United States Patent 7,745,391 (HUMAN THROMBOSPONDIN POLYPEPTIDE) - sequence listing, part 227

SEQ ID NO: 595916 - DNA, 1039 bp, Homo sapiens
ggtagagtagattcgcatgctgcgctcgaaaatgatgcacctgtctaatataagagcgcgttacgactgaatctcaggaacgcaatgatcagttttagcttcttcttgcgaccactattcgcctctctgacgacacgtctgctgtccattgttccaccatgatcttgcatccgagcacctccttcctggcctctgtgcccgtgaccccggaaggccgggtatgccgctcgcccggtctcaggttcctggggccccatcttctcggcgaggccgcgctgacgtaacgctggagagtgcatctcaggtagcgagatctgggttacgcggcactgacgaggctggtgctcccgaccgaatgctgagttcctcctggtagctgacgcgctcccagagacgtcgtgcgaatgcgaacgtggcaccgaacttgtctcatctcgccacgggaatggatatcgagctatgaccagccgtggcaaacccagaaaaaggcggaatccgcgactagtagacttctgcaacgtgcccccatttgtgccctgagagtgcgatgcagagtctgactggtgtgccgcgttctcaaagcattgtcgcccgaattgaagcaatgtatccaagtcgacttctcatatacctccggcatcgaagggccctgtcttcctggctcgtctgacatttgcccgcaactggctgtcgttgtgggcccctgcgaacccccccaaggtccttcattttttcctctcagtttccattgagctcggagactttacccgctcgaggcgcgttggggacccacattagcccgcctcgggattagtcctgttggacacccggtccgcccattgggtttgtgccctccggtggggctcctgtcgcgggccttcaccgggagggccggcccccacttcttgggggttttaccgtataccgaagcgccctggattttccggcgcccaagagtttctgtggttgcccatctctgtgcttggcacggttccccccgtgactcccttttgtaccaagtgttcgaagagtttttccg

SEQ ID NO: 595917 - DNA, 437 bp, Homo sapiens
  misc_feature (22)..(22): n is a, c, g, or t
tttaaaacccacctttcctagnaaaagccctttggctggtgaaaaaagagccaaagttgaacccttccatattccctcctttttccttaaaatcataaatctctcctctacttccttctcttttgcctttcaaatcagcatttttaaaagccatttcttggccctggcacgatggcttatgtctgtaatcccagcactttgggaagccaaggcgggtggatcacctgaggtcaggagttcgataccatcctggccaacatggcgaaacccccatctctactaaatatacaaaaattagctggtgcggtggtgtatgcctgtagtcccagctactcaggaggctgaggcaggagaattgcttgaacctgggaggcagagattgcagtgagccgagatcgcatcgctgtactccagcctgagcaatagagctacactcc

SEQ ID NO: 595918 - DNA, 899 bp, Homo sapiens
aattccccttaggctagtacgaggctgggtgtttaatcggccgaggcctgccggctgctagtctgggaagtgaggagcgcctcttcctggccgccatcccatctaggaagtgaggagtgtctctgcccggctgcccatcatctgagatgtggggagcacctcagccccgccgccccgtctgggatgtgaggagcgcctctgcccggccgcgacccagtctgggaggtgaggagcgtctctgcccagccgccccgtctgagaagtgatggagcccctccgtctggcagccgccccgtctgagaagtgaggagcccctccgccctggcagccgcccctgtccgggagggaggtggggggtcagccccctcccggcagccgcgccgtccgggagggaggtggggggtcagccccgcccggtcaggccgcgccttccgggagggaggtggggggtcatgtccccgtcccgtgcagtctgcccctgcctgggcacgcgaggtggcgggtgcgcctccgctcggccgctgtcccgtccgggaggtggggggtcgctctgcccggcgccccgtctgggacgcgtgaggacgcccctctgcccggccacatcccgtctgggaggtgtacccaaccagctcacttgacgaacgcgcccactgactgacgatggcggctttgtggcactgcaaccgggcgcgcaccggtggcgcaccagcactccaccacactcagagtagtgcacgcgctctgctgctccacccgcacgctcgcccctgtgcagactcccttccgctccgctactcgcacccttcttctgcccttgcgcctgccgccactcaccgcaccttgccccattccctgtctcctacctatttgcctggcccactccggtctccgggctccgg

SEQ ID NO: 595919 - DNA, 121 bp, Homo sapiens
gctgacctcgtgtctcatccgtaggcgctctctaactctaatattttttgtgctcaccaaagtatagtacctttgaccagattttgtgaactcagatacctgtggaagccaggaaaataat

SEQ ID NO: 595920 - DNA, 412 bp, Homo sapiens
gagacagggccacaccatgtacggtcaggcgggtctcgaactccggacctcacgtgatctgcccacctcggacacccaagagagtagggattacaggcgtgagccaccgcgccaggccataaacaaacttacattggagtatgtactcacatgcagaatgatgaatcttctgtctatgacacctgtgaaaccaagcacctagcatagcagcaacagcactgttagtaggagtcttcaaaatcccttgtgtgttccattgtcaattgctgtatccttccccacgcaggcaactactatcctgacttttccaatgcagagatgagtttggctggtttctatacttcatataaattgaattacactatatacttgttaccgtctggcttcttgagattgacattataagttgatc

SEQ ID NO: 595921 - DNA, 102 bp, Homo sapiens
ccgacgcagtacaaactcgtcagtgacactattggacaacgggtggatccattagatgctagactattcagagatcacaacagatatgagacaagctgccga

SEQ ID NO: 595922 - DNA, 211 bp, Homo sapiens
gatgaagaagagaaggaggcacaacttggaatgaagtctgtggataagaaggttgagagtgccaaggagtccataaaatttgggagaactgatgtggctgaatcagaaaaagaaggacttttgactaaatctgctcatgaaacagtcaagccttcttgatttattttcttcatcatcaaacaagctaagaacagttttggttctaggcttg

SEQ ID NO: 595923 - DNA, 150 bp, Homo sapiens
ggcgcgtgtgtcatctgcattcttctggtcgtgtctagcggattccccttggattgctcaggtctggtaggacatttgggtcatcgttgcacgttatgataaccgctctgggcggtgcggaggaatgttctggatccatgtcctccatgt

SEQ ID NO: 595924 - DNA, 289 bp, Homo sapiens
agtagaagttgttggataagtctttatcttcttccaagcctacatgtgatgtagagacagctctgagaataactactgctagcgttgtcatatagaaagaggtcctgtcctgtccaaatcttccaccaaacctgtgtatggattagcagtaaggctgaagcgttgtactatgactggagtccatatccatacctatctatacctgcttaatgacctcgtcccatggggtgtgagattgggttgaagaaatcagtccaggaactgtcctctgggcttggtgttgtccttc

SEQ ID NO: 595925 - DNA, 157 bp, Homo sapiens
tcagaaaagccagttttttttttattggtaaaggtcggccataaacttctagcgggtgccaatgggtcaccggccacactcgcaccaggtggtccgggtgtagccagcaaacagagtcgggccatcagcagaccaggccagggaggtgctgagggtg

SEQ ID NO: 595926 - DNA, 484 bp, Homo sapiens
  misc_feature (248)..(248): n is a, c, g, or t
ttatccccactgtggtccgtaccactatcaagtgttcatctgcatgacataactgcttacctttattggatttttttttgggagaactccattacacttacacgttgtctcctacaaaagactctgggaaggatgctattgagtggtttcttttccacagcttgtgtatttgattcattggctgctctatgtgcttaatccagaataccagttacatttgctctgtcccaggtggaactacacgaagnttatgtatatcttccttcgctgacattaactgtgacgcccatctacaacttttccatgcttcagacatatacctcacttccacctctttctcaaggcatgtcttgagacaggaatagatgtgagcttgttaccccttccaagatccacagcattgcactgtctacctttgcatcttataattggcccattttgaggcttcttaggggttcgagccccaatacgtaatcctggtcgt

SEQ ID NO: 595927 - DNA, 906 bp, Homo sapiens
atggaccagtgttgcttagtgtcttcactgtattttctttaaaaaaaaaaaaaaaaaaaaaagggcaaaaataaaccactcaaaagaacaacaaaaaaacccagcacaaaaccgacgagggagtttggtttcttggatttctttggccaagggcaaaaagatgagatgccctcagcagtgaggattttggcccccttgtggtggggcccgtggcccccaaccttcaggctggccagatggctccccggacaacaccagggctacagggagccagacgcccaggccttgcccgggcctccttgttcctggcccccacccaccacctggcctgggagaggaacggggtcgggtccgtgtcggaaaagtgacagggtcccagagccaaagccgggcctcaagcatcatcagggaggggtgtagtcagttcgaagggcagtctcccaccggagtttcccgagcctcaaaatccaggagataacgcacagccccacccactctgagatgacagcgggctgacttcccgagcggggctttcccatggtccccctggctccaggtcctcctatggcctctccatggaagtgggtggcggaaggtggaggggccgggcgtccccatggcgttgatgtcgcagtagttgatgtgtagctgtgcgccatgtaatctcggccgatggtgttccccccacagaacagcggggtgccacacgggccggccccgggcctgacagaccagacaatacccgagactccggcggattcacacaaacacagggaactgggggatggaggagagacccaccgactccctaagaacccaaaggggccccgcgcaacgcgtcccccacagacaccggacacagcgggggagcaccactacaaacaccggatcaggggcagaaacccg

SEQ ID NO: 595928 - DNA, 170 bp, Homo sapiens
gcccggattggacaacggggttaacagcacaacgcctgagcttgacaggtgaagaaaccgccaaaagacagatatttcagcggaggtggatgctgtgcctgcgggtagtcccgtacctgagtgcaggtccacgatcagctgcgagccgtggcaggagagggggactggag

SEQ ID NO: 595929 - DNA, 526 bp, Homo sapiens
  misc_feature (195)..(196): n is a, c, g, or t
  misc_feature (202)..(202): n is a, c, g, or t
  misc_feature (210)..(210): n is a, c, g, or t
  misc_feature (219)..(219): n is a, c, g, or t
  misc_feature (300)..(301): n is a, c, g, or t
  misc_feature (327)..(327): n is a, c, g, or t
  misc_feature (342)..(342): n is a, c, g, or t
  misc_feature (357)..(357): n is a, c, g, or t
  misc_feature (428)..(428): n is a, c, g, or t
tttcctaagcccaacagtctcggccgtaacaacgaggaggagcggtctcagaaggaggccgaggccgcccagcgctggcccggggagaaagcccaggccagctccatccccgtgggcagccgctgtgggggcgggcggcggaacaattcctcgccggggcaccgtcatgtatgtaggtctcacagatttcaagcnnggctantggattgntgtccgctntgatgagccactggggaaaaatgatggcagtgtgaatgggaaacgctacttcgaatgccaggcaaagtatggcgccttttnnaagccagcagtcgtgacggggggganctccccgaaggaganctacgggttggacgngatatgacacctaaagaaattcccttgtttcagctcctagctcagccactgactgcccctcctgtgtgtgnccatggcccttttctcctgaccccattttaattttattcattttttcctttgccattgatttttgagactcatgcattaaattcactagaaacccaaa

SEQ ID NO: 595930 - DNA, 657 bp, Homo sapiens
  misc_feature (538)..(539): n is a, c, g, or t
tcagttatccatccagccattcatctcccaattgttgatggctgtcatgatgctcacatataccatttcttccataagcattatcccttttcttcatcaactcttcccttcttctataaagaataatatgacatgtgtattgaaactgggattatgatgttcactgcacatgtgatcttactgacatcacagtcaaatccaaaatttcaaagtattgcacaacagagacttactgtactattactattatgaccaaaacataaaatgtggttaccattaaagataaaggatctgtcttaatattcactgtgcactcactatgttcctaatactgtgtaggatattctagaaagattagaaaaatgttcttgccttaaagaatcttttgcctccctacaataatagtagtaagttattattatattcattagaggaaaaatgagcaccaaaatttaaataatcataacagtaccttaccaactttggcaaagaacaaataacttaagtctccttgagtgtttttacatgcactggtgtnnaaatcttcaaaatggctctggcctagttagccaaataaacagtcctaagtaaaatttagtttgctttgtattaataaaacctgtaactatgactctcagtagaaaagtgatcatgtga

SEQ ID NO: 595931 - DNA, 106 bp, Homo sapiens
ttggtgcaggctgagtagtggtgcatctcgtgtactgcacctcgtctctgagtatgtgatctcccacttagcccccaggtagtggactacaggtgcacatcaccaa

SEQ ID NO: 595932 - DNA, 416 bp, Homo sapiens
  misc_feature (85)..(85): n is a, c, g, or t
  misc_feature (318)..(318): n is a, c, g, or t
ggggggggggggggaaaaaaacacctcctccgcggggggcccttaataatgaaataggtttcacaaaatttcaaaagcggggccngggaaaggggttccgcaattaaaaaacccctgggggaaaaaaaaaaggcaatgtgaaagggggaaaggttatttttgaagccaagccaaaatagggcgcttttgtaaaccaaacattggacagggtggggacttttccggaagaagaataccggttggaacaaaaaataaacctaaagaaattcccttgtttcagctcctagctcagccactgactgcccctcctgtgtgtgnccatggcccttttctcctgaccccattttaattttattcattttttcctttgccattgatttttgagactcatgcattaaattcactagaaacccaaa

SEQ ID NO: 595933 - DNA, 202 bp, Homo sapiens
gggggtcccgtggtggtggtggtgatgggtgtcgtggttgggtgtctgtgtgccggtgggtgttggggttggggtcacctgtagtggtggctggtgatgggtgctcgatgtttggggtcttgtgtgccgtgtgggtgtttggggttgggcgtcaccgtgtgtggtgtgtggtgagtgggtgtcggtggttggggtctgcact

SEQ ID NO: 595934 - DNA, 438 bp, Homo sapiens
gtactactggagtccccgagctgtaggcgtgtggcacacggagaactctggacccacaatttcagatgtgttatgtcgccacgagcgacgatattcgcgtcagacacatctgtctccacgatagcgtatgggtgcgtcgtactgagagatagaaatatgggcacaccacgagatatagagatgctattggcccgctcaaggagaggccggagtgccaaggcactggggcaaggtaacaccgtggttgaccggggtgggagcaatcccggagccgtgggagcccacggaacaagatgccggttggctccacagggcccggactgtgggccgggtgtggaacacgggcaagctttctttctgtgggcggaagacaccatggattcataccgtaaccgcccgggacacgaatggtgggttagcccgcgcgggtttggggcc

SEQ ID NO: 595935 - DNA, 174 bp, Homo sapiens
gttgactctagacgatccgcccgactagccgacaggactgagggccccgagtagcccgacagcaatttagcaccacgctgctaaaaccgtgaagtggcggcagaagaatccctatttcccaggtcctgctggtggctgctgatgccctgcgcccagtcgggcgtagtcgggggg

SEQ ID NO: 595936 - DNA, 794 bp, Homo sapiens
  misc_feature (26)..(26): n is a, c, g, or t
  misc_feature (43)..(43): n is a, c, g, or t
  misc_feature (53)..(53): n is a, c, g, or t
  misc_feature (76)..(76): n is a, c, g, or t
  misc_feature (97)..(97): n is a, c, g, or t
  misc_feature (101)..(101): n is a, c, g, or t
  misc_feature (238)..(238): n is a, c, g, or t
  misc_feature (242)..(242): n is a, c, g, or t
  misc_feature (244)..(244): n is a, c, g, or t
  misc_feature (247)..(247): n is a, c, g, or t
  misc_feature (252)..(252): n is a, c, g, or t
  misc_feature (275)..(275): n is a, c, g, or t
  misc_feature (509)..(509): n is a, c, g, or t
  misc_feature (532)..(532): n is a, c, g, or t
  misc_feature (559)..(560): n is a, c, g, or t
  misc_feature (567)..(568): n is a, c, g, or t
  misc_feature (571)..(571): n is a, c, g, or t
  misc_feature (583)..(583): n is a, c, g, or t
  misc_feature (592)..(592): n is a, c, g, or t
  misc_feature (599)..(600): n is a, c, g, or t
  misc_feature (624)..(624): n is a, c, g, or t
  misc_feature (639)..(639): n is a, c, g, or t
  misc_feature (645)..(645): n is a, c, g, or t
cttggaatccactagaggacacactntgttaaaaattaaacanaaaagaaatngcatcgatgtaatcagaatgaanaccgcatggggtcgggggagntgtnctcacttataactatgagggaagaggatctccagctggttctgtgggctgctgcagtgaaaagcaggaagaagatggccttgactttttaaataatttggaacccaaatttattacattagcagaagcatgcacaangagngnggnggcantgctacaattaggtctttgtcanacattctggaggtttccaaaaataatattgtaaagttcaatttcaacatgtatgtatatgatgatttttttctcaattttgaattatgctactcaccaatttatatttgtaaagcaaggtggtgcttatcttttgcaaaaagggaaaaatggtaaaacagacaactggggaatctcaaactccagcactggaattaagggctctaaagcatctggtcttttttttttttacggntattttagaataaatatgctggntaaatattagtccaacattagctaagnnatgctannatnacattattatgnattcacttnagggganngttaaaaaataaccagaatattgngtatcactatggganaaaggnttggaaagaacatgaagactggtttaatttaaaatgtggcagctaatagggattggaattacccttactggctatacattcttttggcttgggaggcaaatgtgttaaagggcctataaagagcaatttcttaggaattagtgggaatt

SEQ ID NO: 595937 - DNA, 137 bp, Homo sapiens
tcaaactccatggtggggtgttaggacatgagacatgtattgtcattagtcattgagctgttaccacatggatgcaccaactcattatggataactgtacgctgataaatgatccactacatactgagttgactgta

SEQ ID NO: 595938 - DNA, 201 bp, Homo sapiens
actacgaatctgcaggatggagaaggtctgcacgggaatggtgatccgggttctcctcgccctctagcagctacctgtaggtggcgatctcaatggtccagggccagcatgacattgagcaggtcctgtgtactcctgcaagtggtggggcatctcgtccttgaggctctgcccctcttcctccagccgcgccatcgcctc

SEQ ID NO: 595939 - DNA, 928 bp, Homo sapiens
gtaacgtgtcaagatgagctctcaacattctcatacgaacgtctgcgggaacacactttgcattactagcaagtgctgcatgttactctagtgtcccgatagccatggtccttatccacacggtgatgaatcaacatctcccagggtcgagtagagggtcttgtctaacatggactttagctatactcccgtattgacctagctacgaaagcattagcatgtgaggtggtaagtaaaaccacgaacatctcgaagagacaatcgcgtcgtgtgaggatcgatcttcaataagatctacatatgctgcaccaatacggacttacataggcatgtgcaacgaagtctatcagtctgcccactaaccagtacaacggcactgggctccgtacccgtttcacccaaaagagtcgtcgagaaagttgtatcgtggagggcaagggtaggagcatcacggagcataaggggagaggaaattgataggagagcatgggtcgtgttatggtcgatttgtgcagccagaaagaagtagggagtgaaaggggcgggaggagagtcgtatgaatgaacttctcgtaaaatggctgtatgcagtatcgattcggatcaaactagcatgtgagttaggtgggagaaatcatcgtgtatgagtgggcaaagggtggggaagacctgggtcaagtaatgacagtgatctattctaagtccacccaatttgaatgaccgtgccgtcttctggaggttttgcccacatcaaattgcgtctgtggaagtctgcctatgaccttgacagaggactagaacctgagtgcacactcatgcacgggattgctgagagactggatttgtcgaggcataggactatagtacaaaagcgaacatatatgtggagaaaatcagccacctccaatacaaacggccggcaaagcca

SEQ ID NO: 595940 - DNA, 848 bp, Homo sapiens
aaaaaaaaaaaaaaaaaaaaaaaaaaaaaaaaaaaggggggaccgaagaaaaaaaaaaccccaagaggggcccacaaaaaaaacggaacacccaaatccatggaaacggggggccccaatgaatgtgagagtacgtatttatattgcgtatgggagaggtggagcgcgatttctaaagcgatgagacaggtgggaaaacagtggaagagatggtgaaatatatgtgtagagaggaaacacatattatatagtgatggggtgcatatagtgtgggaaaacagttacccatagaggagaatattttaaggcagcgctctatgaggggtgaaacttattacaagatgtatataagcagagtggtattataaaggtgtgtgttacaaccatataggcacggacgaaatagtgataggatgagtggaagtaggaacggacgttattgagtgaataatcaggtggcgtattgtgaaagatgaatatgtaggaaagaagatatataattaattcagcacggtgggtggcacaccatgagcggaaggaaaaaacaggaggaggcataggaaggagagtggaagagacgggagagtaagtaaaaagcacgaggggctagggagaatggtagtgggaatgataggatggaggtagagttagagctagagaagagagaaggtaagtgagtagcagaggtagggttgaaggatggagggagagaagaagaaaggacggcgagtgcgagagagcagtcgtatcggaggagatggggaggcgagagaagtagagaaagggaatactaaaagaaaggagatagagagaagaagatgagaggagaaggacagggcgggacggga

SEQ ID NO: 595941 - DNA, 410 bp, Homo sapiens
atcctttggagcctgggagactccccaaaaaggtatatgctatcgagagtagaactttgtagctgtagattagtgatgtttaacacgcctacttgcaagtctagcttctgtgggaaatccaaatgtatattgtcatgcactcaggatactggtcgtgaagtcgagcaaatatgatagtgcattttagcctaattgatcatatgtacgtagttataaaagtagctgtagatggctagcaattatgtcatttgtattaaacccagatgtatttctgagtatgtggttcagggtgttgtgaaaaatgttttaccttttacctttgtcagtctggaatgagaggatttccttttcccctttgtagttcaaagagtacattatgcatcatttcggactcaataggcatgctcatg

SEQ ID NO: 595942 - DNA, 421 bp, Homo sapiens
ttatttagaaaccacaagacaccacagagagtgaaataacaatcacatcatcactttatctggagaccagacatgatcaagtacaattcccacaggaaatcaactctccagtaatattaggaagacaatatcctaggatgtgacaaaatggaaaagatgagaaggggaaaggcagaaatgatacatctaacaacatggctggcatagctggatcccagccaactggccccatcgatcagatattcacagaacagcaaggaaaaagatgggaagaaggcaagcgtgccagccttacacttggatgctacttggggattcaggcaacagctgcacaccaggtaatgctcccgcgagcagtcagctggggaagcgtcgtgcctcatcctcactaagagctccggctgcagaccagtccatgctc

SEQ ID NO: 595943 - DNA, 115 bp, Homo sapiens
aatgacatgttataggcaatcccaacaagtttaacttattgtagaactgtaattgaacagcccgtatataacgatgtttccacagggcacattcatagttattcttagttgtctt

SEQ ID NO: 595944 - DNA, 128 bp, Homo sapiens
tgatggccacctaccgttggcacatatacatcactgcctcatgcagtagtgttgatctaccttgtgctcccatctctactcaacaatcgtgatagaatcccatcaaagctgtttgaccgacgctggcg

SEQ ID NO: 595945 - DNA, 560 bp, Homo sapiens
tggcatcactgtcagtgtatgtagtgactgtagcagtggagacgtcaacagacgtacctacacttgtgccagtcaccgagttttggcaatccaacgtagccaactgttcaaaccatgttcaagtgaggctgacgccgagctgtaagcaatccggctggttctgtggctcacttctggtttctgtccatcactttccttttttctggtccgtaaatcttcttctaacctgtggctgtgctggagtctctgagccccactccggcttgggcggttgccttattcaggaatcgttcactgctcaattaaactctttcaaatttaattcagctgaagtttttcttttatccaatgaaatttgctcatgacaattcatactttaaaaaagacactaaagaaaaagcataaaacttcacaatcttcagctgaaaagaaaattactacttttgtgcattaactctacttttctatattttctataattcacatattttctatatttattttcatatccttgatttttcactataatctttcattattctagacaaagaggccatagg

SEQ ID NO: 595946 - DNA, 122 bp, Homo sapiens
gatctagagatcccacggttcaatgaactttgccaactattgatacataagggttgagagaaacaagcatctatgcagtttcttttggcgtacaaatgatcttacataaatctcatgcttga

SEQ ID NO: 595947 - DNA, 294 bp, Homo sapiens
ccacaagatcattcatctactaatcagtgtaaatatcagctacagctagaactaaagcaagttatacactaattatcccccacattcacactgatgccgtactaaataattctggttctaccattcccttatgcacttttagcaagtctaattcctgtggaataatgttctgtttgtataactcatagtattcacttatagtgctcatgtcaggaatggcaagtgagttagagcccctaatagtctgctattgttagaacgtaatgcacagataataaaacatgtccacttctt

SEQ ID NO: 595948 - DNA, 238 bp, Homo sapiens
  misc_feature (155)..(155): n is a, c, g, or t
accctctctacaatgtgcagctatttatagaaattctagaacagatatatctatttttattgaaaaggaaaatgatgcggtcacaattcacggttttaaacccagcttatcccaccagattcgcacgaagacctcccagaatctttgaatccagntgtaagaaacagtagcagcattaacataaccattttcagtgacacactggtagcattctgcgcgttgctggcggggaaatcac

SEQ ID NO: 595949 - DNA, 275 bp, Homo sapiens
  misc_feature (238)..(239): n is a, c, g, or t
aaaggagtgtggattcgcgaccgaggatgggcaggtcaggcagaggctgttgccatggttataatgagatggcaccttggggtagtcagaaaagggagcacagtaaaagatctgaaatatgtcggaggcacttgctgatggataccatataaggcgggatgaagaaaaagagaatcaaggataatttctcagcatccaaatttgcaacaaatgcatgagtggtggtcagtgttaagtnnacaatggggcagcaatgcacagcagcaagtcaggtt

SEQ ID NO: 595950 - DNA, 415 bp, Homo sapiens
gtcgactctccaggatctcccatagaatgtataatatacaaagcagtaatgccagcagacatcaggacttactttctaaattaagcccagagctcactttaaaaaggcagacatcctggtccaaatgacacccattccattggcttcgtccacaggtggccattccagaccatctctggttccatgtctttattagcaaccacaaactggccatagatgagattctccaacctacaatgatattaaaaaccagttcatttcctctcaacaaactacaggtgctactattggttctttctcacaggcatcaatgccagccacctacagttctgtggctaagggactgactgcactatagggttcccacagtcactttggagttgagtcttggggaaagaaaaaggaacacatgtat

SEQ ID NO: 595951 - DNA, 99 bp, Homo sapiens
gatacctggggagatccggattctgcctacgatagtaggctgggggaggcctgagaatctacatttctagaaagttcagaggtgaggctgatgctgctg

SEQ ID NO: 595952 - DNA, 945 bp, Homo sapiens
ctccgtactcctcattgtacccattctaatcgcgatggcatccctaatgcttaccgaacgaaaaattctaggctatatacaagctacgcaagaggccccaacgttgtaggcccctacgggctactagaacccttcgctagacgccataaaactcttcaccaaagagcccctaaaacccgccactatctaccatgcaccctctacatgcagcgcgaccccgaccttgagactgcctcaccatcgactgcttctactatgaagccccccttgccccgcgaagtaccctaaccacctctggtcagacttcggagctagtgccctcctatatattctagccgccttctagaccgtagccgtgtgtatgcaatcctgctgatcagggtgagtcatcaaaggcaaacaaacgcgcctgagtcgggcgctggcagaagccaaatgggcctcgagcatcgaatcgcgtgattgacatgtcacccgtaagcccagcgattgcatacttatcaggattactgaagtaagtggctctcctttatcacttgcgtcctacccctgatcagtagatgacaagaacaccgtctgaatgaactaccatgccattcatgaagcgctgtggccctatgaaattactcgatttcatcctgcccaaaacctaggacgcgaaggaacccaaatccgtacggcccccccttgcggagctgggcggaagggggggccccggaactagtactccgggcttaacaatgattcgacagaccgccgcagcaccccttgcgcccaaaagcgttcatagccgcaaggcgcacggctctcctgactgagacccctcgagacaaccgggcgccgaggaacccagatcaggacgcggcccccgaagacgccaaacactttggaccaaaccgagaaaacccccgcctgtaaacaaacaaaaccggcgctcgacaacca

SEQ ID NO: 595953 - DNA, 116 bp, Homo sapiens
atctccttaagttatagcattcagatgccacatgatataatcatatttcatatcttcttcgaaaccacacttatccccaccttgtgctatcatcacccgatgagtgtatcaagctt

SEQ ID NO: 595954 - DNA, 1733 bp, Homo sapiens
ctgaggaaagggaattctccccgagatatcatacaactgtggtcaacttgtgccttacgaaggatgaatccaccaaggtcaaagtataaagagcttctgaaacatccactttattctcgactgtatgaagaacgctgccgcttgtagcgtcgcaatgcgtatgctttgtaaaatcctggatcgaaatgccagactactcccagcatctcgccatgctatgatcgattgcatactcgcttgactacaatcagacttcatagaacaaaatgggctgagcagcgaagcgacagacgctacaagaaatattctcatcccgttatcacagtgctgatttcattgcgtcggcccagcacaccccactggtgcacatacagcagttgtgtagtctgcgttttcccgatcactgtcctgctactagctgcgcgtgttacaccatcagcacacagatgccagtccctatgttacactaactcttgctctctgagtcgaacaacacgcagatgcacgccggcactgagatacacgcgaaccaagcaccccgacaactccgcatgccctccctaaccccgccgcacgacgaaaaccaactcaataccacctggaccaaacgctcgcgaccacgtccacagaaaacggaaacacacgacaggcccggaaccctgctgaagtacaacgactccaaccaagtcctcaaacactcgcccactcccccaccacacaccctgcaaacaccaaccgcctggccaccacctggccaagccgataccccgggcacaacggggagcggcccccccgacaccaagcacaggtcgcgcaaagagtcccctggggcacagggaccaacccagacgacccgcgaaccccgggcacacccaacagggatcacggcaaacccatacagcgaaaaaccacgcgggagcctacgcaagcgtggaacgcaaacgaccgacgcgaggcaacaccagacacccacacaccgacaagcaaaccacccaactctggggcacacttgcactgggcaacggcacaggcgacaagaacacaacaacagccgcacgcgcacacactaccacacctgcacacacgtaccacacccaacacgggtgacacaacacacaacacaccgatcacgcccaagccagtcgcaacaccatcgcaccggcacaccggcacacaatcagatgcaccactaaacacgccactagcacacacgcaccaacgagagcgccacaccacaccagtctgcccacccagccccgaactcgaatacccgggaagtaggcacacaaacactcaacgggcaacacacaaaccaacacagggaccctaaccactatcacccacacaaccccggggagtagtcggtaccaaccgccgggcagacacagccaacgactaggcgctgacagccaacaacgggctacccacaacacgccacaacagcccacagcaccaaaagtaaaccaacacgcacacgcagcacacgaaaccgcagaaggcgacccacagacaagagaccggccacacaacagcaagccagccacaagaccagccaacgaccgcaacccagacccaccacaacgacacagcgccgcacgcacacacgccacgcaaacaacgcgaccaacgcacaccaagaacacacgcacgacagggcagacacacacacgatcgacggagcagccgcacagcacgaccaccgaacccgcccgcgcgccacacccgcacagcag

SEQ ID NO: 595955 - DNA, 288 bp, Homo sapiens
  misc_feature (225)..(225): n is a, c, g, or t
  misc_feature (251)..(251): n is a, c, g, or t
  misc_feature (270)..(270): n is a, c, g, or t
gaagcgtttcgtgctgtctgggggcagtgctaaaatctcggtcacactgtctgcagtctctggaatgttattgtcgggagccagcatgggtcccggaggagggaggccatgttttttctgccaatttagttttctgcgctgacagtctagaagacgcatgcaggaatcaaggtctcagacagcccagtggacccagaccaggcacccacgttcttgggatccacnagcatttgcagccacccttcatgccnctccaagtcacttggctanttattgggcaccaacctc

SEQ ID NO: 595956 - DNA, 81 bp, Homo sapiens
acggccgtgtattactgtgcgaaggcgggccctatggttcggggagtggaagactactggggccagggaaccctggtcacc

SEQ ID NO: 595957 - DNA, 1249 bp, Homo sapiens
  misc_feature (1222)..(1222): n is a, c, g, or t
cttggttccgttggtcttgactttctgacattcatctcttgcttcgtttattccacccatttatcataattcgcgcactgtttacctgggcgcgcttttgcgactaagacagatagtgcgcagtacgttgtaggttcgacgcttgtgtccgtcttcatcgtgccttgtcttccgtgggtattcgtatctgtgtgtgtctcctcttgcgtctctcgtgtctcctatttgttgcacggcgcaaacagggtggccacctgtgggctccccatgtgcgctgcctcttgtaattgtgtgttcttgagtatggtagttccgtttcttacccttcgtggctaactgtggggtgtcaggtcgtatcctgcacacgtgtggatgcatcccgggttccagcggcaccgcattcattgtgtggtccatgctgggcaatagccaatatccccagtaagtcatgcgaatcggattttcatacgttggtgcatatgtctcgtttctccacaggattcggagtccccaggagcctctatctgaattctactgtgcactcgggcttccccagagatatgttcggacggaagcctatcgagccaccatcgcgtccattctggaggaatggaatatcctacgcatcgacgatgctgcgacacgatgatggcgctagtcaggtatacactgttacccccagcaacatcgaagagtgcctaaggcaccttccagagtgctcttgtgtgtgtcggtgacgcatccctggaccgccagcatgcagtgagaaggctcctgacatgagcagctctcgaggaatttcccagctcttggggctcaggtggctcactcaagagccctcaccttggggccccatatacgataatgatcacacaagatacagaaccctctccagcctgttgacccgaaccctaaccaacacaatggtttgtctcaatctagacccaacggcatggaccctccgtaaattcttgacgctcttcccccttcccgaggtcccgctagggagctctagcgcctggctgtcgtcgtgctggccgctcctgacaggcctggccgtagcccgtctcaggacctgcatccactgtttaacactaaacccaaggtcatgagcattcgtgctaagataacagactccagctcctggtaccacccggcatgtcagtcagcactctgcccttcatcacgagatatccgcagccgtggctaggattccacttcntaagctccatggcctcagaaagccatg

SEQ ID NO: 595958 - DNA, 530 bp, Homo sapiens
gtacggaatctggaatctatgaatcctagctattcgacagatagtaccatatgtgggatgctgagttggatgttatatatcgtctcctgaaagacattgtctcaaccctgcaaggtgtggcagaccgagctggcactgtaactagatcttcacaaaggccattccgcctttctatcaagccagtctgcttcggtatgatgagagaacatggtaagccatgagcacggagcccattgctgtacttcacttgctgtgaaatgagtttattcatcaaaagcactgctgtgtggaacacgttggtggtggaattatgcattctgatactccatcgattatagttttggcagagcattatgtgcagggaaagttcaatcctaaatctagactgtctgtctccagtaccaacaaagtgttgccctttcattgatggaaggagtcctatctaacctgccacaaggtggctggtttatcacccctaggtaatgttgctgcaactcattattggtgtctgctgctggcagatcggcata

SEQ ID NO: 595959 - DNA, 473 bp, Homo sapiens
  misc_feature (4)..(4): n is a, c, g, or t
  misc_feature (79)..(79): n is a, c, g, or t
  misc_feature (90)..(90): n is a, c, g, or t
  misc_feature (111)..(111): n is a, c, g, or t
  misc_feature (114)..(114): n is a, c, g, or t
  misc_feature (233)..(233): n is a, c, g, or t
  misc_feature (290)..(290): n is a, c, g, or t
  misc_feature (307)..(307): n is a, c, g, or t
  misc_feature (319)..(319): n is a, c, g, or t
  misc_feature (329)..(330): n is a, c, g, or t
  misc_feature (332)..(332): n is a, c, g, or t
  misc_feature (336)..(336): n is a, c, g, or t
  misc_feature (351)..(351): n is a, c, g, or t
  misc_feature (382)..(382): n is a, c, g, or t
  misc_feature (386)..(387): n is a, c, g, or t
  misc_feature (389)..(389): n is a, c, g, or t
  misc_feature (391)..(391): n is a, c, g, or t
  misc_feature (395)..(396): n is a, c, g, or t
  misc_feature (408)..(408): n is a, c, g, or t
  misc_feature (413)..(413): n is a, c, g, or t
  misc_feature (428)..(428): n is a, c, g, or t
cacntacatatcttgaaataatactcttcctaaaaattaccttcttccattaataggaagacccttttctatgcatgtntttggcttaanctcatctcaggataactgtgntgntgttcacttacaccaacaaatgcagacaacctgatctaattaacaaaaattacaaacagctaaatgaacataatatacagggaaattatcgtcagattaatgcacaagaaatacaaganatttttaatgatgaaatattcagtattcttgttcattaatttagccttgtgtttttncaaaaatagtatctacnctgtatacgggnctatacctcnncntttngttctcccatatagncatcacacatccaaaacatggtaccactgcngtgnntngnaaanncgaaaaacaggnaaaangcaaacatacaaaanacaaaaacaccttagaaaagggagctcatcctaaggtttcttaca

SEQ ID NO: 595960 - DNA, 1125 bp, Homo sapiens
  misc_feature (365)..(365): n is a, c, g, or t
  misc_feature (500)..(500): n is a, c, g, or t
ggttttaaatttgtgggaagaaaatgtagattttcgcggaaagggttcgcccaggagaatttcttttgggggaaaaattttgggtttcgtgggaaacagcccgcggttatggtgtatccggaatgtacccacgagtttccgctcggggagagatattaatctagcgcttgggagcccgttgtggaaatattcgtccgagcgccgccccttggagaaaatggtgggctttaatagagcgccccgagagggagagccctggagaaagttggtgcccctggtgtttctcttctagatatgtggagaaacacccgtcgtgttattggagtaaatgtgtggggttgggcgccttttgtaggagaatgggntttgtttacaacatgcgccacatacacgcgtgtgtgtgtgtggggagaaagtgtgtatatggagattctcacacgcttatagagataatgagaatgtgagaagagatgtagatgtgggagaaaatatatgagacnttctacctccacacggtgagagccacacatgggctcgggggagatgtggcacacaccgtgtgtatagtggagacacacccacattttatatgcgcacgcgtgtggagagagagatatccgagagtgggccacacatgtagaatatttcgtgagaatatcccgcgtggagagaagtgttatataacacctctgagagtgcacacaattagaatgggagagcccctcaatacacacacacagagtgttttccacagtggtgtgtaacacacacaatgttaaagagaccctcttcacaaactaaacacaggggttatagtggagaggtgggaataatattggtgtatagcacgagggtgaacacacttgtgagaatataaagagagggtggggtggggtgaatatagagatggttgctataacacgccacaacaccacaaggcttttgcacataattggcacataactatttaaaacacatggctggagacacaaactttgttggggttatatttggagaaaggagaatgcacaaagaatgaaaggtctgtttttgtgtaacttttaagaactttgggtattttactttttggaaaagaataaacccagaattgattgggcacatcca

SEQ ID NO: 595961 - DNA, 102 bp, Homo sapiens
caaacaatgagtataataaataaaaaataaaagggggaagagttgttaatggtttacctgcaggttcagttctgattaaatcatttgtgtttaaagtgtcaa

SEQ ID NO: 595962 - DNA, 270 bp, Homo sapiens
acctaggagaagtgcagcattgtctatctagtctaaggacactttttttttggttttcctgagacgaggtctcactatgtggcccaagcgggaatgcaggggcaccatcatgagcgcacggcagcctgacctcttcggttcaaccgaacctccggcctcagcctcctcagtagctgggactaaaggcacacatcaccacatcgggctaattttggtatttttggtagagacagggtttttccatgtggcccaggctgggctctaactccg

SEQ ID NO: 595963 - DNA, 175 bp, Homo sapiens
  misc_feature (9)..(9): n is a, c, g, or t
  misc_feature (35)..(35): n is a, c, g, or t
  misc_feature (73)..(73): n is a, c, g, or t
  misc_feature (76)..(76): n is a, c, g, or t
aaggtgacnatacacagagataactctggctgttntgcataggacctacaagtgggctggggttggtggttcnacnctgtaggcccaacactttgggaggctgaggtgggaggatcctttgagcccaggagtttgagaccagcttgggcaacatagtgagaccctgtctctacca

SEQ ID NO: 595964 - DNA, 101 bp, Homo sapiens
atcctataaaactccccagtagagtggctgccacttaagttgagaaccactatttggggtacccttgtgtaatcccattcctcatcttctcttcccaaaga

SEQ ID NO: 595965 - DNA, 198 bp, Homo sapiens
gtgtggggggtgtgccccccccccccccccaaaaaggcttttttttttttcgggggtttttttgtgggggggggggccccccccctcccccgggttttttgggggggggggggggttttgggggggcccccttttttttttttttcgggggccccgggggggtttttggccccccccccccccgggggggccctttta

SEQ ID NO: 595966 - DNA, 570 bp, Homo sapiens
  misc_feature (511)..(511): n is a, c, g, or t
gaggatccctccttgaccaaatagttgtgggtaaacaaaatgaaaatatctcacctctatctggggaaacaccctttagtgtacatttagtgtcctttatttaggaaacaccataataaaaacacttatagtagagggggacatacactataatgatctaagaagctacagatggtcatagtggtttgccggctttacaaaatggctccagatcgggaatgccagttggaccttggtcttctataatatttcctttttttcccctcttggaatctcggtatattggattctgaactaaaatggttctcttaaatattcggaatccgggtaatgaaaggtgggggggtattttctttacctccaaggaaagaactactagctacaaaaaatatttgggaataagcatggtttgggtatagggtacatatgggggtggaagacaccagactgaagtaaacagcggtgcatccaatttattatagtttggtaagtaacaatatgtaatcaaacnttctaggtgacttgagagtggaacctcctatatcattatttagcgccgtttgtgacagt

SEQ ID NO: 595967 - DNA, 602 bp, Homo sapiens
cccccaaaatacaccagcaagcaggtaggcaaggcctttaagtttagcccaaggccccctaccccacccctaccacggagccatctggaccgaggtgtgggagtgatggagcaggtttactgtgcctgcccgtgttgggggccagcctgaaccaacagtgggaggtggggccttagtgcctcaccgggcacacggattaggctgagtgaagattaagggagggtgtgctctgtggtttcctccctgccctctccccactggggaaaaacctgttatttgccaagtccctggaccctggaccaactactgggccttattggttgggggtggtaggcaggttagcgtaaatggggaaggaaatgggtaagaagtttactccaaacctaggtttttatgtcagaccagacctaggtgcttttttaggagggaaacagggaaacctggggtcctgtggataactgagtggggagtttgccaagggagggcaccttcccattgtgccttttgtgtgtattgtgcattaacctcttcctcaccactagggttttgggggtgggtcccacatgcccttaaccctaacaataaagttttttttttttgga

SEQ ID NO: 595968 - DNA, 318 bp, Homo sapiens
tggaacctcgagggctactatacatacaggaggagagacttcagctactgcagaccttcactctgttcggcttgctaccgtacatattcattccatgctgcctggccttcagatggctggactagatgcccctattcacatcagtacagtgaccgtcgccagccaaacataagtgaccaacaggtttctgccttatcatattctgaccagattcagcaacctctaactaaccagaggcggatgccccagaccttccgtgacccagcaactgctcccctgagaaaactttctgttgacttgatcaaaacatacaagcat

SEQ ID NO: 595969 - DNA, 335 bp, Homo sapiens
  misc_feature (2)..(2): n is a, c, g, or t
  misc_feature (84)..(84): n is a, c, g, or t
  misc_feature (86)..(87): n is a, c, g, or t
  misc_feature (90)..(90): n is a, c, g, or t
  misc_feature (93)..(93): n is a, c, g, or t
  misc_feature (106)..(106): n is a, c, g, or t
  misc_feature (108)..(108): n is a, c, g, or t
  misc_feature (115)..(115): n is a, c, g, or t
  misc_feature (117)..(117): n is a, c, g, or t
  misc_feature (120)..(122): n is a, c, g, or t
  misc_feature (124)..(126): n is a, c, g, or t
  misc_feature (130)..(130): n is a, c, g, or t
  misc_feature (136)..(136): n is a, c, g, or t
  misc_feature (141)..(145): n is a, c, g, or t
  misc_feature (148)..(149): n is a, c, g, or t
  misc_feature (152)..(152): n is a, c, g, or t
  misc_feature (154)..(156): n is a, c, g, or t
  misc_feature (162)..(164): n is a, c, g, or t
  misc_feature (170)..(170): n is a, c, g, or t
  misc_feature (183)..(184): n is a, c, g, or t
  misc_feature (186)..(186): n is a, c, g, or t
  misc_feature (190)..(190): n is a, c, g, or t
  misc_feature (193)..(194): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (205)..(205): n is a, c, g, or t
  misc_feature (207)..(207): n is a, c, g, or t
  misc_feature (209)..(209): n is a, c, g, or t
  misc_feature (211)..(211): n is a, c, g, or t
  misc_feature (214)..(215): n is a, c, g, or t
  misc_feature (217)..(217): n is a, c, g, or t
  misc_feature (221)..(223): n is a, c, g, or t
  misc_feature (228)..(229): n is a, c, g, or t
  misc_feature (231)..(231): n is a, c, g, or t
  misc_feature (234)..(234): n is a, c, g, or t
  misc_feature (240)..(240): n is a, c, g, or t
  misc_feature (242)..(242): n is a, c, g, or t
  misc_feature (246)..(246): n is a, c, g, or t
  misc_feature (249)..(249): n is a, c, g, or t
  misc_feature (251)..(251): n is a, c, g, or t
  misc_feature (259)..(262): n is a, c, g, or t
  misc_feature (320)..(320): n is a, c, g, or t
cnagggagctcgcggcgcgcggcccctgtcctccggcccgagatgaatcctgcggcagaagccgagttcaacatcctcctggcnanngantcntaaaaggttaatnantataaanantannnannnaatnaatacnaaacnnnnngtnngantnnnaattcnnntaaaanaagacagtaaaanncnaaantanngatcntnananangntnttnnantatnnnatttnntnctnttcatncntaanaantncttaaaannnnaagtagtaaccaaagataaaatcctaggaatcctaaagatttctacaaagaactattntctcatagtattcat

SEQ ID NO: 595970 - DNA, 138 bp, Homo sapiens
tgaactctatctccactttcacaaagcaacctatccagatcattcctcaggtcatctagtaaaccctatggctgattccagattgttctcgtaggtttctattttgaccgagtatgcaaccaaactgtccacaacgcg

SEQ ID NO: 595971 - DNA, 844 bp, Homo sapiens
  misc_feature (4)..(4): n is a, c, g, or t
  misc_feature (7)..(7): n is a, c, g, or t
  misc_feature (29)..(29): n is a, c, g, or t
  misc_feature (844)..(844): n is a, c, g, or t
cggnatncggccatagggccggggcgggnaggggtttgcagggggggaaggcccacgaatggacccgccttgacccgatactgacccctagaccaccagacccacaacgcgaggcaacgcatatcgactagtagaaggaccgatgagtctggtgaggcaaaaatgacacgcagcacaaaactagctacaaaagcccaaaaacgagttattgacgggggaacctgcgcctcaactcgcggaagcctgatagacgagggcgcgaaacgggcacgagagatgaaggccgagcataacagatggcacaacaggagatgagaggacgagcgacggaaagaaaccaagtacgccatggggaggtagaaggagacgcgagagcaaactctccccgactaatgacagacataaccaagacggatgaaagtcggaaagtaacgcagacgaaagactacgggacgaatggggaggagatgtacaatagttaacgacataaggaaggaaaccagcgggcgtttaactaaaaaaaagccactataagttgggagaatgccaaaataggtggaggcccgagagcggaggatagttggatgcgcgccaaccgaagtctcccggcgagcggcacgcggccggtataaaaagtggacggcggtcatcccaacgccgtcacacccgggcgggcccggagccgcaacaacagagcgtagagtatatcgcccataggatacaatcggggatagctgagagaagggctcacacaatatactcccgccgctatgggaaggaacaggtggactagtatacatacgggccttactacatggtaagagagaactcgccagcgtgcgan

SEQ ID NO: 595972 - DNA, 580 bp, Homo sapiens
  misc_feature (570)..(571): n is a, c, g, or t
  misc_feature (576)..(576): n is a, c, g, or t
actccaccctccacactcccaaaggcaggcaaagaatttaagccactaaagagaacactcccaacatgaaagggaatggatgctgtaaaaaataagtcaaatgaatattctcagacactatcacttcatttttttcagtcctccagcaaatcaagagccttaaaaatattcaaacttaaatacttagtaatcatacatctaagaagatatacagctttatgcacaaaaatattcctcaatgtcctatttatagcagtgaaagaaagaaagaataaatgtcccaagtgatggtacaatcatgtaatgacacatttatgcaaccattaacaaaatggtatttaccaggcaggtaaatcataacagctataacaataaactgttataacaataaaatgttatatataaccttgattatatatacacaatgttaattttaaaaggctggaaaatgctgacagtggtaatttctctctggacaatgtaaatgcttttctgttttccagcatttaaacaaaaatgttaattactagtttattaacactattggtaataacaataaattcatattcnnattcnaaaa

SEQ ID NO: 595973 - DNA, 232 bp, Homo sapiens
gctgatgtcgatcttgacattgatggctgctgactgcttagggtggtggttgctgaaggttgggtgacagtggtaatttccgtgatttttgttttgttttgtttctttaagagacagggtctcattctgtcactcagggtggagtgcagtggtacgatcatagttcactgcagccttgacttcccgggctcaagcaatccttctgcctcagtctttccagtagctaggaata

SEQ ID NO: 595974 - DNA, 237 bp, Homo sapiens
  misc_feature (9)..(9): n is a, c, g, or t
  misc_feature (50)..(50): n is a, c, g, or t
  misc_feature (67)..(67): n is a, c, g, or t
  misc_feature (90)..(90): n is a, c, g, or t
  misc_feature (93)..(93): n is a, c, g, or t
  misc_feature (101)..(101): n is a, c, g, or t
aatcatgtncctgccccaggctgcaggccttgcattaggctcctgctgtncctgccatgtatgtgtnctagtcatcaaggtgtatatatnttntgtacctnctgccgatgggctgtacatagtgtatgaaagttatttaagaccccatgttgtacatttctgttcctagattggatgtgtgtgttctaagaagttgtcataaataaaacctgaatgccccaatgtcaaaaaaaaaaa

SEQ ID NO: 595975 - DNA, 125 bp, Homo sapiens
taacaacatacccccgattccgcttcgactaactcatactcctactattaaaaaaacttcctactactcactcttcttaacttatatgataatcctctataccctacctgcctatatgcatgctt

SEQ ID NO: 595976 - DNA, 389 bp, Homo sapiens
aaagaatcaaagttgacttataaagccaataaaagcttcttgggaaatttggccccatactttgtctaggcagtccctgcacagggtttctggcctatgaggcctcacccatctgcaatgtcacttcctagatgggatgcaactacaaaactaatctactctcaagaactagacaggattatgactgccttcatgagtattcacagttcttcctgtaacctgttgaatatacacttagccaatctttcatcacaaccagttactattagaaatggggagcatgccttataattaagactaacttctgtgtatacatcccaggcaatttggaaaatgtctcagatagccctgcaagatatgcaccaataaaacaaagctatgccttaaaa

SEQ ID NO: 595977 - DNA, 1023 bp, Homo sapiens
  misc_feature (107)..(107): n is a, c, g, or t
  misc_feature (109)..(109): n is a, c, g, or t
  misc_feature (319)..(319): n is a, c, g, or t
  misc_feature (345)..(345): n is a, c, g, or t
  misc_feature (369)..(369): n is a, c, g, or t
  misc_feature (373)..(373): n is a, c, g, or t
  misc_feature (388)..(388): n is a, c, g, or t
  misc_feature (390)..(390): n is a, c, g, or t
  misc_feature (400)..(400): n is a, c, g, or t
  misc_feature (411)..(411): n is a, c, g, or t
  misc_feature (415)..(415): n is a, c, g, or t
  misc_feature (430)..(430): n is a, c, g, or t
  misc_feature (461)..(462): n is a, c, g, or t
  misc_feature (467)..(467): n is a, c, g, or t
  misc_feature (475)..(475): n is a, c, g, or t
  misc_feature (502)..(502): n is a, c, g, or t
agcggaggggccgccccagcgaaggggcggggcgcagatctgtttccctcagactccatctgcccggggccgctaagggagcgcaaggtcaagttcgccttggcccngnctccagctcaggtactagggggtctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagntacctgcttcagcctagatcctgccntgaagcggactgctgctccctggntccnactctgatctgcttncnactcttgccnttgtctcccanttantaagcagggtggccnactgcaacacggtgtggatgtgcctgaccannatgangagccganctacctgtggtgctcctggcctgtggntcctttaaccccatcagcaacatgcacctgcgcatgtcagaaggtggccagagcatcaccgtacagccaaacaggaatgtaccaggtcatccaggggtatcatctcctcctgtcaacgacacctatgggcacgaccgacctcgccgccttctcatccccgcgtggcccatggcccggctggccctgcccgcacctccgactgcctcctggttcggcccttggcgcccgtgaccccgcccccgtggcctggcccccgctgcacggtgctgccgtctcttccccgtctcctgcctcgcatctccggctcccttcgccgtgccgaccctggcaacgcccctccctcctcaccctgcccctcgtcctacgcgcgcttcctcggcgcccgctcgagcccctgccccgccgtcctgccgcctcccctcccggcccgcggcgcgctgccgccgtctcccctgcctccctctctcctcccggccgcgcccgtctcccctccgcacgcccgcgcccgtccgcccgccccc

SEQ ID NO: 595978 - DNA, 990 bp, Homo sapiens
gcacttctccattcagatgagaaaaggaagtcctgtttacaagctctgtggaggttcaaacaacagtgtcgtttggggaccaccagttttatactgtgatgattaaacaggagacatgctcttacatggtcagaggatgcctatgagttgacttcattggatggccttaatattgccttgcagtcattttctcccaatgatgcagaaattaaacttatggaaggactaggagcatatggtaaatttgtgtttaatgataggcttactggaatccatcttaggtccaccttcctgcagaaggagggcaggagtaaagcagcatctgcgttcatgttttctccagagctgtgcactccgcactaaccgtccactcatcactgtcacacttccaaagcaaacagaaccccacttccaatttgcaaaggttatttgaaaatcaagtgtgattattttagcagaacctaatacaatcaaattactcagttgccttacctcatgaagagttatgttcacagactgaaaaagccaagtagcactttaggttccttggtttcaatttgagtctttttttcatattaatcagaagactagaaagaccctttctgcaaatcacaaagcctggttcgattatgaagctgcttaatcatcttcaggtgtttagagttatggtgtgtgtgtgtgtgtgtgtgtgtgtgtgtagtgtgtgtgtgtgtgtgtgtgtcactttgggcggtgtgtacataaactgggaaagtgcttactatgtaaagatagatgggcattttaatcttagccctttggtggtataaccggttttggaaaaatttggactggagaatggaaggtgccccaccggggtttttagagtgtaaacaacagtggcgggttattagacctattataagatttttgaaaaaaaggggtttttaggggaacacttttaagctagtataaggggaaggaaatgatcgtgagcacaattattatatc

SEQ ID NO: 595979 - DNA, 869 bp, Homo sapiens
agaaccttcaaagtgaagactgagatttttactgtatatatgggttttgtaaagatggtttaacacactatagatgtctatactgtgaagaagtgttgttcaattctgaaaaaaagcatacatcatgattatggcaaagaggagagaaagaaatttattttacattgacattgcattgcttccccttagataccaatttagataacaaacactcatgctttaatggattatacccagaggcactttgaagcaaaggtcagtggggatcgttgaatacattaaagaagagtttctaggggctactgtttatgagacacatccaggagttatgtttaagtaaaaatccttgagaatttattatgtcagatgttttttcattcattatcaggaagttttagttatctgtcatttattgtttttcacatcagttggatcaggaacgtgtataacacatcttagagcaagagtaagttgggtattaaatcctcattagaacaaccaccggtttcactaataccttacccctgatgagtctatctaagcatatgcatttaaagccttcaaattacattatcaacatgagagacatcaccaagaaagacagatgttcaaaataatagtcccatatctgtaatcatatctactgccacgttacgctaatcggaagttttaaaatctatgggcattttacacgatgcatgcacttggaccgctgggcaataacttaatccctcatatccccggtaaaacatttctcagatgtaacggccaataatagaacaagccttatctcgcaaatgcgcgaaaggcgcgcgaatgaataacagcagtttcaaaaatgccactataaaagaggacaacttgcacct

SEQ ID NO: 595980 - DNA, 129 bp, Homo sapiens
cctcctgcctctgcctccagagatgtagggaccacagatgcgtgctaccacgcccagctagtttttgtatttgtattttttggcagagatgggggcgtcactatgttgtccaggctggtctctaactct

SEQ ID NO: 595981 - DNA, 185 bp, Homo sapiens
ggatcccaaattgaggtcgggtgtgggggtcacaggatgtactcgggcactagaagcacagtgccttcacagagcggactgacatgcgcaggaatgtctcgacttgttcctgtgtctttctgtgaagcagtagagcagcccgtagttcttgagcagtggtcatggttgtgcgagtttggtgtcaa

SEQ ID NO: 595982 - DNA, 209 bp, Homo sapiens
tagaccggagcatgattaactatggcatacttagatcaggatcctattaaagtctagaccattggcaatatgatagtaaattatattctcaatttcaatttacaattcatcatttttagatcataacatttttcttttttcttttctttttttttttttttggaaagggattttggcccgcggcccacgcgggagcgagaccccatcat

SEQ ID NO: 595983 - DNA, 143 bp, Homo sapiens
atgctgagattgccctgtgcaattacgcgctccgggacgccatcgaccagcagacggatatcccatgggcgatcaccgcccagtcgaacatcagcgatctccagcagttcgtccatcattcgatggaggtggtttcgattgat

SEQ ID NO: 595984 - DNA, 399 bp, Homo sapiens
tccggttgtaaacgagattcacagcctctccatgtcacgtgggcctgacagaagctcatacatgcctcatgtgaggtgtccaccctctctgagaatcttccttgtccacaacagcaccgacatactctgtgtaaacttttacggtgactttaggcggacggggagtttggaaattgtaaaaggttatagattgttgcctactttcctgctgacagtaaatgtctctaaacacagtatcatatacaagctgacatacaaacttggtttgggggggagatcctttcctaccccacagtcatacaatatcttctttacctgccttgtggaaatttttatagtttatgcctttcaccactttgtcttaacgtctgtcctgatactgctttttgtgcaacttat

SEQ ID NO: 595985 - DNA, 1095 bp, Homo sapiens
gtatgctgtgaactgccagcgtgatcacatggcagaggattatcagccactttgatatttttgcatttggacatttctggcggctgggccatgaaggccttgctgatccgtagttacggtctctgctggacaatcagtattacctgggagctgactagagctcttcttcatgcatctcctccccaatttttgccgagtgctggtgcggatcaagtcattctggacagtcctgtcgtgcacatggcgcgtggcattatggcctgggcactggctcgcttagccggcttcaacagcagatgcaggacttaccactgggcaagcttcaaggacattcataccaccaccgggcaagcatcacgagagctgctctgcagcttcactccatgctagctggcacctactgctcccgactggcttagacccacaaaatccttctctcttccagacgacgctagactggagtgtaccctttctccatgcactcatccttggcaagctagactgacgtcggacattacccctttctctcctctggaaagagccattattctatatgtgcttcacccaagccccagctcattccacttacacggcttcggacgcgctacgcacacttcctcctctctacttggactgcgcacttcacaagcctttcccaccaccagctgcagcacctcaggtacgcttaaccgcctattaccttcacgcacggaccactcccatgattggccaagcgcccgcggcttagagcaacctcccaatgccctcccgctgtgtatctggcgcgatccacttgggagcttctaacccttgcgcaatggtaccaactttgtgtaatggccatctccccaatctctccggcaaccaaagcaccttctcccttcaattctataaaagcaaaaccccacaacacttaaccatgctaactgtgctaggcagccgttaggcgccctacacatcactggcgtctcgttcctacttccaccgcagtgttttagcccgtccctgccgccttgtatccgggccgtgcgcacctcgcgctatcatctcaggtaaaaccaccaacgcgtgttccccgcgtcgcaactacggaca

SEQ ID NO: 595986 - DNA, 842 bp, Homo sapiens
ttacccaggtgtgccgggctacgactgatggggatggagaaccggatgtccagcggagctgcgggctacggatgttgagccagacccaggtccctccagattaccccaggtttgtggagtctgtggatgaatatcagtttgtggagcgccatgtaacacgagacataacaggatcccaggatccccacaaagcatgaacattatcctaccccatagtgagctggaagaccatcaccagaagaaccaccaacaaaccaaaacatgaacattactatatgatacagaacagctcatcgagatgcaacaaaaatccccgatcatacaaaggaacaatcacagcatgaggaaaccggaagatgactgtagatccgagaaagtggaaaggagacatctgggaccctgcagaaagacagtgagaagatatactagagaccgctgcatggagaagacacactgtaaaccagagtcaatgaagtgacaagagtaccctacggatcaaaaggctaaattatgaaccagagacacttaaagacatgagctcataagagacgacaaagggattactgagagaccaagaactaagcagacatgcatatgtaaaaaatagccactgaagaaatcaaagtctaagggagaccacaaagaaaagagagaaagtagaatagtagaaaaacacactgaaaacaaggaaaatacaaaaaaatagaactaaaaagaaataaggagaacaagccatagcatgcataaaagagacaaaaaaaatcaatttacaatatgatagaaaagcctcaagatgaaaacaaaaaagaacaaaaaaataggaaatacaaaaaaaacaaaaa

SEQ ID NO: 595987 - DNA, 811 bp, Homo sapiens
  misc_feature (202)..(202): n is a, c, g, or t
  misc_feature (217)..(217): n is a, c, g, or t
tctcttgtagatcgatgttctgtctgtgcacaactcgtattcgggcgtagtgtgagaatatgactagtggccccccatcttcttctttccgcgtgtagcacgctgtcttgtgcgagaggcagcgtctggtactcagtatccttcgtaggagaaaatattgtgagaatatgaggcgaaggcttttgcggtgtggggagcgccncccccgcgaggagtngcagtaggagcagaagccaataatattctacggcgcacgggttggcgggtagagaatgatgcttcgatgtagactatgtgcgcacgctcgtatgataggaggagatgcgtggcgacggaggtgttaccgaggcgtggcttcgtaagaggctgccctctctgatgtgcaggggggggggtgctttaatgtctgcttgagagagagccaaaggggcagcccgtctctgtagtaaaggaagtgctagtgtatcatgtgtacacaacctctctgtctgtgtcgcaggtagtgttctcccccgcccgcggcatacagatggcctgtgttatgaaaaaaggggtcgtcgcttttggggccggtcgccagcttgtgattttgacagacgagagttgtactcgcccggcctgggatgttcgagtctcccgccggcgtgcgctcccgcggctctctcttgtctgagcatagtctagagtgtagaagccctgttctcggtccgcttcgcgagagaaatgggcttttattaaatggccaccctttcttgctacccggcctccacttgcaggacatccaacatcattctgcccaacaatgtcgaga

SEQ ID NO: 595988 - DNA, 1852 bp, Homo sapiens
ggtggatagaggatgggcggggttgtcgcgttgtggttgggtggagtggttgtggcgtggctgagtgtagatgtggttgtgtgcgttgtggtggttggtgtgatgattgtgtgtgggtggtatgtgtggtggtgcgagatggagtggggcgagggggggaggggtgttagatgtgttggtgtataggtgggaaggtggttgtttggttgaagggtttttggttgggggggtggttggtgggttgttgggttgagtgggatgagatgtggatgagtgatagatccaggggggtgtgtgagggtgtaagatgtgggtgtggtgtgtcgttggagatatgttggaagagtgtgattagctgtgggtggtggaggtaggtgtgatatgcgggtgggtgtggtgtgtagggaggagctttgaggtgtgtgtggagtatgggtgctttgggggtgtgatgagggtggtagggttgtggggtggtggtgagaggtgggaggtggggtcggagtgggtggtgtaggtcgttgcggttgtgggtgggtggagaggggtgtggtcagggcgacagtgggggtggttggataggggtgtggggtggtgttgtataggtgttgtctcgcgggtttgtagatggcgatgggaggtgtgtggttgtgtgtggtgtggtgtgtgcgcagattgttgatggtgcggtttgaggtaggtgagtgtggttgtgtaggtggtatagggggtgtttgtggttgttgtggggacagatgtgtaggatttgggggtggttatgtggcgtagtaggtcctctagactggtagtagttgatatgggtggctggctttcatgagatagtagtgtatggcaaggttgtggtgctaagtggggccgtgtgagttgtgggtgcatagtggatgtggttgtttagtcgtatggtttgttggtgtgtgaggttcggtgtgtgtgtggtggtcaagtgtggggttgttagtggggttgttgataccgtgtggtggtgagtttaatggggtttgtgatggcgcttagtgtgggatgagaagatggtaagtggttgtgtcgtcaatggcgtgtatgagaagttggttaatgtcggttggtatgtctgtcgtcgtagtagtataatggtatgagaggttatgttaggtggcgtgagggcggcgcgtcaagtgtaggtcgtaaggtatgttgtgtgtagtggtgaggtggtgtgttgtgttgggtgagtgaggaggtgtggggaagttgtgtgccgccgtgaagaggtgagtgcgttggtgtcgagtggcggcgtgcaggagatgtgatataagggttggtgagatgtgggagtgtggtgtgtgtagatgagagagagagtgagtagaggggttggtaagtgttgtggcgaagaagagttagtagtaggttgtcagggagttggggagagaaggtgtgcagttgtggtgttgtttgagagaggtggtggcgcggcggagtgtgtgttgtgtcagcgtgtatgttgcgttggagtagagagagtgaggtgggggcgcagtgaggtgtagcgcgcgcgtgttgtcgggcgcgccagtgtactgctctaggtagccgccaggtggagtctgtgggctagagtagaagtagggaagttggtgttcagcgcgctgacggcaacgttagagcagctgttggaagactggcagtaaacctgtcgtcacgcgtggacctgtaagcatacgtggcatctaattcatcagtgctcttttctcacgtccctgagtccaggttccctcgccagaggagccaccagttctcatgggtggcagctcagtctctcgttctcttaagcctgagcggacttttt

SEQ ID NO: 595989 - DNA, 549 bp, Homo sapiens
  misc_feature (433)..(433): n is a, c, g, or t
  misc_feature (451)..(451): n is a, c, g, or t
  misc_feature (473)..(473): n is a, c, g, or t
  misc_feature (522)..(522): n is a, c, g, or t
tatatactgtgactaaataaaaattgccttttgctttcccctaactcttaattcaagtggtatttaatgtttcatctctcgatgtgttaagctgtgtgtggttgcctctatatctattccttaagtatcaccaaccacatttccaagtttttatcagtactctctctttgggaaatgaggaaattgaggttcaaattaattattcaaaatcatattgtgatagtgaagattagaaattcatttaaccccaaaccctagtttttctttgtagtgaagcctacttaagacttacttaatgttgtctttttggtaagattatcattttgaagaaagacccttcaacttacttggtatttaaaatatacttgaattagagccaaggatcttgagcagattaccaaattaagctcgatgcgggtagaaaccaaatggnctttttaatccgagtaanctacctggtttaagtggtggcnggtgatggtaatgaggaaaatgtgtttgggaccttggtcccccggtccngacgtagagcttttaaatcccctggga

SEQ ID NO: 595990 - DNA, 262 bp, Homo sapiens
ggccccttaaaaccccggggggttttttggggcccttttttgggggggggggttgcccccccccttggaaacccctttttttttggcccccccccctgggcaaaagggtttcctttttaggggccccttttgggggggggggtttttcccccctccgggtttggggcccccccccaattcccgcggtttttgccccccccccccccccctttgggcccccttttttttttgggggcccctttttttaccgtttttcccccca

SEQ ID NO: 595991 - DNA, 1223 bp, Homo sapiens
ccacgcgtccgcccacgcgtgcgagcagagccacatccagagtggggtaatagactacaggcggaccgcgatcccagtttctctaaacccacggtactgtccccagtaggtatctccttctcccgttgagtacttgttaattcaccttgtctgcagaggtgtccagagtatctcaagttgtcgaacccttggagcgtcgcgcagctccattcccctaggttgctagactcaatcacgcatggcttagcgcatatgttgactgtcttcaattgccatggcttacagtactaatttgctggcagactcttgtggcccagtcccatgtgctctcagcttgtgagagccactcatgaggggctatcgtgtgcgcatcatgcttctccaggcgccaaggacgcgccttgggccatgctgcatgactggaggggcgaaggggcacgtgaactacacgtttttgccttcgcaccttgcacgtggtggtctgtcaggccactggaattgcatcaggtcgtgctgcagactccgccgcatgatgccaaggcccctctgtccctgtccagctggagtgccctttgacatttaggacggccgagacaggggcctcgagacgcccagggggggactcctaatggggaagcatgcagggaccgcaggctggactgccacggtccgggcgacgaacggaaacgctaggacacgggctttactgggtgtggcgacgcttacctgtaaccaggagtgttcgacggttagcccggaacaagtgggcaaactgaagggctttccctggcccaaatcggctcccttgagaacagcagaaatcagccctgggaagccatgggagcgcatgcatgggcccggcaaggcagggggcggcacgcgggcccctggattgggtagcccggccagggactccatcctccgatatcaagaacccgtcccggaaacggggagagcactgggacaaaatggcgcagaacgtcggacggtgaaccgaaggggcccttctcacgacatagggttaatggggctctatactgccccattgtatcacgagcccattaacctcacttaatgtccccaagccattcgacccgtgacatcatccgcttttccccaagcaaattgtggcgcccatattagggttggcccttagtggccataggcaatgacgataagttcaaagggaaattaggatatgcctttataaagtcaatatacat

SEQ ID NO: 595992 - DNA, 323 bp, Homo sapiens
  misc_feature (23)..(23): n is a, c, g, or t
  misc_feature (46)..(46): n is a, c, g, or t
  misc_feature (57)..(57): n is a, c, g, or t
  misc_feature (126)..(126): n is a, c, g, or t
  misc_feature (144)..(144): n is a, c, g, or t
  misc_feature (198)..(198): n is a, c, g, or t
  misc_feature (226)..(226): n is a, c, g, or t
  misc_feature (235)..(235): n is a, c, g, or t
aaaccagccagcgtgagtggtcntgagctgcccaatgcgggctcgntgacacacacntacacccacatcgagagctgccagtgcagggacaccgtctgcgggcttccccaccggcacctccccgcnggggcccggcgctccccntaggcatctgggggagcgggtgagcggggtggggacagccccctttactgcccntcgacagctttactctcccccggccctntgagcctcntaggtcgggcttctctcctcagatattatggtctgagtctttgttcagtccttgcttttcccaataataactcagggggacatgcaaa

SEQ ID NO: 595993 - DNA, 118 bp, Homo sapiens
tcatctttacgagtatccccactcggatcgcccttttttcgtgccttctcagtgtttaagactcatttcttgctcagccgccatggttcctaacatcatctatcatcacctggaataa

SEQ ID NO: 595994 - DNA, 352 bp, Homo sapiens
cagagtgcaaccttgtctcaaaaaaaaaaaaaaaaaaaaaaaaaaaagaaaaagaaaaaaaaagttggaatgacatcagactctgtgtcacttcgcagtggggatgcaattctgagaaatgcatggttaggtggtttcatcattgtggaacatcatggagtgcacgtacacaaacctagatggtgccgtctactacacacacacttaggctgtatggtctagcctcttggtcttagcctacaaagctatgcaacgtgtgattgggctgcgtactgtaggcagttgtaacagtggtatgtgtatatctcaacatatctaaacatagaaatagtacagtctggttgtcatgtgc

SEQ ID NO: 595995 - DNA, 117 bp, Homo sapiens
tcctgtaggaacctgggtggttattggcttaatggggtttgaacttatggcctcggattgggggacacgactctctgaagcgccagtcaaacatccccaaaacgcaaaaaccacgcg

SEQ ID NO: 595996 - DNA, 397 bp, Homo sapiens
  misc_feature (10)..(11): n is a, c, g, or t
  misc_feature (87)..(87): n is a, c, g, or t
gaaggggggnnccccccccccctttgggagtgtgttaaattcccccccagggcgcaggggcttttggggaaatcccccaagtgggantttcccaagtttttttttccaaaaaaggggggggtggtttaggccttcgggccccctggagggccccctgttttttaaaagggcccccccccctttttttttgtcccccagtttgtgggccccccccagcccccgccccccccctttgggcctttccccgggccttttttggggctgccttcaaaccttttgggtggggggaccccaaaattccgggggccccccccccgggggaggttccctggcctttttgggtttggttggggcccccccccccggtttcctttttgggttttaccccccattttta

SEQ ID NO: 595997 - DNA, 315 bp, Homo sapiens
gtgctcttcacccatcatagaagaactcctacacttgtcacgatcacagcctaaagtaattgtattctttatcggctcttttgttgttatatatcatttcacttatagctaacaacaaaactgacacacactagcacgatggatgccctagaagttgaatcaattttgaatcatcctacccgctattattttaattcttattgcccttccatcattacaaatcctttatataatagacgatattaataacccagctcttaagcgtgaaaaccatagtacatcaatgatactaaagctattaggcggtaaaagctt

SEQ ID NO: 595998 - DNA, 566 bp, Homo sapiens
acgagggtcatgtcagtggttatacctagatgaatggaatacctagctaatataagtactaaaactactgtattggcaatcgttgccaagaacctgatgacggaaaccacgaggtaactggaaattcccaaattgcgcttaagaaaaatactacgagactagagaattttataacgtaacttcctaagtgtaagatgacaaaatatgactttcgggatatactggcgttaattttcccgtccgcctaaatgtgggccaaaattcacagctacgttatattaagcaaatattaacagtgcctattatttgctgggtgctgaaatttgataaaaaacttaaaagttaaaaaaaattgtttagatctttagtgtcacattgacttatctgggacatcgctttttttaatcctcacatgagatttggctaagtttatttttcacaatctgttaatctcacaaaaactaaagctgttaagcacagtttaaacccattctgcagggtaagaaattcatctgtaaggcaatctatttgataggaagtaaaattagggtcacttccatcgcata

SEQ ID NO: 595999 - DNA, 225 bp, Homo sapiens
ccgggttttttttaaccttgccttttgttcttcctttttaaattttttttttttcccattgttgttttacttttttaactgccttttttttaccaaattttttcccattgttttttttttaaataattccttttttcattgggagttgagggaacctttttttaagggtttttggatttttttttgttgattattaactttttttgaattattaattttgttgga

SEQ ID NO: 596000 - DNA, 549 bp, Homo sapiens
gtgtgggtggagtggtcatattgagttaggttattacgaaatcatgaagtgttccctaacaagaaacttgcaaagctgatttggcaggcaagaaaatcattaacttctagtttatttatttttattctcatgctatacgcttaattaccacgtagaatccactgtgcatagccattcaccttatattcatacaggacgaagccagcaatgttctatcatcgtgtcgggagtacaatactacatcagattctttaccactggggaaatagaataatactgaattcccaatacagaaatactaactttcataagtctaatattccttatcttttagctgacgttctttctctcttcagcgatactagtttactatttagttattctcacctttgaacttctggacttcgggggagttttcacctattgccatcctactatcttaagtactcctgtacaatgcaatatcttagcaaggaaacagtttgaaaacttcacaaatatccaatttcattcttaacatatgggggaagcagtgaaatgaaacagcac

SEQ ID NO: 596001 - DNA, 236 bp, Homo sapiens
agggatactgtcagcgagatgttgggtctggaggtgatgagatcgggcacacttgagctgagtcaccagaccctattgcttcaacagtgcttggccccgccaggttgtcccagccactctagctgctggatgtgaatccctgggaaatgtacttccaaagcctctgtcacaaaatataaaaatcaccagggaggtttgccccagtgaaaggtgccttggcccagcacttaaggaac

SEQ ID NO: 596002 - DNA, 260 bp, Homo sapiens
ggcgaccgcacacgagcgtgtaccttccatcgtacgggcgcccagacaccagtgcgtcatggtggtgcatgggccagaaggactcctacgtgggcgacgatggcccagatgcaatgcgtggcatcctgaccctgaagtaccccattgagcatggcatcgtcaccaactggtgacgacaccaccacgacgaaacgacgacgacgaattccggcaccacgacgacgaattccggcacgaccacgacgaattccggcacgacg

SEQ ID NO: 596003 - DNA, 853 bp, Homo sapiens
  misc_feature (195)..(195): n is a, c, g, or t
  misc_feature (550)..(550): n is a, c, g, or t
ggagcagaggtctgattctagcgtgggtgctctatatggtgatgaagcgtggcgctcgggtcctgtcctcgtggaagtcctggcgcaaatgggccacggggccgtggtggtggccccgtgggaccgactgagagcctaccgcgccgtgacctggcgctccctgggcgtggcagctggtggcatccgtcgcgcgcntggacatgggagtctccccaggctcgccggtacttctcgtgcatggctgccagtcctaacgcttgacatgggattcaggtgcgcgcgttcgatagggcgggcacgagaatggtttctgggctatggcgcctctgtgggacctgacggagtggctgtcgtggcccgggcttcccacgtgaagcgtggtagagggctcctgtattatgtgacggcgtggaggtgaggatcgtgcgcacttggaaggaccacggagtcttggccgcgcgaccgtgtagacgcgagggaccagagacgcacgcaggctcgtcctccacgtgtggcgggcttcgagggactggttcacggatctccaagnaggctatgttggttcccctgggaaagctcctcagttcgtgctccgagagtgttttggcaatgggtgtggcttcaggtcatgatgatgtgcaggcatcgagacagagtcttggagctggttggcagttggaaggagttcagtgaccatggtggagcgaggagattctagtagcaagctgaagagagattgagtcggtagtagcgggaagaagcggtgaccctcgttggaggatatgcagaggagagcttgggaagatgagaacaaagggagaagagaaatttgggaacggaaaaggtgtcagcg

SEQ ID NO: 596004 - DNA, 136 bp, Homo sapiens
  misc_feature (8)..(8): n is a, c, g, or t
accgcaantctcaaacaccgcaaatcgaacaccattaattagaatagtggagttctttccccattgcttgtattgtcgactttgtcgaacaatcaaatggctagtaggtgtgtggcttaacgttcttagttctcta

SEQ ID NO: 596005 - DNA, 139 bp, Homo sapiens
tttgccccttccctcaaacagggggtgggtggggaggctttttaggcccaggaaaagcattttaaaaaaaccccccccctcccgcccgcattttaaacccaggggaataatcaatagaataaaaggggccgcctgtcca

SEQ ID NO: 596006 - DNA, 342 bp, Homo sapiens
tgtattggtggtgctcccctgaagtcctggctactagggcgactgaggcaggagactcgctcttgtcacccagactgtagagcagtgtcacgatctgggctcgatgcagcctctgcctcccaggttcaagcaattttcctgcctcggcagggacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgattttttttttaagctgaaacttacctcatg

SEQ ID NO: 596007 - DNA, 480 bp, Homo sapiens
  misc_feature (46)..(46): n is a, c, g, or t
  misc_feature (48)..(48): n is a, c, g, or t
  misc_feature (124)..(124): n is a, c, g, or t
  misc_feature (199)..(199): n is a, c, g, or t
  misc_feature (230)..(230): n is a, c, g, or t
  misc_feature (250)..(250): n is a, c, g, or t
  misc_feature (256)..(256): n is a, c, g, or t
  misc_feature (281)..(281): n is a, c, g, or t
  misc_feature (367)..(367): n is a, c, g, or t
  misc_feature (398)..(398): n is a, c, g, or t
  misc_feature (446)..(446): n is a, c, g, or t
  misc_feature (466)..(466): n is a, c, g, or t
  misc_feature (473)..(473): n is a, c, g, or t
agagcccctgcgcctgggcgcgaaaatggcggcggcggcgacggcngngcggttcctgaagcagcagttatggagcttcctcaggccggggcggagcggatcatttgactcgcaccggcttccnggtgactgcttcctactgctcgtgctgctgctctacgcgccagtcgggttctgcctcctcgtcctgcgcctcttnctcgggatcacgtcttctggtcagctgcgcnatgccagacagcgtccttcncagatncgtagtgcggaccatgtgtgcggtnctagggctcgtggccggcaagaggactccggactccgggatcacagtgtcagggtctcatttcaaccatgtgacacctttctgacnacaacatagtcaatttgcttaccacctgtanaaccctctactcaataagtcccccaactttgtgtgctggtctcggggnttcatggagatgaatgggcnggggganttggtgg

SEQ ID NO: 596008 - DNA, 382 bp, Homo sapiens
atggccgcaccatcattacaattcttgtggcgtaaatgatccacggtgggacatctactgtcacttactctgtgtaggaactcgagttgaatcattactcttgcgctttacaccacgcctagggcatcatattccacttcctagaactgcacaccgggagaggatgtatttagattgtggaatcctgcgctggctctttgaggggagccatgaagctgtattgatgataggtctagggcaagtgttggcagctgctgagcttgtggatggtaagctgactgtgttggcgattaatgtcgtcctccatctgtcataggttcaggaagcccatctgtacaccatgaccatcagctgtggagcctatgatgcacgtcatgggttc

SEQ ID NO: 596009 - DNA, 699 bp, Homo sapiens
gcctgtaatcccagcactttgggaggccgaggcgggcggatcacgaggtcaggagatcgagaccatcccggctaaaacggtgaaaccccgtctctactaaaaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaacaaaacaaaaacaaaaaaaaaaaaaaaaaaaaactctccgagactaagtttctctctcccccgtggggtgtgcccgggggctggcttccctaactctccgggtgggaaccgattgggttcgacagattttccccaaatttgtgggcgattctgggaccctaattcccccaagagagttcggtgggagccctctgtgaggggtttggggcccccggtgtgtgtggtgcccctcccatacaaggcgcttggtcgagcgccgtacccgggggcggggcaaaagggcgcctacccgggggggggtcgggggagtttttactctgggggggcgcttcctgggcccctatctcacacgtttgggtcacagggcgcccttccacggcaaggttggcccccgcttggggggtcccccaaatttggggcaaacccgg

SEQ ID NO: 596010 - DNA, 118 bp, Homo sapiens
gacagctccacaacaacctttattactttttatgatcgccacctacgccttactgcccgatccatctggaccagctgctttctgggctggagctttttgacccttctgtcgtcttctc

SEQ ID NO: 596011 - DNA, 404 bp, Homo sapiens
aagaaaatttaaatatcaagggaaaaaaaaacaaaaacaaaggggaaaaaaaaaaaaaaaattaaaaaaaaaaaaaaaaaaaaaaaaaaaaaaaaaaaaaaaaaaaaaattaaaaaaaaaaaaaaaaaaaaaaaaaaaaaaaaaaaattaaaaaaaaaaaaaaaaaaaaaattggggcccaaatttgggcctaattgtgcaaattccctttatggggggccatttaaaatataagggcccgggttttaaaaatggggatttgggaaaaccctgggtttccccaattaaaatgcttttgaaaaataccccctttttcaagatgggaataaatcaaaagggcccccccaaattggcttttcattttccccactctaaatggggggttgtatggcgttttttttttg

SEQ ID NO: 596012 - DNA, 891 bp, Homo sapiens
gcaacaggctatgaagactccctgcccggctgctatatgtctggtaaacagaataaatagtacttgagcatccctgacaaaaaaaaaaaaaaaaaaaaaaaaaaaaaaaaaaaaaaaaaaaaaaaaaaaaaaaaaaaaaaaaaaaaaaaaaaaaaaaaaaaacaaaacaaaacaaagacgaagagcaagcaacagaaacaaaatatacagaggaggaaacgagagaaagaacagatccacagagatacgataggagccgacccggcccggcgagcgcgcgaagaaacgagcgaacgggaagggaacaggaacacgggcgaggagcgacagaggagaaggagaagaagaaaaaggaacagtgaccgcactgcgagagagcacaaccgacagaagagaggaagaagagaggaggaccagccgacggcgagaggaacacaaagaggcgaagcagaagaaaaacgcacgacgaaggcgagagaaaaagaagcacaacaagaacacgagcacgagaacagagaagagccgagaacaaacagcgccagaaacaagaaacaaagacacacaagaggcaaacaacaccaagaagaccgcaacaaccaagagcgagacaaaacaaaactaacacacaatacaaagaaacaacagaaaagcaggagaagaaagacgacaagagcacaggaggaggaaacaagagcagggcagagacggaaagacagacgaaacaaagaacgggacagagagacagagagcacgcgaaacaaacagcgagcccacggaacgaaaacacaagaacaaagacaagaacacaacagaaaggaagagagaaaaagaagaaggcagaagagcaagaacagagccaacagcgcacagaaaagaagaagcagacaaaag

SEQ ID NO: 596013 - DNA, 625 bp, Homo sapiens
  misc_feature (376)..(376): n is a, c, g, or t
  misc_feature (392)..(392): n is a, c, g, or t
  misc_feature (420)..(420): n is a, c, g, or t
  misc_feature (477)..(477): n is a, c, g, or t
  misc_feature (482)..(482): n is a, c, g, or t
  misc_feature (562)..(562): n is a, c, g, or t
  misc_feature (566)..(566): n is a, c, g, or t
cgcggtggctcatgcctgtaatcccagcactttgggaggccgaggcaggcggatcatgaggtcaggagatcgagaccatactggctaacacggtgaaatcccgtctccgctaaaaatacataaattagctgagcgtggtggcacgtgcctgtggtccaggctactcgggaggctgaggcagggtctcaccatgttgtccagactggtcccaaactcccggtctcaagcaatcctcctgcctcagactcccaaagtgtttaattttataaattaaaatacagaactttaattaaaatacataattttaatttatacaaaacaggacaagtaattcatagcacaatttcttttattttgaaaacaaaataaacaaatntgtgtgtagatagaangggaaggttttccctctggcagtgcagngggggtgaagcaaaggggagtgtcacgttttgtgcttagttttatctgactcttacncagtnagagtgaatatatactacagggttttttttttgtctgtctgttttttgagacagagtctcactctgtcgccaggctggantgcngtggcgcgatcccaactcactacgacctccgcctgggccacagagcgagactctgtccc

SEQ ID NO: 596014 - DNA, 1061 bp, Homo sapiens
ttcttgttgcctgtggggtgttgtcctgctcgtgtgtaatcttgtgagtctgtggatctcgtggtgtttgtggtggcaacgtgtggtgttaggctgcggcttcgttgcctccgttgtggtcacatgtcccatgtctcgtgtgtgggtatcattgtagtaacttgcactgtgtgctgccccgggagttgtggtttgtttattccccgtggtgctacgcgtgtatgggggtgtgcgacccccggtggagtgccgcgccccgtgtggtggctcttctcttctgtgtttgtggtccctcgggccactgagtgcttattcagcgtgctatcccggtggagtgtgtcttttgtcgtgggtgtggtgtcggttcgcaccccgtggtgttttctcggtctcttggtgtgtgtgtctgtctcctcggtgtgttgtgcggcggtcgtgtgtcttgcgctcctcctgttgtgctcagcacacgttgcgcttggcttgtcgctgggggggtttgtttcactcgttctgcttgtccagggattgattattgatgtgtgtgtttggtcctctcatcgtctttctcactattctacctgtcactctttcgcgggggtcatcgtgttgttgtctcgcgtgcctcacactgagtggtgtgggatagtcgtgtcgctggcggcacacatcatggtctaccgtcgcggataggtggagatcgtgagtgacctccgatacgtgtgctaaactccgggggtctccctcacgcttttccgggtagctgtgccgacacctcccgcgaaggaaccacacgcggggcgcctgactgtggaacacagtggtgcaggggggcccgtttctctgacatctatccaggcgctggtgaggcccacaggtggtatgcgggttcctgaagggtgccctggttcctagcctgtcaagctctcaaggtgcctggaagccaacgtccacgcaccatgagtgcgacggattcacccgtggccgactctattatccctcgcttatggtttgtttgaaatctataatagaactactttatgagaaaaaagacaaaaaaa

SEQ ID NO: 596015 - DNA, 323 bp, Homo sapiens
  misc_feature (158)..(159): n is a, c, g, or t
actgaagaggcagaagaggctccacgaggcggggcccgtcagcagatcctcagacggcgacacgcgcacttccttttctgtttcctagaccttttaactgatggaattcagtaagcagaaaacgtgcttgaaacaagggcaccatggagcggaccctnnccctctcccctcgtggagtccttgaccctggggcaggtgacccttcttgctttgcaggcaggggctgtggctggagcttctcctacaaacgggctgtgctgggattagcccggctgtacatttgctttatgcttccgttggcatttaaaaatctgatgttcata

SEQ ID NO: 596016 - DNA, 1363 bp, Homo sapiens
cttaaaggagtgtccatacaagcatcgggaatccacgaagtgcctgggactcagagcttatgtgtattgctgaactcagcctgtcctgagctttgggcttcttatcagggccgttatggctgacttgtaggtgtgggattgtgcaacgagtgagttgtccgagtttcttgtaacataacctgatgctatttggcaggtgtgcagtaaagttgtccctacgattatggttaaagcttggaggctaggtaatagacactaggaggaaaaatgagaaccttccgaagcagtctgttgatagtgggttctagtcttggacagatgccgagcgttctgctcgtccattgttagtaaaggttcattgtggcttgttacgagcctttgaatctgtatgcagactcaagacatgttgagtggccaaaggaaaagataagccgaacttccgacctccgcgccgatcaaggcagagagaaaagagagagacgaaaacccaaccatctggtagtcattgaccattttggctacatgcatcattacagagctggatcttcaggctctcgggctaatttacgcctgagttctcacgaggaacgtgtggtacaaaagtgttcctcaatgtagttataaagtctcacgcgcaaataagtcgatcgttccaactggttgtatagcctgcgtggtcactgtgcgtcaggagagatgacttgggtttcggaacgcctttattggctggagatgaatgggaggggaagcccacccggttctgtggcaaagggcgttccctacaaacgtggcaagttgtgacttcctaggcacaggctggatactggcggaacttccacagaattgtcacgggaaggacttgaacagcttagaacaagctccggaaccgcagtggcgtaagagagagagggggcccacggcaggggcacagggacggaatcgacgcgagcatgaagatacgatgccgggcaggatctaaccctgagaagagttggggacaaagggcacgctaagtggctaaaaagccgccgtgaaaggggtaaccccgcatgtgatgggtagtggacgccgaggtactacccgaggtgcggccaacaacgacgagagtagatgaagcgcctacaagtgaatgaggatggcacatcgaacacaccccgacggtgtgctaaacccacggcgacaccaccgtcgctagtttcaggagaacgatagtgaccacgctaatcgactcaacacaacgaggggagtcttcatacagacagccagaccgcacgcctactgcacatagtaagtaccgcagacggaacgtagcaggaatgcagagtacagagtagcgatagataaatgacatactatgtaagaa

SEQ ID NO: 596017 - DNA, 296 bp, Homo sapiens
cgggtttactgtacggtagacctccagatatttatttcatataactgaaacttggtaccctttaaccaacacctccccattaccgtctcccctaacgcctggcaaccaccattctactctgtgcttcatgtgtttgcctatttagattccacatgtaagtgagatcacgtagcatgtgtctttctgtgtctggcttatttcatgtagcataaagttctgcaggaccatccatgttgttgtaattggcaggatttccatctttctaagggctgagtagtacagttagctttcgcatc

SEQ ID NO: 596018 - DNA, 823 bp, Homo sapiens
gaggccactcagaggcccccagtggggacagtggagggggacctagtccccgattctctcacccaccagctccacacattccagccaggcccaggccagtcccccacatcacacccccaggcctcctagcgggcacgcgcgggctgcaaccgcacctctgacccccaaccggcgacgggacaggcgcccaaccttgcactgcaccctacggcacttcggtcaacgatcgcacctcctcgagcaaaatgcacaccgacatcctcgcactgcgcacacatagctgaccacccgtaggtccctgggagaccaaagactgccccacgccctccacggatagccctgccatccactcgcctatcccacaatcacgccgtagaccccactcggcgccacactccaacagtgcgacgcaaatcgccatgtgcacaacacattcccacccgaaccatcacccccttgaaaccatctacactaagcccaaccggatacgacccgtagacccacccaccaaacccactctcccgacctgacatccaccatcgatccactggcccatgccacgtcgcacatagagaccctcgcattcaatataggtgatagcaacaccacggatcgagggccgcaccccaccgacggccaaacacaaccacggaggccaccacacccaaccaacgtacaccacgatgtcaaacagccccatcacacaaactcgctccgccaactacccctaccacacccacacaaccagcaacgagctacaaaggatgacacaaagcgacgtccccacacaactagcgcaagaacaacaacgcgaccacacaac

SEQ ID NO: 596019 - DNA, 107 bp, Homo sapiens
taaaatgccaagataagaaacgatttattatagagagaagaaaaatttctcatccaaaatatagaaatctgtacagttcatgtatattgattgtggcaaagttgtac

SEQ ID NO: 596020 - DNA, 383 bp, Homo sapiens
  misc_feature (125)..(125): n is a, c, g, or t
  misc_feature (209)..(209): n is a, c, g, or t
  misc_feature (271)..(271): n is a, c, g, or t
  misc_feature (280)..(280): n is a, c, g, or t
  misc_feature (379)..(379): n is a, c, g, or t
aaggtctcaccctgttccctagctgtagtgaagtggtgtcatcttggctcactgcaacctctgcctcccgagctcgagtgatcctccccacgtaagcctcctgagtagctggaaccacaaggtgngccaccatcccgggctaatttttgtattttttatagagacagtgtctcaccatgttcccagcccactggttttaactcctgggntcaacgatccgcctcctcagcctcccgaaatgctagattacagacgtagccactatcctagnccatttctnttattcaaaacacttcattatgtccagcacccttgtattagtcatcagaaggtttttcattaagtgtgaaccagagtgaagggaggggggtggttctgncagt

SEQ ID NO: 596021 - DNA, 981 bp, Homo sapiens
  misc_feature (350)..(350): n is a, c, g, or t
  misc_feature (975)..(975): n is a, c, g, or t
tctgtggtggcgctctacaactaagtggattccccgcgggctggacggaaattccgggcacgaaggctgggactccagctacacttccgaatatcttcccacggaatcctggtgccaaacagcacgtgacgaagattggactgtgacgacacgacattccaacgccacactggcttgagacaagaacttctcgggacaggcaccggttacacacttgtggaaacgtgtaacgcacgggataactctaacccctgaactaaacagctcttgaacacttggtatccactttacccacagggtgacacgacatgttgttggcgtcgccacattgttacttggggccagacatngagaccacaggagatctcacgattccacttggggagaaacacaaccaccaactcctcgggctcttggttcactacacacttgagcaacatgtgccacttacaccttgctactatcgttgcggtccgtaattaaccaagctcaccttggacccgagcgtgtttagcaacatcgtcgcttgaacttgggggaaaacaacgcatgggcaggtatacaccccacatattaaatcgacccaatgtgcagagaccaattcaccaccatatcgcgccaacatgtggcggttcaataagcggaaacgaaaggtcccggcacacggaatttgtcccatttccccaaccaggtttgtcgccagaccttgaacatgggcgaaatgcggcacattggttaggccggttacaacatatgtttgacaaattccgcggtaaaaattttcgtgtcaaatacaccgactacttttttaacccacggtgcgaccatccggcgtccccttatttatctccacgacattataaccgcgacactgtggtgtagctggtggttcccgctttgggcaccagggttctccctttaaggacggtggactcccaggtcacaggggggcaccgggccatcaggggcagtgcncacgtt

SEQ ID NO: 596022 - DNA, 1083 bp, Homo sapiens
  misc_feature (371)..(371): n is a, c, g, or t
  misc_feature (417)..(417): n is a, c, g, or t
  misc_feature (572)..(572): n is a, c, g, or t
agcggcgtgaaaagtcccatttgtatttgcatccttatgaccaatgggcttagctggcacatttcttccacatggtggacgtcatggccacagggcacgaagagatggccacgttccagttctggacaggctttccttagggtcctgtcctcactgaatgcacgttactgccggtaaagccctctcgagagtttctcgcgtacccataggcgttgactcaaggtccatagccaactgggcaagtccaccgacatggagaacatgaccagagttcctcgcattacaggactttccaagcaaaacccacatcttgctgcattcattcggtagccagggcctaaatcgctgcctgtctgaaccgggtagctcgnctggaaatgtacatgtgggtccaacaacattcttgggtctgggctnttgaaactagcacttcctgtggggcgcatcgatgaataccagatggtagtcatgaatcatgaagttcctagctggtagctatgtgcgatggatcttctctctctcgctggtcactggtgaaacgctcagtcttaggcaggaatgaggaattccanctttgcaacggcaatcgggaggccattacccgttgaagagtctgcagggtccacgctatactgaagcaggcggaaggtgtccgaagcgtcgtcttccctcgctttgttctggggagtctccaaacgtcggccaagtttgactagaattgtggcggtttatcgagtccatggcacaactcaaggtaaggccctacccaggaagccgacttctaaggatgggcggggagtcgagggtgcaccacgttccgctgccgggttgggcacacccgatttgggctggtcctggaccctattgtttacccctaatttcctttgtttgttcttctggagttgccagggtgcggtaaagggcagctccgggggatcccgaggggctatcgtccttccttgccgtggtgcgttcagggaggttcgcctgtccgaagtggctccgcgggcagagggtggccttttggctttccttgggcgctccccctttcttgagccttgcagggaacacgttttcccctgg

SEQ ID NO: 596023 - DNA, 1211 bp, Homo sapiens
  misc_feature (576)..(576): n is a, c, g, or t
gatattgccgttccagtcctctgctatgcacgacagacatatacgtgtatattccctctactcttattaccgccaagatcatcacaacacgtctgggaagagcacgcatgcgggtattaaccgcactcaaacccatggttctcgtggcctctgatatccacggattcgtgatttgctgtctcatgcgatagattcgagcaacagtaattgtcctaatggtctgggccaaggcagtttggccagattcggtatgtaacttacagtcgagtagctacttattgactaacttccatggatgctcttaagcgtgcgtaatgcggtgcatgtactagatgaagaagactctttcagctgcgttcgtatgacgtgattttagagggtagcaacggatggaccagatcctttgtcattcccacttgcgccacgttagctgaaatagcggtggctagcaccatggggatatcgttcctagaagcgcgtagaagctggggcgcgttgatcattgatccaaatttggaggggatggaattgttgacagaagattggagtttacctatgtaataaggttcgagcacntttgcaagtggccatggagatggaccccgtctcggtgtacgtggtagcacatgttgtgtttccgtaccttggtaggggttgcttgaacttgggttccattgcattacccaccacaggaaacctagttacccgcgttgatattgccggtgccaaataagtgcaaagtttcccggaatctctatatccatctctgggtttttcccaaacgaggataccttctcatggaactagaactatccctttggaggcaataggtccactagaaggctccaagtttgaccgatacccacacgccttaaggccctaatattctatataaccgattggttgtaataccccttacgtctgtacacgcatttggggcccagattagaagacagaaagcgggactttgcctgggtgcataacaattttccccccaaaatcagaaagaaccacttttgggaatcgcccatagcaactaaagcgttcgacattggccacgcgtacctttgggagacacgttggggcgacaagcggcttcgaagtccctatgtcagggaatcccgccgatttcatccagtctttgccatgtgtaaggcccacacgtaacaagacgtaaagaccttgagaactgcgcacaacacgggggaacg

SEQ ID NO: 596024 - DNA, 102 bp, Homo sapiens
tgtcggtaccccggtggtgtagacagcgcggccgcaccgtttgcgccgcgagcacggcgtagcgcatggcttcatgcaggcgggcgggcacaacgtcggcgg

SEQ ID NO: 596025 - DNA, 204 bp, Homo sapiens
tttcaattaaggatatagaattgatcttgtcacaatgcaatagttgtcgagagctaaaggcagtccgatccctgacgaacatacatgtatgactatttgtatatgcgattattgaatttacaatgttacctttttgaaagcactttttttggtgtctcaaagtgagtaactgcagccctcagctgcagctcgccccttagttga

SEQ ID NO: 596026 - DNA, 182 bp, Homo sapiens
  misc_feature (128)..(128): n is a, c, g, or t
tactttccaggggattaagaaaagccttctacacaaagttcatcagctctccaaatgacacaaccactgacaggattttgagactcgcagtagtgatgcacatgcaggctggtaggaaatgggctganagtctgcagcacctagtgccattatcttgcagggtgtcactgataagcatccaa

SEQ ID NO: 596027 - DNA, 362 bp, Homo sapiens
cgaccggaccatattgccccctagctgcagcatatccctccaaggaaagcatatctcattcttttgtaagatggcctgacctttaaaataactggagtcagctgggcacagtggctcacacctgtaatcccagcaccttgggaggccaaggcaggtggatcacctgaggtcaggagttcgagaccagcctagggggtattgacccctaggctgatattgcccactagggtgcatgtgcacattgtgcaggttagttacatatgtatacatgtgtcatgctggtgcgctgctcccactaactcgttatctagcattaggtatatatcccaatgctatccctcccccccagactaaggggcaat

SEQ ID NO: 596028 - DNA, 128 bp, Homo sapiens
ctgacattactagtcggaatgaagacagtctgggcacatagcgagatcacacctctacaaaaaaaagttaaattagccaggttgtggtatgtaccttagttcttagctattcgagaggctgaggtgga

SEQ ID NO: 596029 - DNA, 241 bp, Homo sapiens
tgtttcctcactatggttctaaatattgcttcatttcaaactttgagagatgtatggatttccaagtttttctttactttctcccagtatgttttaacaaaaaagaaaaaaggcaggaaaaaaggaatatttagcagtattgttcgttctgatttgtgaatttgttggtgacaactaaacaaggctttcagcagtttctgacaattaacatacttcattccacactcccgggggaaaagta

SEQ ID NO: 596030 - DNA, 109 bp, Homo sapiens
tgaacgttgtttctgacccagtttgtaagtttccgtcagcaggcgagttttacctattccatggaaagatcctcattatatatctgtgaagttaataaaacagttttac

SEQ ID NO: 596031 - DNA, 425 bp, Homo sapiens
  misc_feature (419)..(419): n is a, c, g, or t
gggctcatcggaggccatcagggaggctccacctctcccagcccactctctctgagttcttcatttattaaaaatgctcttttcaggaacggggaaaacgggctcaagaatcatggctgtggcacccggggcctattgtgtctcttgtcggcgtctcgctgtgaaagcacaatgagtgcttctattttatctgtaagagaagatgactctttattttgctcttcttagcaatgtggtttaataacacgcactgggtaaaaagagaagcgtaattaaacaagaacgacaaatctatagccttggtacaggaattaccaaaaggttaattttgtaccctacctaataaataatgacgtgttctggaaacctttattttctctctcctgaagaaaatccaaatgataataacagggggccantaaacc

SEQ ID NO: 596032 - DNA, 496 bp, Homo sapiens
  misc_feature (27)..(27): n is a, c, g, or t
  misc_feature (66)..(66): n is a, c, g, or t
  misc_feature (101)..(101): n is a, c, g, or t
  misc_feature (124)..(124): n is a, c, g, or t
  misc_feature (160)..(160): n is a, c, g, or t
  misc_feature (170)..(170): n is a, c, g, or t
  misc_feature (266)..(266): n is a, c, g, or t
  misc_feature (282)..(282): n is a, c, g, or t
  misc_feature (307)..(307): n is a, c, g, or t
acacccagccaaattctagagacaggntctttttttgcccaggctggactgcagtgatacatcatngctgactgaacctcaagttcccaggctaggtgatntctcacctcagcctttccaatanttgggtccgcagatgcaggccagtacacccagctcnttaaaaaaantttttttcttttttgaagagtcttgttttgttgcccaggctggaagtgcatggtgtgatctcggctcatgcaagctccacttcccggcttcagccntctcctgccctcagcntcccgagtagctgggactacaggtncccgccaccacacccggctaattttttgtatttttagcagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtt

SEQ ID NO: 596033 - DNA, 1620 bp, Homo sapiens
cttcttgtaccctgtaaatagaccatgacttcgatcagtatttcttgtaccccaccccttcctatcccacagatgtgccccacatcccctgaaaggagctggctgtctcaggtcctgggctcgcgcacttcacacccgtgcagatggaccgcggcgtgaaccgaggcatgtgcacgtgaggaccgcttcgggactgaatatgtggccagctggaccacccctgacccaacacgtctgcagagcggccgaactactctgctatactaactactataatactgctactgctactaccggaaacacacgagaaaacagaaaccagcgaaccaaatgacacccctccagcacacgcgcacccgcacccccacactaacaacagaccagaccccgccacgaacacacacaaaaaacacccccactgcaggcacgcgaccgccaccacaaaacacacaacaccacccaccacacacgcgcaaccaacaaagcctcccaccccaccacccacacaccgcccaccaccacacagcgacaaaccaagaacgagcccccctctcacaccccgcgacaccccccccaccaccaccaacgccccaagcacacaccagcgcgcccaacgcacacacacacatcacaacacaacgatcccacgagcaccccccgcgcagcaccacactcgacgacgccgccaccaccatccgcccgcaccccccttccccgccatccacacgcgacccacccccaaacacaccccccctcggccgacctatgcacacccccctcagccgcctcgccccactacacaccgaaccatacaccagcaacgcactcccgctcacccaccgccctactcccagcacccgtccacaacactaccccgcacacccccacccacccaccacacgcccaacaccggcatccccacacaccctcaaacaccggcgcaccacgccccccacccacacgcccgcacaaacaccctcacgatcccaccaggccaccgacttcacatctccactgcgaccaccctctaccttataaatcatcacaccataaaactacaaccacacctccacaccactcgcaccacttaaccaccacacactcccatagacacctcactacaccaaatcaacagcagctgcctccctccacactaatacaacacacactcacactattcactacacacctcgtcaccacacccacaacacatcacacaactctacacaacaccaaccccaaacgataaaacacaactaacaacacgatacacaaactcaccacaccaaaaaccacagctgcaagcagactgacagggactagacgagcaggacaagagccgagagtgagtggatccggagaagcgaccgtcacatgaagatgacgagcagcgacccgacgacgcaccctcgcatgcccatggatacggcggaaggacggcagactccacttaccctcccatgcggcatcacacgcaagtggacacgagcggcgcggtcgtcagcgctagcgaagcgataaccgcgacacagaaagataatgatgccactacagaacgtggtctgacgatcagacgatcgacggggaagtgaggagcagaagctctcgggagagacagac

SEQ ID NO: 596034 - DNA, 362 bp, Homo sapiens
gctatttgggacattattggcagtgggccctggaggccagtccctagccccccttgccccttattttttccctgcttccctcgaacccaaaaatttttgagggatgaacgggtagacaaggactgaaattgcctctgacttccccctcccctgggttttgactttttcctccccttgcttccagggaaaatgaaaaaaaaaaaatttggaaggggctctggctccctaacccctgaatcccaaatgatgggaagtatgttttcaagtgtggggaggatatgaaaatgttttgttttcccttttggctttatgtcccttttacccctgtttttatccaataaactaagtcggtattttttgta

SEQ ID NO: 596035 - DNA, 369 bp, Homo sapiens
gtcgacaaaaaattagagtgttcaaagcaggcccgagccgcctggaatggcatggcatggaatggaatggaatggaatggaatggaatggaatggaatggaatgaaatggaatcaacccgattggaatgcaatgcagtggaacgcaatggaatggaatggaatggaacggaatggaattgaatggaacggaatggaatggaatggaattggatggaatgaagaagaatggaatggaatggaatggaatggatggaatcaacccgagtggaacggaatggaatggaatggaatggaatggaacggaacggaatggaatggatcggaatggagtgcaatggaatggaatggaatcaacccgagtgtcgacg

SEQ ID NO: 596036 - DNA, 587 bp, Homo sapiens
gctccacttctacctgcgcaacatgacatttccagaactagcttacaattcgtacaccggttataattggtttatggtttccaatgtaggaccaaattttagagataaatactgaagcaaatattgaatttcttctgtgttccacacgaagaatatgagtgaaccattattccggcttttgtttcctacagcaagatgtaagttatctggtttgcttattacttagaaaaagggctcctgctggtggaggtaaattagattatgcacctatcggcgggttagcgttgggctgtagccttttggtcgcttgcatttaccacgtatttttttctttcaatttattataagcttagagatacgatttcaaggcgcagctcttctgttagcagttttctcttcgactttgtatgaggatcatctcattttgttagcttctattcacatacctactataacactaatcctgctatggttcagacccaaatatcttcaacccctgccataggaactgtaaaaaatagattgtaattcaaagtaccttcagaaaaaaaaaagttatatacggcgcataccacacagtacgcaat

SEQ ID NO: 596037 - DNA, 191 bp, Homo sapiens
agaggatccccgtaacatctatgcatccgtataatgaataaccagctccactcccatatctgaagtccaacccacactattagtttgctgtacattcaatatctctgcattttgtctcaacaaaaacaataagcatcacacttttttttttttttttttttttttttttgggggaacaaaagggcttgggg

SEQ ID NO: 596038 - DNA, 402 bp, Homo sapiens
aggctgcggccgagcgcagtggttcatgcctgtaatcccaacactttgggaggccaaggagggcgaatcacgaggtcagaagttcaagaccagcctgtccaacatggtgaaactccgtctctaccaaaaatacattaaaaaaaaaaaaattagctgggcgtggcgatgggtgcctgtaatcccagctagtcgagaggcttaggcaggagaatggcttgaattcaggaggcggaggttgcagtgacccgagatcacgccactgcactccagcccaggtgacagtgcaagactctgtctcaaaataaataaataaaataaaataaaatagaagacctaaataaatggacaagcatccggtgtccccaattggaagacttgctattaagatggcgatatcctaaa

SEQ ID NO: 596039 - DNA, 123 bp, Homo sapiens
tactgaaattacaggcgtgagccaccacatccagcctgggctgattgggggtcctaagggtcaagggttgggtagttttataatagctcaggacagttcccggctcgggtaaggatgctcggg

SEQ ID NO: 596040 - DNA, 381 bp, Homo sapiens
cgcagatatgctctctgataaagaactgtgggctctactagaggaactcgagagacaggaggagttgctgtgtgaacttgatagtaagcctgatactgtgattgcaaatggagaagataccacatcttctgaagaggtatacttcttgtgataaggatggtgcaaggttataaccattcagaggtcaagtgaatagttagttgaactgtgtcaatgaatgggtccaggtcttaccacagtgatgaagatgatgatgatgatgacgacgacgactaccacattgacgaccatgatggtgataacgaccatgacgctttaggggttggagagtctataccaacactgtatttttcacatactggagagcctaagagggttcgt

SEQ ID NO: 596041 - DNA, 138 bp, Homo sapiens
  misc_feature (124)..(124): n is a, c, g, or t
ggggggttttgttttctaagatggggaaactgtaccccaccctgtctaagttctgccctaatgggcccccctggtgtaaccgggcggctatccatagggggggtttcttccttgggggccgtcnttttttgggaaaca

SEQ ID NO: 596042 - DNA, 106 bp, Homo sapiens
tatccccatacagagtagccacatcaccctcttacctctacttctacctacgcctaatctactccacctcaatcacactactctgtactctgtatgggggatctcg

SEQ ID NO: 596043 - DNA, 287 bp, Homo sapiens
  misc_feature (21)..(21): n is a, c, g, or t
  misc_feature (23)..(23): n is a, c, g, or t
caatttcttccagatagcctnantcatctctctccatctctcaagttcaaagttccacagatttctaggatggtggcaaaatgccaccagtctctttgcacagcaagtgtgacttttactccaggtcccaataagttcctcatctctacctgagacaaccccagcctggattttgttgtcatatcagtatcattttggtcagagccattcagtatgtctctaggaagttccacatgttcccacatggtcctgctttctgagccctccaagtctctaggaagttacca

SEQ ID NO: 596044 - DNA, 350 bp, Homo sapiens
  misc_feature (52)..(52): n is a, c, g, or t
gatgggtctccgtcccatcagatcacaaaatcacaaagcaccggagctggangaatcttaagagataatccaaggccaggagcggtggctcacggccctaatttttgtatttttagtagacatggggttgcatcatgttggctgggtgtggtggctcacgcctgtaatccctgcactttgggaagctgaggggggcagattgcttgaggccaggagttcaagaccagccagagtaacatggtgagaccttgtctctacaaaaaatacaaaaattagctgggtgttgtgacgcacacctggaatcccgatactcagggggctgatgggagaagactgcggggatcctgtaa

SEQ ID NO: 596045 - DNA, 1363 bp, Homo sapiens
  misc_feature (289)..(289): n is a, c, g, or t
  misc_feature (753)..(753): n is a, c, g, or t
tgtcgtgctctcgtcgggccctgggctaggcagaggatcagtgctgccaggtgcctcgaatggtgaattgtcctccgtgtagccagagggatggagtgtggagcagtgtaattcaatcggcgtccagcaaacgaagagcatcatcaacggacaccaagagcgtgaggcaagagatggatgcatatatcccaagacacccaactctatggtagctagcgcatgatgagggcgcattagcttggttcgagatcttcgcttctagattcaggcggacatctgatgccccacngtttgtgcatgacatggttgcgaatgcattgtggtctcaggtagacttgagtgcgaagaggcgcgtacaggacgtgttgtggtgttgtcagtgcctcctagagcccacgttggcaattcgtactctttccgcctgagacaatatgtgaatttccaactgtgtgctgtgaccacgcaaccagaacatgttgtcgtgcacaacggtaagttatgaagcaaatgcgcgaacatgtgttccatggattactaccatctccagtcgctccgtgaggtagcgaattgccaagggagaaatcgtcgatcgatatgattcagacattgtatagtaactagttgagactaaggctatgagcaaaagcatgtaattcctcagtgggacatggtcgccctttttgtgctgcacacgtgcactcacccaggacactggctggggaaacgcattcgatgaacctgggctcaccgttntgagcattgatcagacgtaaccgcagtttttgtggttcatcctattggttcatccgatattcgtcggagggggcccgttgggtgccaccaacgttccttccgcttctgtttacccgtcttcttccattacagctgacatggcctagtgaaacgtggctaaaaccagggttagaaacaagcggctttcccgggaagaaaccaggcctaacgataggcaggcccctgggataccatcctattacccatcggagggccatttgggaaatacttggggatggagatatagagttgaaatatgtgttagaggaaactatcgtggcaggggatataggagaattgaaagcccggtttaaaaagattatacgggagacccgtggcctcttaaacattcaagttacgcgggaagaaagagtttctctaaaacgggaatatctaaaccaggggggaaacacaacagcagctgcacacaggagctggaagaacatccaagaagattaatcggtcggcgacacaacttagcagcagctgataaacgaacataaacgaaaaggatgtgcgaagaagacaacaatgaggttactacacgaagacggtagatacagccagaagg

SEQ ID NO: 596046 - DNA, 149 bp, Homo sapiens
gggggggggaaccccgggggggggttttttttttgggggggaggggttttggggtccccttttttcccctccccaatttttgggggggggaagggggaaaaaaaatttgtttaaagtttttaaaatggtaataaaaaattttttcccca

SEQ ID NO: 596047 - DNA, 546 bp, Homo sapiens
agctggaatagagctcgcctcggctctgctggccttggctgcagctcttccagaaacccggggcgcccacagaagaatctcatacctggctctctcttcagggatgacatcatcggctcacaccagtcttccaggaccaccttctggatgccaaggctgctgctcgagtacctgctgtgcacctctacctcctgagccaaggagcacggattccaggaacccactaccatacagagcaactccttgtggacccccctgggatcaggacagcgagggacaagcgacaaagaggatcatcagtggccagctagtctctctggggttcaaaccttgaaccagtgccctagtgagggggcactggccatggcccttgacctttgctctgcttgtgtcttgagtctgagccctttcctgtacatctgtgctcgtgttcatctgctagtgaactggagtgctgccttccccgaggagggtcgtcccttgtgactgatcatgctgtcctaacaatgtcctgagcaaaagggtccctttgggaacctctcagga

SEQ ID NO: 596048 - DNA, 590 bp, Homo sapiens
agctggaatagagctcgcctcggctctgctggccttggctgcagctcttccagaaacccggggcgcccacagaagaatctcatacctggctctctcttcagggatgacatcatcggctcacaccagtcttccaggaccaccttctggatgccaaggctgctgctcgagtacctgctgtgcacctctacctcctggtaccccagccactccctcaagttgcctgcatgttatatggcctagccaaggagcacggattccaggaacccactaccatacagagcaactccttgtggacccccctgggatcaggacagcgagggacaagcgacaaagaggatcatcagtggccagctagtctctctggggttcaaaccttgaaccagtgccctagtgagggggcactggccatggcccttgacctttgctctgcttgtgtcttgagtctgagccctttcctgtacatctgtgctcgtgttcatctgctagtgaactggagtgctgccttccccgaggagggtcgtcccttgtgactgatcatgctgtcctaacaatgtcctgagcaaaagggtccctttgggaacctctcagga

SEQ ID NO: 596049 - DNA, 1739 bp, Homo sapiens
  misc_feature (76)..(76): n is a, c, g, or t
  misc_feature (771)..(771): n is a, c, g, or t
  misc_feature (1739)..(1739): n is a, c, g, or t
gagtagaagcgctgtccggagcttgcgcatttcgcaggcgctgccgcctcggcagttgctcctgtcgatgaatggnccatgtatccgacagcaccgatcatccaaccgagtgagagcggtaccagctcaaacggcctgtccacagagggcgtctcgagtcgaggagagggccacattccttttgtgcacctcatgcagctgcgaggtcgggtgaatggccaccgcagcactaagaatattgatgacgcgaacactcgaggtggtatgcgtggttcccattgcactgctctccaccctatcacgccaagagactctcgtgtattgcctaagagctagcattaggtgaatagccatgtgggctaagatacatctggaattggattcctttcgtttgctggggtgaaatttacgatcgcgagatgcttgcgtgctggacgtaccaagaaaggtgggtgtcgtgagagcgtgtaaagagcgacgattgggagtatgaatgatttcatacgcgagagggtttgtagactaggaatgacgttgataagggtgcgtgggttagcgctatgggacgcacactaggatcggcgctagtagtaattgtcgtccatagtggtgattgctatcctttgaacacgtaaatatcgagaggaaaagaaccactctgggtgcgtggcggagtgcccacgggggtcatctacaactggtattttggcattattgcccacgtggacttggaacacgtacgaagcggaggtatgtactgtgcgccatctnttagcacccgcacttagaggttccttttggagtaaccaaccaaaggtgcttatatattgctccattgaactcgcgcgggaaactaaccgtctcggttaaaagtggggcaccgtttttgccccttggagagttgaccgacccccggtggaagtttctgtaacacagcttccacacgttctacttagggttggccatggttgatttaactttgtccaagggaacttcctgcagggggttggctggcatgagcctttttgccccccattttcgacgaacaggttgccccaacacacccagaatcggtctaattaatatcactgggtgaggcacaggcacactgcaattttgacaaacgcagcgcgtgtacagagtgctttgtgagcactgaggacctttgacagtgggagaataggcccccctaaataagggggggcagacagttctcatcgaagacagccactgttcggtgcgcctcttgcgtcaaacattcacctcgtgtgcaggtcagcgaatacaaaagaggacaaccacccatacagtcccacaggggggcccacaaccaggacaatgcgggacggccggggccacagaggaggaagaccggaattgagactggacgaacgacaaaaccactacgtcggcacaaacaacattgcaagcaaagagcgcacacaagagagaagagagcgatacaggaaaagaagtcaccaaaaggtagcacacaccaagcccaccaggcacatgcagagaaaaacacctaatacgaccagcacaaagaagcacaagagcaacactgatgatccaaccgctacaaccaagacagcactcagaagagactctcggttaagagaaccacagcaacagtagagacaacgcagaagtcatacatctactctaccatccctcattctactcactctcaccgacgacgaaggagcaccaagagcaagcacaacagacaacatgcn

SEQ ID NO: 596050 - DNA, 305 bp, Homo sapiens
atttcctttcccccaagaagccgtggggtttgggatttttcccaagtcctgtttttgaatttgtgtccttggcctgcacagctttgtaaaaccccctccccggttggggggggggcctccccttttcccaagtggttagttttttttaccccccagaattggttgggtttcctgtgtaattgcccaaatgggataagcctggattgtggggtgggcccttttccccaaattttttttgtcccttttcatttaaaggctctttttttgagtttttgggaacttttggccaaatccaaaaaaaaaaa

SEQ ID NO: 596051 - DNA, 267 bp, Homo sapiens
agctggaatagagctcgcctcggctctgctggccttggctgcagctcttccagaaacccggggcgcccacagaagaatctcatacctggctctctcttcagggatgacatcatcggctcacaccagtcttccaggaccaccttctggatgccaaggctgctgctcgagtacctgctgtgcacctctacctcctggttcttcatttcctgtgggcctagtttccaggggctgagtgactagggtcttaaaacaggtttaaggcttggc

SEQ ID NO: 596052 - DNA, 731 bp, Homo sapiens
gccgccggttgggggagagtaattccggcgtgttgcgaccatggcgtccatggtggacccgtcggcctatcggatgcaagtatgtggcgccctttcctcatcatcaagatcaggaccgcaagtcccgtcttatgggacttgaggccctcaagtctcatagtaatggcgagcaaaggctgtagcgaaatacaatgagaacatcacttggaccaaatgggcttgataagatgatggtggataaggatggcggatgctcgactgtgaacctacactgatgagggccgaccgatctcaacgcactgcatagcgatcgtcgactcactcaggattgccaagcgtgatgcgatggaacatgtcccaaagcttctcagcgcatgcgtgaaattggagatggaacacaacacggcagatgcgcccgccccatgagcctggaatgccctacagaaaaagcaagcacaggcgagacgaccaaacgagcctaagaacccgagcgaccagtcccaccacaaaaacgagaagtacaccccgcaagacacccatgccacaaaagacgacctgagcgacgaaagaatggacaaagactgagacacaagacacaagaaagacaaggaaaccaagacagaataagagaagacccaggatagggaggcatagacacgagaaacaacacgcaacaacaccacaaaacaaccaccaaaagggcacagcaaccaagaccagagaagaaccca

SEQ ID NO: 596053 - DNA, 394 bp, Homo sapiens
  misc_feature (60)..(60): n is a, c, g, or t
  misc_feature (234)..(234): n is a, c, g, or t
  misc_feature (261)..(261): n is a, c, g, or t
  misc_feature (302)..(302): n is a, c, g, or t
  misc_feature (325)..(325): n is a, c, g, or t
  misc_feature (360)..(360): n is a, c, g, or t
gagagctccaagaccaaaagaagagacccccaagtggggtggaaaccagccaggtatgtntagaggctggaggaggcagtgtctgatttgcatagggcacaggggattggtttgaccagacatgtcattcatgtaacctgcaaaaacattggccctctcaccctagccttttaatatgcaaatacagggcaccatgatgttctacacacggggggatatgttgccaggcacgtntggggcaagggcaagaagacaacagtnagaatcgccatgtttgggtagacccagtttctaatggcctntatttgcatatccaaagggttanccggctcttaagagcttaggggcttttacaaaggnaacttgcttttcttgggagctgcttttaaaaaat

SEQ ID NO: 596054 - DNA, 624 bp, Homo sapiens
acgagtcgcgcggaggcggaggattgggtgcgtctcagagattcaacttcagccgtaacccatcgacatgggcgaggaaggcatagctgctggagcgtgtaagtgtggacggtctcatatgactgctgtataagcaaagagggttgtctgcataatgacatgcgccgtcactcgccgacgtagtggtcaccttaggcgacgatgggaaaggttccgcagatagacttggccaaacagcactttatgaacaagccgcccaaggtcccaatcgttggtgctgcttgacactcactaaactggtgacgagcctatgtatgtcaagtaggtgtaggccctatgggctgaactaccaaacttcataggcgtatagttagaggtgggactggacgaactagcaagatcgtaggacgaatgtgggtaggccttttgttataagattgtacaggatgagggggtaacacccaagtaaagatggttctggtggctgtctgtgtaggtattttgaggacttatggacgagcgagtctcaggccaaggtatgtcatgaaagagtatgtggatctgcaagattgtgaatgaaataaatctttggtacatcatgtaaatggtttgattaaattatac

SEQ ID NO: 596055 - DNA, 134 bp, Homo sapiens
tcgctcgacatcgatacgactttttttttttttttttttttttttttttccccccccctgcgccccgcccctcgccttgccgaagtcctgcccgatgcgcgggtggtgcatcaattcccttctgtcgtcttctc

SEQ ID NO: 596056 - DNA, 377 bp, Homo sapiens
  misc_feature (18)..(18): n is a, c, g, or t
ttatggccggcggaccanaatttgttaccttttatccacaaacaaacttacaaggcgggctttgggcttttaacctgtaaatccaaccaccccccagcaaatgtttgagacgccttatctctctatcttcaaaataacagtatactacatcaccgccattgttttggacccacgtgcccagaattcttaagagaattcctattacaatcaactactcagtccattatacttatactactgctccccaaaaccacaaattgtcccctatccgattaaaaaacctatccgcttccttaaaatctaaaatgtcaccagattataatatttatacgccctaatataactttctcattatatctcatctcgttttttatccg

SEQ ID NO: 596057 - DNA, 262 bp, Homo sapiens
ttttttttggaaaaaaaaggttttttttggggccgggggggccccaccccccgggttttaagggttttccccccccccccccccccagggggggggattaagggggggggcccccccccccccccctttttgtttttttgggggggccttgggggaaaaaattccccccttttttggggttttgggggttttttttttttttttgggggggggggggggggaaattttttttttttcccccccccttttgttttttttttta

SEQ ID NO: 596058 - DNA, 111 bp, Homo sapiens
cgagctcgtaccaagtctggcggggcttagaatcatattctctccatcaggcctgaccaggtgtgacctcggccacataaattcacagattcttcgtagcctctttgatct

SEQ ID NO: 596059 - DNA, 276 bp, Homo sapiens
cttttaaaggattttcctttggatgggggaatttgttatgcttataaacttgacggtcccattcctgagcaagggtggaaaaattcccaggggggacaacctttccatcaaatttgcttttttgagggaaaaaataaaaattttgtcaaaaattttttccgctaacacaacataggaagttttccggtttgaaaaacccagaatctaaaattttttgaggcaatagggacccttttttttgcccttaactctttttaccaatttattccaaaggct

SEQ ID NO: 596060 - DNA, 1613 bp, Homo sapiens
  misc_feature (574)..(574): n is a, c, g, or t
  misc_feature (1388)..(1388): n is a, c, g, or t
gtcgttgcctatatcatattcgcccgctcctacctattttgatttacatcattccaatccacatccagtgtgtgtatatattagcccctccgtcctgcggttttacaccccccacacacacgaggctgtgttctttttcaaataaagaagaaaggtgttaattataaataaagttgtatagaagtgaaactcttctccgccaagaatttgtgtctccccccccccccccttgtttgtcctcccacgaatgtagtcactctgacctcccctttgttagagcactctctccccccccggtgttttttttatggggggggtgccgcctcccctccctcctgggtcccccaccaggtgggaagacagcaaaacagatgattttttaatacacgcgggccccccgctgggggtgttgtcgctcccctatataacccgcgtgggcccaacacaaaggggggtgtgtcgaccacaataatagtagtcacaccacccgtgtgggctggtgccgtcccccttatagcatatttagtggggggagacaccctcccgcgtgtgatggattagagatagttggggngcctcacccacacccgcatagaggtggtttttaccaacagcgtggttggtgttctcgtataaaccgtgttttgtaaaacccaccccgctgggagaaaattgtgtaggagaccctcggtcgccccccccccttgcgagaaagaaagaggccgcgcgcggctcaacttgtgaagaacaaccactacggcttcacaaagttactcgcagcggtatagtgtagctcccccctcatttgggagagagtcctttttttatagattgtttatatttgatgagagcgcaccacaccactgtgtagctctcttactcacaaacacgcccacacacaggtgtctctcttaaaattttgccgcacaaacactctctgcactctgtatgacaaatattttcctgcgttgtttggggggcgagacacactctctggagagccacagagataccctcacacactcctctctcagagagacacgtggacacacatgggttataagagacttcttacacacacagttactcacaagctcggagagactatctatatatatacctacacacatgtggagatccccccacatataactgtggtgcctcacactcgggaggacacacacagtgtataccccctatagggaggataacacacggcgccacattgtcctatatttctatagagagtgcacacacaatcacaccacacataagaggtgttatcgacccctccgagatggtgtggagatacacggagacactccccgcagatggggcgcacacccactctatattataaagtgtttgtctttgttctcacccgagtnttaaagtctctaacgggagatttgaggttctcgacccccgtatatccacggtctggtttttatatttaacttctcaaatttcttctccctgtatcgaaaaggaacaaagagagaaaatataaggcctatctttctacacacaaggcgcctttccccgtaaaagaaatcatttctaacttagtattatacccaccccccaccccagaacacccgcctttgtttata

SEQ ID NO: 596061 - DNA, 217 bp, Homo sapiens
gagacgctgtctccataaacaaatcacacaaagtatggtgtcagtagctgtgttctagcaacctgtgctacgcactgaggacaaaaatgtgatcccaacagaacagggatgtcttctcgcccagccccttgagcagcagagccggggagcagatgcagggaaatgcctgatggtgtacccatgtggcagggcggatgtgtagggcaccgcagaacag

SEQ ID NO: 596062 - DNA, 175 bp, Homo sapiens
  misc_feature (132)..(133): n is a, c, g, or t
gcaggttcaagaagaaatatatttgatgagtttataataaacacctgcaaaactgcctgggtaccagctcgcatgcactgttttttgggtgcttcagaggcgctatgaagagcaccttttttttttttcgcnnccgcccaaccggaactccgaacatgatcaggagtattgggcc

SEQ ID NO: 596063 - DNA, 519 bp, Homo sapiens
ctgggaatccaactctgggcctctgctctctccccaagcctggttagtatcactttattgagacaggttctcactgtgtaacctggagtggcccagaactagtaaggaagaccagactacctcaaactgacaaagatccaactgcatcccaagcactggaactaacgacatgcattgctttcctttttaagtaggacttttatctacactgatagatgctgcccacatgaacagtagctcttgggtcactagtgacttaacagtacaggagcctggagtaatagctcagcactagagccatacataacgcatgaggctttgagtttaatccccagcacaaagaaatagctgtctaaaaagcaaaatagttgctgggggggggggggggtgacgcacacctttaatcccaggacttgggaggcagaggcaggtggatttctgagttcgaggccaacctggtctacagagtgaattccaggatagccagggctacccagagaaaccctgtctcaaaaacca

SEQ ID NO: 596064 - DNA, 100 bp, Homo sapiens
agcatgggcctcacatttcattgtgactcctagtttcaccgtgtaaatgctacacatgttatttctaccctcttatattgtgctatctaatctagatttt

SEQ ID NO: 596065 - DNA, 284 bp, Homo sapiens
cctgtaatccctgctagtcaggaggcggaggcaggagaattgcttgaacctgggaagcggaggttgcagtgagccgagatggcgccactgtactccacggtggtgtcagagcgatactacatctcaaaaaaaaaaaaaaaaaaattagctgggtttggtggcacacacctgtaataccaggtactcgggaggcccaggcaggatgatcacttgatcccgggaggggttggttttccgtgaaccaagattgtactactgcactccagcctgggggaacaggggca

SEQ ID NO: 596066 - DNA, 241 bp, Homo sapiens
ggatcccgtggctactgctggagacctgggggtgaacccagtcccgagggcactactggccagtcctacaaacagtattctcagagataccatcagagaacaaacactaatcgttaatagcccaattgagtgcttcatgcctttagaatgtacagagctgacatgagcaagattcccgacgagtaaatcatcatttccaagtccagtaggaacaaagcatagtctctctagccaaggatcc

SEQ ID NO: 596067 - DNA, 395 bp, Homo sapiens
ctctgtacagagttgagagatggggacgacatgtgacagagctccttgctgctcaaattatatgccagagaaaatattcaccttctcggactccctgacaccaggcatgggcatgtaatcctacagcacagctgatgaaagagaagacatcttgatgctatgtgacacgcacgaagataagagctttcctatgaagatgacggagcaaaacaagtagaaggggcactagactccctaccttcacacttcctgctataaaagcattgctatgataaggataatctgcagaaacagacttctatgtcatatgcgaaaatgcatgaaaagtcatacaatatccattaaattggcgcaaagatccattttgaaggagtaatctgagggacctacagacc

SEQ ID NO: 596068 - DNA, 335 bp, Homo sapiens
atttaaaagtcaatttggtatcacctccacacttgataagggagttgggtgcaatttggtttcaaaattgggaactttaaaaacttagggcctgactgcggtccttaacggacttaattaagtaacccgtagcttaattggcctgaacaagctccttgttccaaggttaaagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgtt

SEQ ID NO: 596069 - DNA, 190 bp, Homo sapiens
atcaggtactgatgagactgcattatagcacagctggaggggttcgtgaatactcccgctgtaaatcccgttctacttcactcggtcaggggagtgaagtgccttaagaaacaaatgccctgtcctacttgatctagctggtcagtccggtcttagagataccctcttccctgaagaacctgaagatcgt

SEQ ID NO: 596070 - DNA, 119 bp, Homo sapiens
tagcatgataaatcgagccggtaccctcgatatgcaagcgaaattggtcatctcgctaacaactgcccagctttgaggaaatctgaaatagagtactatgctatgttggcccttatccg

SEQ ID NO: 596071 - DNA, 399 bp, Homo sapiens
agccggttgttgaagtcatcctcgcgggtgaccaggacttccaaagaatggattccctgctccttagcagtcttgtaaacactgctgaaatcatccccaaggtttgggtcagcccccgcagctagcagaatctgcaccacactgtcgtttcggttgatggcagccaccatgagcgctgtccagcccagtttgtgccttgcattgacatctgcgccttctgacaatagcctgctgacctcctgcacgttgttggcccgggcagcttccatcagggctgcatccttgttggacggactcttgctgtagcaatgaaccatcagcgccgtgccagagcccacatgctgaggccggctctgttggggacctcattccagctgtcctgtcctggcagtgtttctt

SEQ ID NO: 596072 - DNA, 331 bp, Homo sapiens
acgtgtagcgggtgtgatggtgtgtgcctgtggtcccgctcccttggggctgggtgggcgggatcgcttgatcctgggaggttgaggctgcagtgagcaagttaacattttttgttaccaggtggatagcatcacttctcaagcaccatcacacagcgtgcagtcaatcaaggcagggaagccacaagcagatgacaacgtttctaggtaagttcacatgcattcttagtctgttaaactgtcttcagcaaaggcccttgaggtggtacacaaaataacaatactcaatgtgggaactccatgtcgttgcaacgcggggatccctctcgca

SEQ ID NO: 596073 - DNA, 130 bp, Homo sapiens
  misc_feature (13)..(13): n is a, c, g, or t
atgtctggatganctgctcggcattgtcggtagcagccttcatagcacgctgacggctagccaattccaaggcagccgattgcagcaaggcgtagtggacgcggttggcgacgtacagcggtagcaactc

SEQ ID NO: 596074 - DNA, 503 bp, Homo sapiens
  misc_feature (50)..(50): n is a, c, g, or t
  misc_feature (172)..(172): n is a, c, g, or t
  misc_feature (195)..(195): n is a, c, g, or t
  misc_feature (231)..(231): n is a, c, g, or t
  misc_feature (261)..(261): n is a, c, g, or t
  misc_feature (291)..(291): n is a, c, g, or t
  misc_feature (306)..(306): n is a, c, g, or t
  misc_feature (317)..(317): n is a, c, g, or t
  misc_feature (330)..(330): n is a, c, g, or t
aggaaaaaaagaggacttgcagaagaaaaagggattaaaacacttgaagnattccagaaggcaccccagggttccccacccccatagaagtcccacacccccattccccccatgttttttgcattgaagccctgctggggggcaggcccctgggtccccttccccttctganccctgttgtccctgagtcacaancttatcccctgtccttggaacccattggttcctaancagcactggagaatctgagacagctggaanaccagagcaccccattcagcccctctaaanttgtatgtggtaaanctggggccaanagagggcagctgnttgctcaaggccagccatagtaggaggtctaaaacttgtgtcaaccagcgtgctggctggattatttaggctgaggcacaagattcacttgaaccctggaggcggaggctgtagtgagccgagatgacaccactgcactccagcctgggtgacagaatgagtctctgtctcaa

SEQ ID NO: 596075 - DNA, 566 bp, Homo sapiens
  misc_feature (47)..(47): n is a, c, g, or t
agagaagaaggaagaggaaagaggagggaagaatagggaaggcaaancggaaaggaccaagacatgggagagcgagagcaaagagagagaggggagggatagagaaaagagaagaaagaaaggaggaggaagggaggaaggaagaggaaaagggggagaaagggggagagaaaaaggaagaggggaagaagaaaaggagaagagaagaagagggaaaagaaaaaggagggggaaagaaggagaagaggagagaggagaaaggagagaaagagaaaggaaggggagagagaaaagggaaaaagggaaggaagaggagagaagagaggagaagaaagaaagggaaggggaaagaagggagaaagagaggaaggaaggaagaaaaaggagggaaaaggaaaagaaagggaggagaaggggaagagaaagggggaaagagagaggaagagaaaaaagagaaaggaagagggaaggagaggaaggggaggagaaaaagaaggggagaaggaaaagagagagagaaaaaaagaagggggagaaagggggagagaggaggagggagggaaggg

SEQ ID NO: 596076 - DNA, 116 bp, Homo sapiens
cggtccaattatccagaggattatggttggacgggggcccgaggggcgctcctccgcgggcatgaccagttcgcctacgagggcaaggattacatctgccctgaactgaggacctg

SEQ ID NO: 596077 - DNA, 933 bp, Homo sapiens
tgaatcaataaacaatattattgaattgcatagctcatttcacaagaaattctggatgaaatgtgtttaataatatacttcaacaatccatttcttggcaattgttgaaacaaagtgagatattctatagatcttaaatgtgtaattcctatgtgttactgttctttctgggtaaattcctatggttagtataagtatggtgtacctaattggagtgtattctaatcattctctctttagagatcagcagtgcctggaccatacaagtcgagcaagtactaactcatcttaagcagccttacaacttgcgatccatctaatattcatgattgaatcaaggtagaccaatcgatatcaaaaccaagagttattaactggtgagaagagaattctgtagcaaattgcattgtatatattatatgtattgaggtcatgtgtgcattcatcctttgtgtgtagatgtattgaatttatttactagtgtgctaggagcattctgttgattttgtcaatagtaacattcaaatctttaggagtggtattatgcttactttcgcgtaaaagtaatcgtaatctaagttggattttgattgaatgacccttagaaaggcggttaaatatttagagtgatctgtccatctggattggtcgtgcagagaggttccgcgtatggcactgtaacttagctgcggttggaaacatctgggttgcgattagagtatcatcagagtttccatttctcaatccactcctgcgtgtctgcttcacccgtttgttctcggaacaactcaactcttattgcacattcaacggttacttcgaatggtttcccaactcccaggctctcttggagcctcacttaaaaggaataaacagactcagtttttaaccaattatgcgggggcatgtcccaattcttttaacctcaatgtc

SEQ ID NO: 596078 - DNA, 299 bp, Homo sapiens
ctcggcccagcattactgagtcagctaatttttgtatattgagtacacagtgttcaccatgtttggcaggctggcctcaaattcctgacctcagttgatccacccgccttggcctcccaaagtgctgagattacaggcttgagccaccgcagcctggccttttttttttggttgagacgggttgcagtgacacaattttcagctcactgcagctcttcaccgctcgggctcaagttgattttcccattgcagtctggtgaccatcaggttttgtgtccatcacacgtaatgcttctttt

SEQ ID NO: 596079 - DNA, 708 bp, Homo sapiens
ggctgttacggccctggaagttatgggatgggctgactcaagcgtgaggcgctgctggaacagtcgccgaggcgattcccgcccaggctcctgtaaccgccaggcagtgtgaccgcgccattgtccagcctccggtagcccagagcatggcactggatacaccgtgtggggactgcccccgcaggcaggatgagacgatggacgctaggggaggggatccacgtgctcccaacgctatgctcagcgttcagtgactgccctggtgtccatcatcgccaccgtctatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcggtgaggctgggtggcctccttggaccagggagggagccaaccaagtcctgctcagcctgtgctcaccccggcggatagtccttggccctcctgggagggtggcgagactgggctcctagggcctctgtctcctgatgcttcagctgcgcacaaaggccagctaccctgggcgtgtgagccagaggacagggttggaagacggaaggttccggggccttgccccacggacacgcactgtcttcctcttgcgggacca

SEQ ID NO: 596080 - DNA, 616 bp, Homo sapiens
caagctgcgcacattacagtagacaataagaacaatgagacacaacttgagagtccagaaactaagaccgaacattcatggtctattgcttccaagaaaaaggtactatgcgattctgaaagtgaattaatcgtattcctcaacaaacaatgccaggtaagattgatagaagactacctcaaggaatctaataatcagtatccctaaggtcaaggataaagaaaggattctaaagtcgatggaaaatgaaaagaaagaaataatgtacaatgtgagctccgactacatctggcagcagacttgtcagtggaaaaaggccaggagacagtgatttgacatataagaattgcagaaggaaaaaagttagaggccagaaatagtgttactggagaaaatattcttcaaacatgaaagagaaagacttttccaaaccaacaaaagctgagggatttcataaacaccagatctgtcctataagaaatgttaaagggattacttcaatcagaaagaaaagggcattaatgagcaatatgtaatcacctaaagctataaaactcactggtaatagtaaggagacagaaaaacacagactagtataacactgtgagcagcgttg

SEQ ID NO: 596081 - DNA, 330 bp, Homo sapiens
gggggggcccccccccttttttcggggatttcgggggttttccccccccgggggtttttccccctttttccccaacctggggggggggggccggggccggggccccccccttttttttttttggggggggggggtttcggccccccaatttcccccggcgggttttttaacgttttccccccccccaaatttatgttctcctttcccccccggggttttgggcggggggcccaaccccctttttcccccccaggggcccccccctttttttttgggggggggcccctttcggggggggcccccatttttttcggggcccccccggtttta

SEQ ID NO: 596082 - DNA, 242 bp, Homo sapiens
gactcgacaagctagaacgctaaaccagagaactaatataagatagaacagggagaacactggcctggccattaccatttccataactagacgtcgaacacagaacctaaacactcaagatatgcttaatttaaaaattggacaatcatggaagtcttggtaagtcttggctatactttcccatcacatggaatgggtatttcatacaatgaaatacaaaaatgtcaaggaacttttctctt

SEQ ID NO: 596083 - DNA, 144 bp, Homo sapiens
gccttgcttacggcgtgcactccggcggccatggagcagcgccgcgtcaccgacttcttcgcgcgccgccgccccgggcctgatcgcgcgacagggcgcgacgccgaggaaagaaaggaaaggaatacgagaacagaaaaaaag

SEQ ID NO: 596084 - DNA, 1495 bp, Homo sapiens
  misc_feature (271)..(271): n is a, c, g, or t
  misc_feature (758)..(758): n is a, c, g, or t
  misc_feature (762)..(762): n is a, c, g, or t
gcaacaaacatgaacgtttctaccacagagaagaattaggcgctccgttctcaagtagacagagtccagctgccttgacatagcctcgaagacctgggagagagggcccagacctgggaccctctgggtcatgcatgtgggatccatctgcgcgcccagcagactccttatccgtcctagaggcacacgcacctacgcgtctggcgcttgcgattccattatcgccaagaatgatcgtggattctggttaatagttagagtactcgtcgtngatcaaagcgtttatctctaagcgtagttgtatctctctcgttaagatctagaaggtcgagaaacgtacgacacttatggtggcaagacacttagttctaggtgactacttaccccagaagggggtcctggggggtgtcgtaattgcacctgttaccatggcaccacaagccagatgcgtacctagataagctattcggacctagggggtagccttcgggtgaacattggaccacgtgttctctggtcgccacgcttttgaccttgttactacaagtcccagagatccaactagatctccttccccccctggggaagtgcccatttcctgcgcctcttagcccccttggcccctcgggcccttgaccggcgtccccccagaccttgctcaaggtccccgctgtgggcccctttgggaacgaacgccacggatttcgcgtagggtccctttggatttaatttgctaacccatgcgcaccggtagaccncttnttctttaacaacacacacacactttcaagcggtattatccctagttgtgtactctcgttggcttagggctaatgggtcccctggccaagttaacgccgccaataaagctcccgttgcataggtattttgctctcgcacaacacgggcggccacacaggggccccaaaactccaataggtttctccccgcgaactgttgttgcctcaaggcgccacttggcgcgcccaaccccgagaggaggggttccgttctacacggggcccccttcagagctcccccgtgctcttccccactctgtccgccttgctccccagagccccctttccctcggcacgcgaattggcgcctccaccgcgctggctctgtcttcccaatgtgggcgcggcacacaggtgcgcctcctaagccccgtctgccgaaggttctttccttggtccccaagcgttgtaccttcctttaccttggtgggaccccttgcggtcgcttccccccccgagtctttcccacagcgtcgcagctctgcgcgcccctaccggaacatgcgccggcggcttacaaccaagcgcgggcgccatttccccccttccccccttttccccgcgcatttcctttaacacgggaggcttggctctactttcccagcagtctcacacagctccgcattgcttcacccagggctccgctcttctcggggcgcccccccatggcacgcagacacgcactctctcttcga

SEQ ID NO: 596085 - DNA, 117 bp, Homo sapiens
tgtcgtacagcagtcggtgctagagcgagatcacaccactgcactgacccctgggcataccaagactgtcaaaacaaaaaaaaaggaaaaaggttacgtaccccacaagtcaaagga

SEQ ID NO: 596086 - DNA, 680 bp, Homo sapiens
gagttgcttgtcgtcaacctcattaaactttttaaatggggtctcaaaattctgtgacaaattttgggtcaagttgtttccattaaaaagtactgatttaaaaaactaataatcttaaaatctgccacacgcaaaaaaaaaaaccaaaggtggctccacaaaacattctccttttcctttctgaaggttttacgatgcattgtgttatcatttaaccagctcttttacctactaacacttaaagtggccaagttgaaacaaacagttctgagaccgttcttccaccacgtgattaagagtgggggttggcagggtatacaggagataatattcattatacgccttctgagctttctggggcagacttggtgaccttgccagctccagcagccttcttggtccactgctttgatgacacccaccgaaactggtctgtctcatatcacgaacagcaaagcgacccaaggggtggatagtcgtgaaaagcctctcaacacacatgtgggcttgccaggacccattttcaccaagtggcacgcttacaccagatcttcagagaaattatgagggccattcttccaggcttttatacccagaaaggggcgaatcaaactctttttccctttacagtctacaggcaaaaattttgtctgtgccacattgtgtgaagccccggatgg

SEQ ID NO: 596087 - DNA, 193 bp, Homo sapiens
tcctgtgactaagaatgcttaacctcctgggaatgcagcccagcaggtctcagccttattttacccagcccctattcaagaacggagttgctctgattcaaataactctaacactcgggcagactcctcggacacaaacacaacacggcggaaaacgttgcatagcgagtggattgcaggtaaaagatgagag

SEQ ID NO: 596088 - DNA, 356 bp, Homo sapiens
  misc_feature (38)..(38): n is a, c, g, or t
  misc_feature (40)..(40): n is a, c, g, or t
ttgtatgtatgaggtgacttggtgggtggggtggacananaaaggccgctgcgcctccctggacgagatcctatctcagcgggatgctgcctctgcccgcaccctccagctgcggtctgaggaaccctcaacccctgccctacccaactcggggcagttgtcctggatccaggacctgataacaaggaaactggatgagactcaggaccttctggcataggttcatggactgggagatgggaagctaaaggccaaggacccccctcggtctccgtcggattctgagtcaaatcatctgctgttcgagaccgaacggctgctgggagaggcatcattcaattgtaaccagtcaaaga

SEQ ID NO: 596089 - DNA, 445 bp, Homo sapiens
agcggtggctcacacctggaatcccagcactttgggaggccaaggtgagcagatctttcgaggtcaggagtgggagaccagcctcaccaacatggcaaaaccccatctctactaaaaatacaaaaattagctgagcgtggtggcatccacctgtagtcccagctactcaggaagctgaggcaggagaattgcttgaacctgggaggcagaggctgcctgagccgagatcatgccactgcactccagcctgggagacagagcaaggctctgactcaaaaaaaaaagaatctatagttgagtaaattgcatggtagtatggaattggctaatttctgagcattctgtggttacataagatgctcacattaggggctgagtgaaaggtacacaggaacgctctgtgctatctttgcaacagttcagtgagtctaattatttcatagtt

SEQ ID NO: 596090 - DNA, 184 bp, Homo sapiens
acatcccattggttgtgggtaggggctggacaggcatgtggtggggcagggtgggcctgcaaaggcactcacttgatgaggtctccagacaataccgtgcattgctcagatctgcgagcgatggacaggagggtgctgcccttttagtctggccacagggtactcaacccagatcctcccaaca

SEQ ID NO: 596091 - DNA, 333 bp, Homo sapiens
  misc_feature (279)..(279): n is a, c, g, or t
  misc_feature (301)..(301): n is a, c, g, or t
  misc_feature (317)..(317): n is a, c, g, or t
  misc_feature (327)..(327): n is a, c, g, or t
aaccatgagctttttgtgggaaaatgttatggaataactgccagaaaacattgtggtgaaaattaactattactttaggaaaatatgataaagagagcatgttccctttttatagactgaattctcacttgaatggcttaaatagctaaggcagggagggaagtccagttaatatctcagaagcacaactatttgtttcgaggctttttccagtatttttttcaaaaccactttaaaaatgtgaggggaattaagctgcttgttcggtttaagtagggnttacttagtgtttatgtctaangggttattttttgccntgtgaggggnaacagc

SEQ ID NO: 596092 - DNA, 822 bp, Homo sapiens
ctctgttgcccaggctcgagggcggtggtgtgatctcggctgactgcaacctctgcacctgggttcgagcggttcttctccctcagcctcctgaatagctgggattgcaggtgcccaacaccatgcctggctatcttttttatatttttagtagagatggggtttcatcacgttgggcaggatggtcttgaactcctggcctcaagtgatccatccaccttggcctcccaaagtgctgggattgcaggcatgagccactcacccagcctagaaaatattttaaactgagtgaaaactgtaaacacaatatactgaaattgtgggatccagctaaagcaaggttcttagaggcgtatttatcacttcaaatactttatttgacaaacaagaagggcccaggcacaagagggttacagtactgatagtcccagacacttggggaggccacggcgggcagatccacgaagggtcaggagtctgagaccagactgggacggaatgggaaaaaccccgctctactaaacatacagaaattaagcgcgcatgtaggtgagcacatggggacctagactactcggggggcctgagggcaggagaatcgcatgaactatggaggcagaggtgcaggagccgagatgtgcactacactcagacggggaagagcgagaaccgtttcaacagttaagagacgaggcaaaaaagaccaaaaaaaagtgtgagggccggccaagacaaacaccggggcgcgccacagagacacagaggacaagacgcaagagcgccaaaaacggcgggaaccaagggaggcaggaacaaaacaga

SEQ ID NO: 596093 - DNA, 182 bp, Homo sapiens
cctttcttgctcttcttcttttcggatataggtaggtcatcatcgagtgtcatcattgagaaattcatcaaactctcctcccttcttagaacgccgtccaccaccaccacctcttttcttctctttggtggcttcagtctcaccagtaaacataagaatatgttgggtcttctccacatact

SEQ ID NO: 596094 - DNA, 851 bp, Homo sapiens
ccacgcgtccgcacttatttgttggcttctgtgacatgaagaaagtctcaccaggaaaatgggatgcctaagaacaagcctaggcaccagtgaagtataaaggcatctcattgtcacttccccaggagaggtgggccagaggctggttctaattgggcatctcaaagtcacaggcaaaaaatcactcctgtaacacttagatgggcttacctttctagccctggggagttgtcacctagcccctgaagcccctgaggtaacaaagaatacatttgatctctctttcccaccaggacagggtgagcagctagtcttactgctccctgggaagctgaagctctgagtatgactctgcctcaaaacttgtctcagccaccaattactagggttttttacagaatgaggcaggtgctacctgaatcaacccctgttacaatgcagactcctaggctacaccccaagcctactatgtggtgatcttattttgtagttcaggctggttttaaacacatatcttcctgcttcagcctctggaattctaaggttacaggtgcatactaccatggaaactgtatctatactaagtatctcaaacttggtgcacttccccttgtccacttgctccatactgtagtgtgagaactattccccgggcctgtgagtatggcataccaaatgtgttttttgagagactgacaaatttggggtcttgagttgcgcggaaagaatccagctattcagcttcctatttttgattccaggcttccaaaggtcctggtttgaaaggagcctggggatggtcattctggaatcgttacccaaagccggtccggggaaaataatagcgggcc

SEQ ID NO: 596095 - DNA, 134 bp, Homo sapiens
  misc_feature (12)..(13): n is a, c, g, or t
  misc_feature (53)..(55): n is a, c, g, or t
  misc_feature (79)..(79): n is a, c, g, or t
  misc_feature (90)..(91): n is a, c, g, or t
  misc_feature (95)..(95): n is a, c, g, or t
atgtcgtagaanncaagtgagccaagagaatgcttttccacattccttacatnnntatggattcactctggagagaagncatatgaatgnnaggnatgtggaaaagcattctcttggctcacttccccggaatt

SEQ ID NO: 596096 - DNA, 845 bp, Homo sapiens
tgggggttcacacattggtggattttaattccgaattttttaaaaaacaatttaccccctcttccccaattcccagctcgtgatttatacaagtgcttaacggtggcaaaaaggctcttggaactacatccttctaacaaacaaacaggcaccaggctgttcgacaacctcactctcgcactgcaccagcgtcctatgaaggggtgggggcaacttgctccttgaacacagctcacacagagagttacaacaccagtgttcacctgggacgcaatttctcacgcccacaacagttctcttttctcaagctcaactcttttggactcttatggcgaccctcccaagtgtttttcaaaggaagtgccgtgttgtgtagaaaccctcagcatgtgtatacatgtgcaaaattctcccccccctttttgtgcctccaacataagggcgtggccctactccctcagctgtaatacgagggactcctcatctccgaaatgtttatctcacttaaactgctgtgtgatcaacaccgagagattccccccccgaagtgagtgtgtggtcttcacgcaacgaggactcctctctcttattataagggtgataaagctctactctccccggctgacgagaagatgttggtgcccccgatgtactgagcgctctctcctcttatccaccaatcgcaagaggtgccaaatccaacacaagaggccccgtttctcccctactgtaatgtgacgaccatcttctcttttccaggcgacaattctgttgtgctcccaccaatatctactaacaccgtcttctcttcgaacccccaaacaacgtgtggtggcctctccgca

SEQ ID NO: 596097 - DNA, 596 bp, Homo sapiens
acgggatccacggcagtgaatagaaccccgcagcagtgaatgaatagaaccccatggcagtgaacagaaccccacgacagtgagtgaatagaaccccacagcagtgaatgaatagaaccccacggcagtgaacagaaccccacggcagtgactagagccccatggcagtgaacagaaccccaaggcagtgagtgaatagaaccccaaggcagtgaatgaatagaacctcatggcagtgaatagaaccccaaggcagtgagtgaatagaaccccaaggcagtgaatgaatagaaccccacggcagtgaacagaaccccacggcggtgactagaaccccatggcagtgaacagaactccacggcagtgaatagaaccccatggcagtgaatagaaccctatgggagtgaacagaactccatgggagtgaatgaatagaaccccacggcagtgaatagaaccccacagcagtgaacagaaccccacggcagtgaggagaaccccatggcagtgaatgaatagaacccccatggcagtgaatagaacccatggcagtgatcagaacccacggcagtgaatataaggccatggcagtgatc

SEQ ID NO: 596098 - DNA, 274 bp, Homo sapiens
  misc_feature (15)..(15): n is a, c, g, or t
  misc_feature (36)..(36): n is a, c, g, or t
  misc_feature (52)..(52): n is a, c, g, or t
  misc_feature (178)..(178): n is a, c, g, or t
cagaagcacaggtancctggagcttgtgactggcanctgaaggtgggggtgnggtaaggggggggtgcagtcttgagccctcaacctataggatctgacactatctccaggtagatcgtgtcaaaatatggtacgtgcctgttgtcccagctacttgggaggttgaagtgagaagatngcttacggtcaggagtttgaggctgcagtgagctatgattgtgcctgtgactatcacttcactccagcctaggcaacaaagtgagacccccatctc

SEQ ID NO: 596099 - DNA, 161 bp, Homo sapiens
ggggggggtttggggggcgggccctttttttttccccccggggggaattttttgggggggaaagggaaagggggggggaattttcccccccccccctcccctttgggttttttttaatggggcccccccgaaaaatttggccggtttttttttggtgccca

SEQ ID NO: 596100 - DNA, 916 bp, Homo sapiens
  misc_feature (916)..(916): n is a, c, g, or t
gccggtgctcctccctcgcgcagcggtggctctgggcgctggagtaaacactgctttgttcctagcgctcgttttcgtcgcccgtgcctcacgcgccgggtctggctggcctgccctcggtcttgaacccatttcggctcgtgcgtgcgggatgcgtgcgggctggtttggcttgagcggagagagaggagcggggcgctgggggatgcgatggggaactgttgtggacgcagtgttcggaatgttcgcaaggaagggggggggttgcaggagtaggcggcggggagggaatccaagtattttagaacatgctcaagagggtgagcattaacaatagagttgagaatctagtagaaagtgatgaaggggagagcccaggaagcagtcataggcctctaactgaggaagaaatttgttgacctaagagaaaggcattatgattccatttgcctgaaaaacaaaaaagatctgtgataaagaaaattcaaaaagagcaagaagggcagagaatgggtgcagcaatatcatccttccaacaatggagaatatcagagttcaggaccagaagatgacttcggaatcttgttggggaaatatgagtcacagtatgaagttttcgaagtagtagactctcatcagatgctacagtttttgacagcaaatacagaagcagtgtgatttatgaacaaaaataaataatagtggaatgaggacggcattcgttagatctagaaatgggagatgaggaggatgatagaatgtttcatggaaaagtccaaagagagaatttaggggcgggttagttagcacaggatggagaatcaaaaaggctatgatcagggtgggggaaaatttttggcttgaagacgggaagagtgaaaatttaagtgttgagagtgaaaaaacagaagtggtn

SEQ ID NO: 596101 - DNA, 200 bp, Homo sapiens
acttaaacctttttatgatgatttaaatggaagttgttttttgtcccttaatgttggttccagtccttcaactgttcatatttactttataacattcccatactaaccctttttcaaaatggggtgggggggggaaatgcagtttagccatgtcctcaaaataaagttttggtaaaaataaataaatgtccttttgttta

SEQ ID NO: 596102 - DNA, 707 bp, Homo sapiens
tcacatagtacctggttttccacaagtaagccaagggcatgattttctgtgtacatttattaacagttctttggttttatgaaatactcatatgaagccagtccctggagtactgttttttaaaaggtccctttgaaccatttgtaaattatattttcattcataacctgcattcttagaaggcattcagtcaacatttacagcacttactgtgtattttccacatggagtggttcaactcaagcgtcccttccagtattcagggcattcttatttcatgttcaagtgagtgcattgtttagaaatcacagtttattaacatgtacatgatctattttaaaaaaaaaataagtactgacacctgacttctactcccaattagcagattgtaagaaatgtcctcagtttggtggatggtgtggtgcctgtaaccttatctttttgtgtttgtgagcacttttattttatgtatgtatttattattgtagtagatttttcttggtgagctacttggagtctttgacatgggaaggaaagagcagttataagatctccctgactcatgttcttccagtagttttattgtagattgtgaatgttactgaagttttacattttactgattttgcagaaaatataatttttatggaaaagaagcaaattgacaaagcactgttgtggtattataagctggctctggtgaccta

SEQ ID NO: 596103 - DNA, 799 bp, Homo sapiens
  misc_feature (376)..(376): n is a, c, g, or t
ggcgtgtcgctgtcagtgcgggtgtgcagggatgtgagggcagctggagtgcgttgtggcgaagcttgtgggagcacgcccatcgtctgaggggctaacttccgtgaccatggtccaagtctctgaagaagtcggtggaggagagccgggagaagaagcagcctcgaggtgggacatgagtgaccggggcagtctctctgacgtgctggaggtctcacggactcgtgtacgcttatcccatagtcacacaactggatccgtctgccataacaagctaacaatggtgccaccgaacatcgctgaactgaagactttggacggtgcctcaatctgttagctgattaaccggaagtcgagggaagcttgtgctcaccancacgactcagtgtaagcctttcagcataacgtcatgagcgacgcagtgaaattcccttggcagtgatcgaggcctgaagcatcttttggcgcacgacgggcttcggctccctgccagctcttgaggttcgggacttgacgtacaacaacttgagcgaaaattctcttcctggaaacttcttctacctgaccaccctgcgtgcactctatctaagtgacaacgatttttgaaatcctgccgccagatattgggaagctcacaaagttgcagatactcagccttagggataacgacctgatctcgctgccctaaggaaactcgggggagcttacccagcttaaagagctccacattcaggggaacccgctcaccgttctgccccagaactaggaaacttggatttaactggccagaagcaggtat

SEQ ID NO: 596104 - DNA, 818 bp, Homo sapiens
  misc_feature (818)..(818): n is a, c, g, or t
cttagaggcactgaaggatagcacagaagtagaaatggtggatgagaacactgagaaaaaagatagaaccagaaaaatggccaattccaggccctcctccacgcaggtggccaccaacagattctctcaatgatggatgtgtccagagtgtgtccccaggccaagctttgtgctcaccatacagtcagggtgatgatcttctgaaagctctgggatggtcatgggaccggaatatgcagtgacataggtgactcactggaaatgccttaataaatacggaacaaatcggttgcaaaattgaaagcgatcaagacggtctcctggtcaaggactgtctatccccacctctgtgtgggcgacatgtgtgggcccaaccacgtgcaggggagataacacacccttgtgcgcatactgagagacagaccagaaggattgctaactctttacataggagcggcctattctgtgtaatcggcctggctgcatgcgcggctttatccatggtgggcaaggttacttcatacatactcctgggaaataccgacaagatatgtctctggtcccagggtattgaccttggtggtccagcatgacagtaacggcgaaacagagggattgagttagcatttcccagatcctcaaagtacctgataatcagaatgtgctttaaagtgtagtggccctgtgtaacactcagattcggtcgatgtccctggcgctcccatataatgtggcttaagcgtaagcaattcaacacctgcgcgagtatctccgtcacctcacagtccttggacatactagcaggcacccctacaacn

SEQ ID NO: 596105 - DNA, 961 bp, Homo sapiens
tgactggaactagactccccatctcactcatatatccacatcactccctcacaaacagtaagccttctcctcaaatctctcaatactttatccatcatcagcaggacgagcttgaggtggataaaaacaaaaccagacatacgcaacaaagtcttaggcatactcctcaatatacccacataggacgaataatagcaggtgtctacccggtacaaagcctaagcataccccattcttaacgtttagcctactcaatatttagttccctaactactacacggagttgcctactacctcaaattataaaactccaggcacgcaggaccctactactatctcgcacctgaaagcaagctaacaatgactaacaaccttaaattccactcgagcctcctcgtccctaggaggcctgtcaccgctaaagcggctttttgcccaaaaatgggccatatatccgaagaattcacaaaaaacaaagaagcctccatcatcccccaacactcaatagccaccaattaaccaatcctttaaacctctaacttctaacatacgcctaatctactccaccgtcaattcagcaatacgtccccaatatctaaacacgcgtcagccagaacaagtgacagggcgaccataccagaacccccccagtcctcaccagcgatcatcggccctaccaagcacgcctacctacttcacccttgtatctacaacgtcgaccaccacagacacaacacaacaacacatcgagcgccaccgcacccacacagacctacacccctcagcgagcagcccacaagcacaaaacggaccacgcgccacagaaacgcggcacatacgcgcgcccaacaaaaacaccgcgccgacccaacaccaggcgcgggcacgcaccacgcgcgacccaccccccggcaccgcacacagcgccaccacacgcacaccccaccacgacaaccagccg

SEQ ID NO: 596106 - DNA, 142 bp, Homo sapiens
ggaccggtgttcctttgtctagtgggtctagtgtggagaaggtgagggaggctccaggccattcttctttttttttgtgatacggagtcttgcccttgttgaccaggctggagtgcagtgagccgagaatcacaccattgca

SEQ ID NO: 596107 - DNA, 5396 bp, Homo sapiens
  misc_feature (5373)..(5373): n is a, c, g, or t
ggcctgatagcgcggcgtgtggaccggccgaagagcgcgcccagagcggcgccgtcgcgagccacagcccgagccggtcccagccgagccgagccccagccgagccgagccggcccgagcgctccggtgcccgcagccatgccggccggccgcgcgcgcacctgtgcgctgctcgccctctgcctcctggggccccaggatttcgggccgacgcgcttcatctgcacttcggtgccggtggacgccgacatgtgtgccgcgtccgtggccgcgggcggcgcggaggagctccggagcagcaatgtgctgcagctccgggagaccgtgctgcagcagaaggagaccatcctgagccagaaggagaccatccgcgagctgaccgccaagctgggccgctgcgagagccagagcacgctggaccccggagccggcgaggcccgggcgggcggcggccgcaagcagccgggctcgggcaagaacaccatgggcgacctgtcccggacaccggccgccgagacgctcagccaactcgggcaaactttgcaatcgctcaaaacccgcctggagaacctcgagcagtacagccgcctcaattcctccagccagaccaacagcctcaaggatctgctgcagagcaagatcgatgagctggagaggcaggtgctgtcccgggtgaacaccctggaggagggcaaggggggccccaggaacgacaccgaggagagggtcaagatcgagaccgccctgacctccctgcaccagcggatcagcgagctcgagaaaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagctgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggcggggccaccaagtggaccttcgaggcctgtcgccagatcaactgagcacggcaggccaggctgagccgcccgccctcgccccctgcttgtgcggcgatgatctgtttgtgcgtctcttctctcccttttccccaggaatgaaccgaggccgtcgccctgcacacgcacacgcacacagcctggttttgtcctcatgcacacgaagcagcccctgctcccatctgtccctgaggaagccccacttctctgtaggagcccggactctctcagcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaaggtgaaggcaggccgtcctgggatggtaccctgtgctctcccgtggaggagaggggatggctgaggacactggcccttacccagggcgaacagcatccatccctgctgtttgcatcttgagagcagcatggggcctgggaggtcggcctgtgtgcccagctcagctagctctgccccaggacggccctgccctcgaccttcccacctcctcagatcctgcaaggctgggtctgcccctcccttctcacctctggagctgtgctgcactgcttcccagagagggccctgagagaggagcgtgccacccaccagggaagccgggccccagcacccctctcctttggcctcccggagtgcagaccagaggggaccttttaaggaaagaagccgtgtttcgatgaagacctggccacatggggcactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcaccctggagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgccggtgcgcggctgtgtggggtgctccctgccagcacctccggccagccccgcccctgccgatctactggaccgcagaccaccttctgcccccgtggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgcccttgctagggtctgagccaagcccctcgactcctcactgtgttgacacttggcactttgctggccccgagaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaaagcccaatacttagagtcccaattttgtctcatttgccaaaaaaaaaaaaaaaaaaaaaaagcaaaccccctatggttgatattgttataatgtatatactgtataatatgaaagagaatcgatgtatctcactttttcattatttgctaaccaaagctgtacatttttcatatgatctgcagccttttgggtatcaaatgggtcaaaaccatgggacctgccacctcccatcagcaattctggaaatgcactatttctactggtattcttgcttttttttttttttcattttcttgctgaaatgacatgaattgttgagtttatttttacncagtaaagagtggagaaagaaaa

SEQ ID NO: 596108 - DNA, 843 bp, Homo sapiens
ctccttggcgatggatgacgtaccccttaccatcccattaaaacctgtaatcacccttaccctgctcaacatccagtatcccatcccacaggcaggctttcaaagcattaaagcctgtcatcactcgcctgttacagcatggtcctttgaaagcctataaacactccttagcaatttccccattttacctgtccaaaaactggacaagtcttacaggttagttcaggatctgcgccttatcaaccaaattgtcttgcctatctaccccgtggtgccaaacccatagactctcctattcctcagtacctccctccacaaccattctgtgctagataaacctagctgaccccataaatcctaagattctttccccactcccctttccatttcgttaaaaaacagacctaaaagctgctcccacactagctctcgctaactcatcccagactttttcattacacatagctgaacgtgcagggctgtgcagtcaaaattcttacacaaggactgtgatcgtgccctgtggcctttttatccaaacaacttgaccttactgttttagcctagccctcatgtcttgtgtgcggcagctgcaatgcttaatacttttagaggccctcaagatcacaatatgtctcaatactctctacagtctcataattcaaatctattctgcctctacctgagatattttttgccctcataactttggagtaatcttgttaatcagcctacctgtaggcccgtcattacggcaaagccaaccggccaccgtagggggagcccgagggcctatgtaaaattggcccgagggcgcggaacgcttgattgctccccctcgga

SEQ ID NO: 596109 - DNA, 2933 bp, Homo sapiens
  misc_feature (2850)..(2850): n is a, c, g, or t
ggcctgatagcgcggcgtgtggaccggccgaagagcgcgcccagagcggcgccgtcgcgagccacagcccgagccggtcccagccgagccgagccccagccgagccgagccggcccgagcgctccggtgcccgcagccatgccggccggccgcgcgcgcacctgtgcgctgctcgccctctgcctcctggggccccaggatttcgggccgacgcgcttcatctgcacttcggtgccggtggacgccgacatgtgtgccgcgtccgtggccgcgggcggcgcggaggagctccggagcagcaatgtgctgcagctccgggagaccgtgctgcagcagaaggagaccatcctgagccagaaggagaccatccgcgagctgaccgccaagctgggccgctgcgagagccagagcacgctggaccccggagccggcgaggcccgggcgggcggcggccgcaagcagccgggctcgggcaagaacaccatgggcgacctgtcccggacaccggccgccgagacgctcagccaactcgggcaaactttgcaatcgctcaaaacccgcctggagaacctcgagcagtacagccgcctcaattcctccagccagaccaacagcctcaaggatctgctgcagagcaagatcgatgagctggagaggcaggtgctgtcccgggtgaacaccctggaggagggcaaggggggccccaggaacgacaccgaggagagggtcaagatcgagaccgccctgacctccctgcaccagcggatcagcgagctcgagaaaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagctgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggcggggccaccaagtggaccttcgaggcctgtcgccagatcaactgagcacggcaggccaggctgagccgcccgccctcgccccctgcttgtgcggcgatgatctgtttgtgcgtctcttctctcccttttccccaggaatgaaccgaggccgtcgccctgcacacgcacacgcacacagcctggttttgtcctcatgcacacgaagcagcccctgctcccatctgtccctgaggaagccccacttctctgtaggagcccggactctctcagcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaaggtgaaggcaggccgtcctgggatggtaccctgtgctctcccgtggaggagaggggatggctgaggacactggcccttacccagggcgaacagcatccatccctgctgtttgcatcttgagagcagcatggggcctgggaggtcggcctgtgtgcccagctcagctagctctgccccaggacggccctgccctcgaccttcccacctcctcagatcctgcaaggctgggtctgcccctcccttctcacctctggagctgtgctgcactgcttcccagagagggccctgagagaggagcgtgccacccaccagggaagccgggccccagcacccctctcctttggcctcccggagtgcagaccagaggggaccttttaaggaaagaagccgtgtttcgatgaagacctggccacatggggcactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtggagtggccgccncccgaagaacgcacatgtattatatggtatgtctctgccttttttgtgaaatttatattgagggttttcagttttgtggcccc

SEQ ID NO: 596110 - DNA, 2064 bp, Homo sapiens
  misc_feature (2041)..(2041): n is a, c, g, or t
ttggcactacccaccccgtcgggtggagccgctcacccgacggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgccggtgcgcggctgtgtggggtgctccctgccagcacctccggccagccccgcccctgccgatctactggaccgcagaccaccttctgcccccgtggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgcccttgctagggtctgagccaagcccctcgactcctcactgtgttgacacttggcactttgctggccccgagaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaaagcccaatacttagagtcccaattttgtctcatttgccaaaaaaaaaaaaaaaaaaaaaaagcaaaccccctatggttgatattgttataatgtatatactgtataatatgaaagagaatcgatgtatctcactttttcattatttgctaaccaaagctgtacatttttcatatgatctgcagccttttgggtatcaaatgggtcaaaaccatgggacctgccacctcccatcagcaattctggaaatgcactatttctactggtattcttgcttttttttttttttcattttcttgctgaaatgacatgaattgttgagtttatttttacncagtaaagagtggagaaagaaaa

SEQ ID NO: 596111 - DNA, 1997 bp, Homo sapiens
  misc_feature (33)..(33): n is a, c, g, or t
  misc_feature (35)..(35): n is a, c, g, or t
  misc_feature (1974)..(1974): n is a, c, g, or t
atgttgttcaagaggatcccgcctaagtggaangnccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgccggtgcgcggctgtgtggggtgctccctgccagcacctccggccagccccgcccctgccgatctactggaccgcagaccaccttctgcccccgtggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgcccttgctagggtctgagccaagcccctcgactcctcactgtgttgacacttggcactttgctggccccgagaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaaagcccaatacttagagtcccaattttgtctcatttgccaaaaaaaaaaaaaaaaaaaaaaagcaaaccccctatggttgatattgttataatgtatatactgtataatatgaaagagaatcgatgtatctcactttttcattatttgctaaccaaagctgtacatttttcatatgatctgcagccttttgggtatcaaatgggtcaaaaccatgggacctgccacctcccatcagcaattctggaaatgcactatttctactggtattcttgcttttttttttttttcattttcttgctgaaatgacatgaattgttgagtttatttttacncagtaaagagtggagaaagaaaa

SEQ ID NO: 596112 - DNA, 3761 bp, Homo sapiens
ggcctgatagcgcggcgtgtggaccggccgaagagcgcgcccagagcggcgccgtcgcgagccacagcccgagccggtcccagccgagccgagccccagccgagccgagccggcccgagcgctccggtgcccgcagccatgccggccggccgcgcgcgcacctgtgcgctgctcgccctctgcctcctggggccccaggatttcgggccgacgcgcttcatctgcacttcggtgccggtggacgccgacatgtgtgccgcgtccgtggccgcgggcggcgcggaggagctccggagcagcaatgtgctgcagctccgggagaccgtgctgcagcagaaggagaccatcctgagccagaaggagaccatccgcgagctgaccgccaagctgggccgctgcgagagccagagcacgctggaccccggagccggcgaggcccgggcgggcggcggccgcaagcagccgggctcgggcaagaacaccatgggcgacctgtcccggacaccggccgccgagacgctcagccaactcgggcaaactttgcaatcgctcaaaacccgcctggagaacctcgagcagtacagccgcctcaattcctccagccagaccaacagcctcaaggatctgctgcagagcaagatcgatgagctggagaggcaggtgctgtcccgggtgaacaccctggaggagggcaaggggggccccaggaacgacaccgaggagagggtcaagatcgagaccgccctgacctccctgcaccagcggatcagcgagctcgagaaaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagctgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggcggggccaccaagtggaccttcgaggcctgtcgccagatcaactgagcacggcaggccaggctgagccgcccgccctcgccccctgcttgtgcggcgatgatctgtttgtgcgtctcttctctcccttttccccaggaatgaaccgaggccgtcgccctgcacacgcacacgcacacagcctggttttgtcctcatgcacacgaagcagcccctgctcccatctgtccctgaggaagccccacttctctgtaggagcccggactctctcagcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaaggtgaaggcaggccgtcctgggatggtaccctgtgctctcccgtggaggagaggggatggctgaggacactggcccttacccagggcgaacagcatccatccctgctgtttgcatcttgagagcagcatggggcctgggaggtcggcctgtgtgcccagctcagctagctctgccccaggacggccctgccctcgaccttcccacctcctcagatcctgcaaggctgggtctgcccctcccttctcacctctggagctgtgctgcactgcttcccagagagggccctgagagaggagcgtgccacccaccagggaagccgggccccagcacccctctcctttggcctcccggagtgcagaccagaggggaccttttaaggaaagaagccgtgtttcgatgaagacctggccacatggggcactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcaccctggagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcagttccacttaggccggagcagttccacataggccggagagtgccacttaggc

SEQ ID NO: 596113 - DNA, 3714 bp, Homo sapiens
ggcctgatagcgcggcgtgtggaccggccgaagagcgcgcccagagcggcgccgtcgcgagccacagcccgagccggtcccagccgagccgagccccagccgagccgagccggcccgagcgctccggtgcccgcagccatgccggccggccgcgcgcgcacctgtgcgctgctcgccctctgcctcctggggccccaggatttcgggccgacgcgcttcatctgcacttcggtgccggtggacgccgacatgtgtgccgcgtccgtggccgcgggcggcgcggaggagctccggagcagcaatgtgctgcagctccgggagaccgtgctgcagcagaaggagaccatcctgagccagaaggagaccatccgcgagctgaccgccaagctgggccgctgcgagagccagagcacgctggaccccggagccggcgaggcccgggcgggcggcggccgcaagcagccgggctcgggcaagaacaccatgggcgacctgtcccggacaccggccgccgagacgctcagccaactcgggcaaactttgcaatcgctcaaaacccgcctggagaacctcgagcagtacagccgcctcaattcctccagccagaccaacagcctcaaggatctgctgcagagcaagatcgatgagctggagaggcaggtgctgtcccgggtgaacaccctggaggagggcaaggggggccccaggaacgacaccgaggagagggtcaagatcgagaccgccctgacctccctgcaccagcggatcagcgagctcgagaaaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagctgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggcggggccaccaagtggaccttcgaggcctgtcgccagatcaactgagcacggcaggccaggctgagccgcccgccctcgccccctgcttgtgcggcgatgatctgtttgtgcgtctcttctctcccttttccccaggaatgaaccgaggccgtcgccctgcacacgcacacgcacacagcctggttttgtcctcatgcacacgaagcagcccctgctcccatctgtccctgaggaagccccacttctctgtaggagcccggactctctcagcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaaggtgaaggcaggccgtcctgggatggtaccctgtgctctcccgtggaggagaggggatggctgaggacactggcccttacccagggcgaacagcatccatccctgctgtttgcatcttgagagcagcatggggcctgggaggtcggcctgtgtgcccagctcagctagctctgccccaggacggccctgccctcgaccttcccacctcctcagatcctgcaaggctgggtctgcccctcccttctcacctctggagctgtgctgcactgcttcccagagagggccctgagagaggagcgtgccacccaccagggaagccgggccccagcacccctctcctttggcctcccggagtgcagaccagaggggaccttttaaggaaagaagccgtgtttcgatgaagacctggccacatggggcactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcaccctggagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagcccaccccgtcgggtggagcgctccacccgtcggg

SEQ ID NO: 596114 - DNA, 804 bp, Homo sapiens
  misc_feature (2)..(2): n is a, c, g, or t
  misc_feature (395)..(395): n is a, c, g, or t
tntggagaggccgcggcggcaggcagcgggtgagtctctaatcttctaaaaggggttcctatagaaacgcggagcggggcgcgccccccgctcggcccaggcccgggctgcggcgcttcgcacagcgcgcccctccccaagagcccctctttgctgtgggcgctccccgtctccgttcggcccccaccggccgagcgaaagaaatcaggagctagaaagagaggcattagatcgagatgagcggcagaactggaatcccgtctcggattcgtgacatttcaggcctattagcatttctccaacggagccttctgaaaacctatttaaagtgtaatattaaaaacctcttggctgggggcctctctcgccttccatccgccgcagccccctccagngagggcgagaccgggaaaaaaataaaatctgttgagctcagaggaagtagccgccaagcccaaaaagtgcttggatggccacaggcaggccgtagggggaagggagccccaatcccccagactttgtacttttatttagcgctttcagcaaaatcctttctgggttgagtagccgtgagctgcccgcggacgacctacctgaccggggcgcagggagtgcggaccacgccagcaggacttgtcctgggggccccggagccctcatctctgcagacccccgagcccgggctaggcataacgtaccctggaagggaagcttggagggggcagaaaattcttccaatgctgcctcgaagagcaagtgcagtgataagattgacttaaaacaagagagcccgtctttcgcgcg

SEQ ID NO: 596115 - DNA, 168 bp, Homo sapiens
cccctccgcgcataactcttcctttataattacccagtctcaggtattctttagagagtagacgtagtacaagaatggactaatacaggtgcctagcccagtgtctggaacttcaggggaaaggttaaatgtcagctgtcttttggagcaaaaaaaaacacctttctc

SEQ ID NO: 596116 - DNA, 284 bp, Homo sapiens
  misc_feature (1)..(1): n is a, c, g, or t
  misc_feature (105)..(105): n is a, c, g, or t
  misc_feature (276)..(276): n is a, c, g, or t
nttcggcacaggaagtggcatgataatggctcacagaacctccaccttctgggctcaagcgctcctcccacctcagccaacagagtagctgggactacagtcgtngttcaccacaccagtccaactttgaaaccctgtctctactaaaaatacaaataattagacaggcatggtgacacacgcttgtaatcccaggttactctgaggactgagggcaggagaataacttggaaccaaggagggaggaggttgcagtggagccactcacgttccttnttgttctc

SEQ ID NO: 596117 - DNA, 897 bp, Homo sapiens
  misc_feature (30)..(30): n is a, c, g, or t
taatttaatttaagttgtgacaaaaaaaanttttggaaataaaatgttcaaattcacggggccaccttgatcttattttcgatttagacttcctttggaaactacctaattcccttccttatttagtgggcatctgtctcatcttgatagtcgttttcatgatcacaaaatttgagcaggatagacatagagctataagaaacagactttgtaaagaccaacttaagaaacttcctgtccataagttctataaaggagatgagtttgatgtatgagccattacggtggatgagtctgacgatggtaacatactcggagatctatactgtattcatgattatcattccaagctgtgttctactgtttgcttagctcatcttgtgcttctcttgtcttttgcgatttcacctatcctgcttctatctactagcgagcgacgagtttagacttttatttgtattgcgttatgatattcgatatatgccttttattttctctttttctattgctttcttttcgttttgtgatggttatgctcacgtcatcttatgttttttcgataaacttttctactttcactctttggattgatagttttcattttgcttgcgatttatcttttgccgtctctattggacgtatatttagtagatgggcggcgcatcgtaatcgggttcggtgcttgggtttgcctgtatcctttttttctcccctcgttatttccgctattgtctccagtcctcatggatctcttcgattcgttttatgttatttattatactctgccattacgtggtgcgtcggttttcagcattttgggtcggtttctcgtcacctcttggtgtggaaagtttgccgccgtcggcccactctaacccatttacgttctacgaaccg

SEQ ID NO: 596118 - DNA, 183 bp, Homo sapiens
cgactacaagagtcacctgagtgtgccatggccagcagccggctggccaagtccctcgtggtggccgaagagaagaagatgtttggaactgggttgtggccatggcctggcaagcatgcctggcctatgtctcccaaaccccaatggacttgtgattgggtacctgatgctcgcaattctgta

SEQ ID NO: 596119 - DNA, 1274 bp, Homo sapiens
gagacaattccgtaggcgactgaaggtcctatatgctagagtaggtgcaatgagatgagtaaattgaagtcctaacggcaggattctgtttcatgacttatgtgctgggattgatgatgcagttctacaactacttgtcaggtgagtatagctgtagttgatggttgcataggaatatatgaattgaggcttgatggatgatcgaagtagtgagaatctagtcaaggatggaagactggtgcagagcctcgctcttcaagattatatacgccacgagttactcgatggaggctggcggcacgcatcaaatcgttgacattcgcattgtgaccgcgaggatgtgtggatgggttgctttgctgacactccggagatcggtgcctgttgttttctcccaagttccctgtgtgtgaataaagcggacgtactgtagtcccacgaaatttaataccaattagacaggggcaagtgacttttaggattacgaactgaaggctgactataaaaacagttttaaagctttaagtttaagagagttgtagggtgcattaagagataactttgacatgggggactctttttaagaaacgcagatttaaaacctccgagagggtggatttacacacaggaccgttggaacaaatcccatggaaccgcagggagacgacacttgtggcggttcaatttaaacaggccttagttttaaacgccattttaactaaaagcggcaagcaccgagcaaactcggaaacaggacttcaacactttgaggaagggtgggtaagcgactggaacaacgcacacttttggcagcgcaagaattagaaccgcttggccaccttgtggcaccaaacacctggcgacacgacacacggaaacgttaccccggggcgaaacgggcccagagaccacgacaggaaacttaggacgcacacgactacggggcgaacaaaatccacagcaacaggcattagcaaaaccccttaccccttttctaaccgacacaggaacaacacaacacggagcttccaccattttaacccgcgctcggacaaaaagcggtaccggacaagcggccgtccaacgcacacacccactaaggaacccgtcggtctagaggcaacacagccaccacaaggacttacaagcgggcccacaaactggttaccaccacatttttcagacacgcgcaaacatttggcggacacacatataacgaaacaccaccaccgacgacaagagcgcacaacacacgcataaaacacagccagatc

SEQ ID NO: 596120 - DNA, 238 bp, Homo sapiens
tgtaatcccaatcattaggtggaagcagaggcgggagtgatcacctgaggtcaggaattcgaaaccagctgggactacatagtgaaaccctgtctctactagagatacaaaaaattagccgggtgcggttgtgggcgcctgtaatcctagctactcaggaggctgaggcaggagaatcgcctgaacccaggaagcggaggtttgtagtgagccaagattgggatcttggcctcgtgcg

SEQ ID NO: 596121 - DNA, 644 bp, Homo sapiens
  misc_feature (190)..(190): n is a, c, g, or t
  misc_feature (200)..(200): n is a, c, g, or t
  misc_feature (322)..(322): n is a, c, g, or t
  misc_feature (394)..(394): n is a, c, g, or t
tccccagatttatttattggttgaacagttctacttcagccaagaggggaggtgttcctggagaaaccagttgggtaaagcaggtgaaaaacgcaatacacatggtggcaagattccagcttcacaaaggggcaagggagctttcagtaaaatcactgagatcttattgatgggaaggatgaaagccacntcagcttccntgcaaggcaagcaggaaagcaatctacttcccaggcacactcttgacccagagttctggctattcagaccagacaggcacctattttcatctgcagaaatgttgatgttccaagtagagagnaattgtgaccctatctcccatgcaagcctgaacctgaagagtgctcctcctgtgtgaatgcagtcaccttanagtgttccagaaaggctgtctatatgtgcacccatcctgagtgcccatgggagaaccctcagctatgtctgcagtggtggatgggggaaaaataagtccccttctccaagattcttcaggagtaccaggactgcttgactgttggagtagagctgcagactttccccactgagcccagcactacaactgtgcctctgctgaaaggaacttcccaccaatggaaagatttaggactcaaggccttccatcc

SEQ ID NO: 596122 - DNA, 951 bp, Homo sapiens
aagtaggccaggcgcggtggctgacacctataatcccagcaccatgggaggccgaggcaggcggatcacctgaggtcaggagttcaagaccagcctggccaacatggtgaaaccccaactctattaaaaatgcaaaaaaatagctgagcgtggtggtgcatgcctgtcaagtcccagctacacaggaggctgacgcaggagaatcgcatgaacccgggaggcagaggttgcagtgatccaagatcacgccactgcactccagactaggtaacagagcaagacttcatcccaaaaaaaaaaaaaaaaaaaaaaaaaaaattcttgtaaaaaaaatttaaaaaagacggggaaatctggagtaagggaatttatttccctttaggggtataaaattttaaataaccgtggtttttttttgggaaaagagcgcttaataagggagagggaaaggtggatataacaatagttgggcacatttttcaaaggtataagaatccgagacgggagtttcggatcgtatgggtcggggcccttggtgaaacccttcacaaacaaaccggggagcatattttattaacccttaaaagtgtctctggtccgtggggaaatcccccttccttttaaacggggtcccattgtccttttgtctctaagagaaagcaatttaacccggttttgtgggtcaagggttaatggtacggttgaagttacacacttctttaagaaggtttctatcccagcgggcatccgtgaagttatgtaactcctatgggggcgagactctcttcctccaccggggagcgatcaccacattggtcaataccggttaagggtcatctttttatccttcacggttccagggtcagtctttcacagggtaccctacccggcgaaatgtgggggcccgactggacgggacaaagcagaatgggcacgcgaggaattcttctg

SEQ ID NO: 596123 - DNA, 620 bp, Homo sapiens
ggcagaaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcggggaagccactctgatcccggactgcctctagcggcacccttgggcttgtggctttgccctcgggccgggggaaggctgacggcgatgccaggacgccgctcccctccgaccgtaccgggcgccctgggttgcctggctgctgggcggctcttggggcctggacccctgtgcggcttggtgcagccctgggggcgggtgtggagccccagcgcccgtgccaaggcgccgcagcaagtgggaggggcggccagggttattgtacccagcaaagtaaagcgggcgcaaacaagccggcggccctgatctcctacgacgggcttccaacagcagccgttccgggtgctggaacgagaagggaaaggcgctgatcccctgcaagaagattatcttgaatatatttccgctgtataagcgatggacgtac

SEQ ID NO: 596124 - DNA, 437 bp, Homo sapiens
tagccgacctagcaggaccccccatgactcagtctcagacacactaacacttgtccacattcatcttgctagaatagctattcctaacattctggttcagatcctctgtaagtttctcaagacaaattctccataatctgatcgctgctcttccctgaattctttacttaccaaccctacaccccatccttctaacctgacaaccaaggtgtccagtttcatagttatgccctcctctgactgattaccattatgtcagctgtttcattgctggcaaagccacttaccttctctctcatcatgattccttcaagtcctccctggctcagcttaaatcttagcctggcttcacctatagagtgacagactcctttccaatgctctcacagaaactcatgcatttatccatcatagtgtgtgtgtgtgtgtatacatat

SEQ ID NO: 596125 - DNA, 268 bp, Homo sapiens
  misc_feature (44)..(44): n is a, c, g, or t
  misc_feature (127)..(128): n is a, c, g, or t
  misc_feature (136)..(136): n is a, c, g, or t
  misc_feature (178)..(178): n is a, c, g, or t
  misc_feature (211)..(211): n is a, c, g, or t
aaagtacttttaattatagtcctttctaaccagtgttgacagtnttctgtattgctgcttcacagtgaaagtacttgcattacctcttttgtattgaaaaggtttcatttaggtagttactcttttnntgcctctntttggtaagtagtttgcccacacaacagtttagataaaattngaaaataaccaaggatacctcaagccacctttnacctaaggcacattggttcttgacagcagacacatttcatgagccaagagagctagg

SEQ ID NO: 596126 - DNA, 103 bp, Homo sapiens
tacacattcaagggtggcagctgctttaaagcactagaagtggtagcagcttagctctagaaagcaggaaactaactttcagccagaataccaccgtccacag

SEQ ID NO: 596127 - DNA, 1000 bp, Homo sapiens
cgtggtggctcatgcctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaagggaaacctctgggagggcctttggttcagtaaatccctttcagtatttatcccttccttttccccaaaagaagctttcttcccgtgttcaccctagaaagggagcaggatgctaataaatactttgtggggtgtgacttaggccacaccaactcttaatcatctcccaatttccctttaaaacctttctaatttcccagggcaaggttacccctcgtgttgttacctcagaaactttggcagagacagtcattgggctttccccaaaagtgccccactgcgggagataatgcgatggcgcctcccttaacaccttatggctcctcccaatattttttctccaaccacttgacaattcaaggtcctcctatggaggaagctcttacgaacacagacaagaacaagcaacaaaacaacgaacgacaaacacaatgttgttgcggcgggcactgtcggccctcggaaagaagagttcttcaagaacaccatctgcggagagggagcccgggggcccccccgatggctcatagcgcggaacacctggtgcacagaggcggctccacaaagaaaaacaccggcggcaacaaaacaacgggacgggaaactcccaccccactgaaaaaaaacgcgcggcggggggaacacacagaggcttcttgaaacaacaccacacagaaagcgcccgcgcgggcgctaaacaggggggcgtcc

SEQ ID NO: 596128 - DNA, 1033 bp, Homo sapiens
  misc_feature (485)..(485): n is a, c, g, or t
  misc_feature (489)..(489): n is a, c, g, or t
  misc_feature (500)..(500): n is a, c, g, or t
  misc_feature (509)..(509): n is a, c, g, or t
  misc_feature (526)..(527): n is a, c, g, or t
ggtacttgcgagcaaatacgattggagacaaggctggtgaggcaggcgggagaaagcagggctcagctgctgcccctgcctactgcgaactctgctccttgcctctggcgttgaaccactacgcaacgtgcactctcctgcgcgcacactacctgcacgcctgcgcctgctgcgggcgactgcactgccactacctgctctgcacgcgccctcgatccttacctctgcctcctccctcctcctactgcacaccacacgcgcccctctgcacacaccccgcccaacctcacgcctcaggcgcctcccttgcctcctctctcccacgcctctctctcccctctcctctctgctgcccaacattggcgcacctctactacaacgcacactcacgccctccacctacacacacgctcacacacgcctcccccacgaagcgccctgcgcaccctcccacgcctctgcaaaccaaaaagtgtctgtcatgntcgntgttttccgantatgcgaanccccctgaagcaatganncatcacaagaaaggctgcggcaccttctacaccccctccccacccccacaccacccctctgcctctccccctgcacgcacacccacccccctccaccgcaccaccccactccggcgccccctccctctgcgcctcgccacccgccactctttcctaccctccacccccacgccccccccccccctcacccagcacccactcctcacccctgcacccctacccgcgccctcccttccctcccctccccacctctgcacacttctgctttcccatcccccccttctctggcgctgcgcctccccccacccctcccccgcccacttcctgcttgaaaattaggccttcgaggcccccgaatatccaacggtggatgcccccgaaatttttgtgcgcgacggaaacccccgagttgcacggggccacagtgtcccttccccgtcgaccccctcgacccccccccgtctccgctcccctccgcgctgctcacactccctttaacccttggg

SEQ ID NO: 596129 - DNA, 319 bp, Homo sapiens
ttggggaattttttttgtttttgggaaccccaaaggttgggccccaatttaggcctttccttccaaccgggggtttagggtgggggggttccccaacccaaatggggggttataaaaaagggaccctcctaattccctccccccctagaattgggggggggggtttgggttttttaggggggtttttaccccttgggtttccttggggtttttgggttggggtaaaaaggggcccgggggaaaacccgcccccttctttttaggccgggggcccaaccgggaaaaaaagggggccgggggatggttttttggcccccca

SEQ ID NO: 596130 - DNA, 162 bp, Homo sapiens
gaaactccattggaagcttttcttcaatttcaatgcttttgacagagtagattactttttgggaaacactcctttctctgctcccgttacaccaaactctcctattttattttttggttggtttgttggcctcgggtggtacccctcggggaatcttctaaa

SEQ ID NO: 596131 - DNA, 300 bp, Homo sapiens
tgagcctccatgcccagctaaataaatattctttaattataaaataattattcgtgagttatggttttaagtttgacctatatatcagctgtctcaagaaatacaggaaataggccgggtgcagtggctcacacctgtaatgccggcactttgggaggctgatgcaggcggatcacgaggtcaggaaatggagaccatcctggccaacatggtgaaaacacgtctctaccaaaaaaatacaaaaaattagccatgcatggtggcacacacctgtagtcccagctactcaggaggctgagg

SEQ ID NO: 596132 - DNA, 717 bp, Homo sapiens
  misc_feature (95)..(95): n is a, c, g, or t
  misc_feature (140)..(140): n is a, c, g, or t
  misc_feature (149)..(149): n is a, c, g, or t
  misc_feature (193)..(194): n is a, c, g, or t
  misc_feature (205)..(205): n is a, c, g, or t
  misc_feature (208)..(208): n is a, c, g, or t
  misc_feature (215)..(215): n is a, c, g, or t
  misc_feature (218)..(218): n is a, c, g, or t
  misc_feature (225)..(225): n is a, c, g, or t
  misc_feature (230)..(230): n is a, c, g, or t
  misc_feature (254)..(254): n is a, c, g, or t
  misc_feature (265)..(265): n is a, c, g, or t
  misc_feature (270)..(270): n is a, c, g, or t
  misc_feature (277)..(277): n is a, c, g, or t
  misc_feature (279)..(279): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (296)..(297): n is a, c, g, or t
  misc_feature (299)..(299): n is a, c, g, or t
  misc_feature (327)..(327): n is a, c, g, or t
  misc_feature (332)..(332): n is a, c, g, or t
  misc_feature (342)..(343): n is a, c, g, or t
  misc_feature (352)..(352): n is a, c, g, or t
  misc_feature (354)..(354): n is a, c, g, or t
gaagttgctttctgtcccggcagaggaagccagatcgctgagggtccggtctccagtttgcctcctgctatatccattggaagagaaaagtttgngacttgggcccccaagttttgagagaactgggctttcggcgcggngggacagangaggctcgtggggagctttccccatggagcttacccagcctgcnnaagacctcatncanacccatnaancccctgnctcanaacttggggaccctgaagaccccnggagaggaggntgaanatggctnanacactgnggnccntnanntntttccctgcacccctgagcctgtgaatnctganccggatgccnntgtttcctntncacagggccagctccctgaagcagtccaccactctcaccaaccggtcatggagggaacgaagtgtcagctctgtcggcaccctagactccctgtggcatccaccagctcgcagcacagggggagctggaccagctgaaggagcatttgcggaaaggtgaccaacctcgtcaacaagccagacgagcgcggttcacccccctcatctgggctccgcctttggagagattgagagcgttcgcttcctgctggagtggggtgccgacccccagatcctggcaaagagcgagagagcgcctgtcgctggcagcaccaggcggtacacagacattgtggggctgctgctggagcgtgacgtggacatc

SEQ ID NO: 596133 - DNA, 285 bp, Homo sapiens
gacaatttaaccatcgttgctggtattttcataggcattgcattcctgcagatatttgtggatatgcctggcccagaatttgggtagcgatatcgaagctgtcagggcgagctggtaagaccccctccaaccgctgctgcaagacacttgacagacccagctttcgggaccctccccggtgccgaactgatcttcgagctgcatggacctaatacagatgcagcctgcaagtctcgcctaatggagctgccattaggggagtgtaaacctgggaaatgctgctac

SEQ ID NO: 596134 - DNA, 446 bp, Homo sapiens
  misc_feature (95)..(95): n is a, c, g, or t
  misc_feature (140)..(140): n is a, c, g, or t
  misc_feature (149)..(149): n is a, c, g, or t
  misc_feature (193)..(194): n is a, c, g, or t
  misc_feature (205)..(205): n is a, c, g, or t
  misc_feature (208)..(208): n is a, c, g, or t
  misc_feature (215)..(215): n is a, c, g, or t
  misc_feature (218)..(218): n is a, c, g, or t
  misc_feature (225)..(225): n is a, c, g, or t
  misc_feature (230)..(230): n is a, c, g, or t
  misc_feature (254)..(254): n is a, c, g, or t
  misc_feature (265)..(265): n is a, c, g, or t
  misc_feature (270)..(270): n is a, c, g, or t
  misc_feature (277)..(277): n is a, c, g, or t
  misc_feature (279)..(279): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (296)..(297): n is a, c, g, or t
  misc_feature (299)..(299): n is a, c, g, or t
  misc_feature (327)..(327): n is a, c, g, or t
  misc_feature (332)..(332): n is a, c, g, or t
  misc_feature (342)..(343): n is a, c, g, or t
  misc_feature (352)..(352): n is a, c, g, or t
  misc_feature (354)..(354): n is a, c, g, or t
gaagttgctttctgtcccggcagaggaagccagatcgctgagggtccggtctccagtttgcctcctgctatatccattggaagagaaaagtttgngacttgggcccccaagttttgagagaactgggctttcggcgcggngggacagangaggctcgtggggagctttccccatggagcttacccagcctgcnnaagacctcatncanacccatnaancccctgnctcanaacttggggaccctgaagaccccnggagaggaggntgaanatggctnanacactgnggnccntnanntntttccctgcacccctgagcctgtgaatnctganccggatgccnntgtttcctntncacaggcaggcagcttccttaaacactttaagaattttaaccaaccggggatcgagggaacgaggtggtaacttttggcgggccccccttaa

SEQ ID NO: 596135 - DNA, 164 bp, Homo sapiens
gaggaggctggaggaggcactgggggccctaatggctgtccatggcatgactaccgtggacagtttctcatgagctgcagggcctggagcaggaggtagagccgtctagaaagtctgctcgatgtcatgagacaaggtctgactcgcagccgtggcctccagta

SEQ ID NO: 596136 - DNA, 1008 bp, Homo sapiens
  misc_feature (743)..(743): n is a, c, g, or t
  misc_feature (1007)..(1007): n is a, c, g, or t
ggtccgcgtggcacctcgcctgctccagcctctggggcgcaattccaagcttccagacctgcgaactgactgcgagaagaagaattaccttattttctctgccccaatagcatacctggagtgcgaggctacacacaaaattgagaattttaaccatgatgggaagatcgtgctacatcgcagtgctggatcagtcgtggctacatccagaatcggtgccaagttctgggaggtgatcactgatgaacatggaatcgagcccaccggcacctatcacggggacagggacctggagttggatcgaactctctgatgtactaaaaagaatccagaggtggggaatatgttcctcgtgccatcctggatggatctaaaacctgggaccactggactctggtttcgcatcaggtccttgcggaccagatcttgagatgcagacaatcttgagtaatcgggtcaagtgctggggcaggtaacaactgggcacaaagggtcaccttgacagcagagggcgcctgagctgtgttgattctgtcctggatgtggtacgggaaggatgcatacagctgagactgactgccagggcttaccagactgacccgtctcctctggaacgggggcggccatgctcttcaatgggacaccctccttattagccagatccgagaagactggccttgatcgcatcatcatagctacagtgtggcgcctgcatccacagtgtctgacccgtgggccgaggnctacaatgcacctctccgtccaccaggtggcagagcatcagtgaatgagacgatgcgtgaaacaggcccctataaatctgcgccgactgagatagcacacaactaggggattgacactgccagcgccgaggggtacaacggtcggtcggcaacatcggccgcatgcggaaagcccccggccaaagcggtgcccacaggcatacagcggccaccgtcaaaagggaccacgccggcgccgggcagcacaggcagacgcccgcgaana

SEQ ID NO: 596137 - DNA, 786 bp, Homo sapiens
cgtcagggaaggtgggaagaggaccgcggcagggcgtttgggagctgcggctgcgctcgggggcgcggggctggctggcgggcgtctctccggcacacacagcccgtgcgccctggccctgggcgcctccccgagtctagcgagcctggtgtcctgggagccccgggggccgggctgctgggacctggtgctgtgtgggctgccctagaggccctggtggccgtcccccgtgtggccctgccgagaggggcgtgcgcagctccccggcgcctgcactgcgcgccttgcccgcctggcccggcagcaggggtttcatgctgcgctcacagctgtgcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagaagggctgcgcaccagttcgccggcgcccgtggtcctgtgcgcccttaccagcctgggcaagtgggggagcggggctgccagagggggccgggggtggaagtctctcgggggcttccctcccgtgctcgtggaacccgcgccccggccttcccagtcccgggcctcccgcgattgctcgcccgacgtttgctgcagcgggcccaaagccgagattcagcctccgggaatctgccggccgagccgggggttaacgccgccaaacccgacccaggtctgcactttcccg

SEQ ID NO: 596138 - DNA, 651 bp, Homo sapiens
caaattattgagtatctcctaagcaaagggtactgtgtttagtgctaaggttgatactaagcagaattaaagatgtgaaatttaatgaataccctgttttaagagctttgctaaagatgtgtatggaatgttctgaatgaaacagacttagtaagacatgagtgttgaaaagttttctcagttaatttagcagcactcaggactgctttgtccatgcagatacggctgacttactggggacttttgtttctaacattagccaagcttactgtcaactctgaagagatgttggagttgtcctagaacacttaaacttggaagttaaattgtcttccaatgtgtttggcagagttataaaagtagacatgagccatattgatagaggcacggcatatgaagagcttcagaatacttatgacacttctttgacgttctgtgaaaggctatagataagtacctccaaacatcatgcctccagcctcactcttgcttaaggaaatactctgaaagtagattttctttcttttttgagacggtctctctgtctcccaggctggagtgcagtggcatgatcttggctcactgacacctccaactcctgggtttaaacaattcttgtgcctcagcctcctgagtagctgggattacagg

SEQ ID NO: 596139 - DNA, 697 bp, Homo sapiens
ttttaataagcggggcttgccttgtggtgtcggcaagctttatgagcgtcatgaggaaaatctgcatttgccaggttattgtctgcggaacgggtcttgctccaaaggggcttcagcagtccttggcctgatatggtcttggaacttgcttccttttccatccatggtaagcagcacctaccctacctgccccacttgtccttagcctggtcatttgacattagtatctcgaccttctcaccagctcccaggaccataggctcaggcaggggcctccatgggccccagcggaacactggggacttggcctctctctagggtacatggttctggttcaggctgggagaggcagcccagcaagtctcatgtggggagcagtcagacagcatctgggccttggcctggagcgcaaagacgttggctttctctttctctcaggtgaaaggtcattaaggcagcaaaacaagtttggatcctggtcacttaggaagcttcagattcctttgcatgcaggaagggagtggtttgcaggtggccaagttcttctattttggctcacactcgacatgaaaattgagaattttacactttccctaccctctagacaaataagatcttttttgtcagtttgtttgtatgtaactaaagcctttaggtgttatagctcctgcttaaacaatgattactacttcaagga

SEQ ID NO: 596140 - DNA, 193 bp, Homo sapiens
acacagggtgtcaccatgttggccaggctggtctcgagcgcctgacctcagatgatccgcccacctcagcttcccaaagttctgcgattacaggtgtgagccgccacacctggccctttgtgactatcctttttacttagcatactgttttcaaggtccatccatgttgttgcaaaagataagatttcattaa

SEQ ID NO: 596141 - DNA, 1009 bp, Homo sapiens
gaagggtctggccacgtgtgtgaaatggtcagacagatgtatgatggcatgaccttcctcaaccagaatgcttagagatcgagctggctgcggagaagccagttaaacgtccatcatcaccagtggaggagctaccagagatagagcgttggaagatctggatacctgtatgactctctgctgtacaagtatgaccctaaatccaaaaggaaagagtatccatagccgaatgctgcggcctgttattctagggcttatgaaactggagctctcgatcctagataaagcgcatggcaagaggtaccaaattcacatcgaaggagcaagaactacccatccgctccagacaggagaagcggaaacacgggattaatcaatatgaagatagacactcaacaaagaagggaagaaagctggaacaccaaaaaccaacgtaacaagccgaaccaaggacagaaacaagaaagacaacaccagccccacgacaatccggcccgtgcattgcacacaacctatccaaccagatagggtaaccagacatggtagcaatacgagagagaggacggcacgaggaccacactcaccgaagcacaacaacaacgcggaacaacacgcccaaccaagcaaccgccaacaccaacagccccgacacacacgaccccagaagcacacgaacacacacacaaaaatgaaagcaaacggaaaacaatgcgatgactacaagaaaagcaaatacagcgcgaaaagcacagaccacacaaggatgccgaaggaacgacaacacaaccacagagggaacgaagcacacggccgaccacaacaacgacgagcggcgacaagaaaaggaggacgaggacaaacacgaccgcaccatgcacagccaacagagaacgacaagacacagacccgacgagagcctcgcgcccgcgacacaaaacgaagaaacgatgagtgcaaaacgcagagcgtgacgaggacagagcagtcgcgaacacacgactacgtgaaa

SEQ ID NO: 596142 - DNA, 1464 bp, Homo sapiens
taaacctttccttataagcatgccggtgtggggttgacagggagggtaataatagacttgtgggtggatgtgtaaaatatgtgggcgtgtttaattgtgtcagttctcaggtgttttataactctcgacccaggctttatgcggagcgaaaagtgtttcacagtgtttcacttattactaaccattagtttcttcataataggggtagataagatagggtcccaactgtgggtgtgttgagagaagggcgcctccgcgaaagaagaactcttaagatagtgtgtgtggtgcgcccgtgcggaggaattaaaccccaacacccgccgaggtcgaagaggagtcctcgagggtttccctcaagacttttgcccagagggaagaacactccactcatcccgtgtggacacagtgtacagcggggcgaaccccaggtccaagagaaaacctacggggcgtgggcccacgcgggccactcacatgaagagaggcaccacagaccgccgcgggggggcacatatcccccacgcgcaacaggtgttgttcaccgttccagtgtcgcccagcgtgtgtcccacccagtgtccacccgcgcgcggggacaaccatgtggtgtgacccccgtgtgtgtccaccacagtgatatcctcccccgagactccagaagagaccagagacaccgttgtctcgcggggcatctttggccagcccctgtcgaacacggggggggacacccccagaaggttcgcctgttcgaccaaaggcgccataaaaaccgcctagagaggggcagcttttctcgcctaacatggaccttacctttcaaggggcccccccacccacaaaagccacaacagccgtagaagcccccgcgtccacgcgtggggttccaaaggccccccaagtgcaaagagacccggcctttggtgtgaagcccacccaccggccggggaaaccccgccctcacacaacaggcggcccgctcggcctcccaacaagaaagcctccctcgggccagagggcgacgcgcagctccccgccaaaaaagggcctaggctggggccccacaagagccgagacgctcaccactacacacgggcgcagcaccccgctccacaagaggaaccccccctcacaaaaaaacacgcgcacgcaaaactttgtggggggcccccgtaaaataccgacccccctaaaggagcaagccatcttttcggatcctccgcacatttcccggccacccctctgtcaggcacgggggtggagagactgtgtatcgggcttaccccacagaaaccctcccacgaagggtcctagtcaacagacccccatgtgcgggcccacccaaaaagtggagacccaccgtggtgcgggaacaccacatacagccctctcaccgccccggcgtatcaactacctctctccctctctcctctccctcatcaatccacctctccatcgagggtg

SEQ ID NO: 596143 - DNA, 118 bp, Homo sapiens
ccgcatgtttgcatggcagaagcgtctcccttggccccggcctgggagggtggttcctgttctcagcatcccctaatattcagtcctgtatattttaataaaataaacttgccaaagg

SEQ ID NO: 596144 - DNA, 116 bp, Homo sapiens
atcatgtagtctggactttgagcagtgtgaccgctaccagctgcaagctgctggcacatgatgggcctcatgaagggccgtgccaaccctcacacgtgcttagtggaggatgtcaa

SEQ ID NO: 596145 - DNA, 122 bp, Homo sapiens
tcggataatcatccaatagttggatgatctggaggaagtagtggacttccaggtcgccctggtttccctgggtcatcatggcggtgcgtcagggatggccgcgctgggctataaagacgatg

SEQ ID NO: 596146 - DNA, 258 bp, Homo sapiens
ccagcaggctatatggatatcagcgctgggccaggcgatcttcgggacagaacctgttcggcgatgcggtttgcctcggcattgagcaccggtttgagcattctgctggatgtatctggtctctcgccggttgtggaatgatccgcaaaaaagcctggtcagcaccttgctctacatgagtttcgtcagcgtggctgcgctgggcggatatgccaacctggacccgcagttcactttttgggtgcagggacccactcg

SEQ ID NO: 596147 - DNA, 339 bp, Homo sapiens
  misc_feature (7)..(7): n is a, c, g, or t
  misc_feature (200)..(200): n is a, c, g, or t
  misc_feature (205)..(207): n is a, c, g, or t
  misc_feature (244)..(244): n is a, c, g, or t
tctgaangctgacacataatggactagaccctgctgtgtccaagatggtttgctattaccagcaatgccacttctgggtatctgttcaaaagaattgaaagcaggatctcaaggagctacttgtgtatccatgttcctggcagcactattcacaatatctaagaggtagaaacaaccgaaatatccattggcagatgagnggatnnncaatatatagtatatatgttcaatgaaatgttattcnaccttaaaaaaagtaaatcctgcaatgtgtgacaacatagatgaaccttgaggacattaaaataagtgaaataaaacaatcacagaatgacgaaa

SEQ ID NO: 596148 - DNA, 714 bp, Homo sapiens
gcggccgcgccagcgcgcgctccagcagcgccgacttcccgcgcgtgaagcgcgcctccatgccgccgccacccaggaaccgcagcaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaaatgttaatacgccatgatttttgaagaccaattttagttcaggaggtggttttaaatattggatgaaaacttacaggctgttttcaatattcatttctgaaatactttagtatgatagataaatttggttaagttcttgttcattgtgaaatactgttggaagaatttttttcaaaataaagacttctgaatttgtggtaccaaaaaaaaaaaaacaaaagcaagcaacaaaacttgtttcgggcgcccctgggagccctggagaaaagttctacaacaccatttcggggggcccggggggcccatcggttagttgaacgggggccaacgcggttaccaagagaaaacggggcataaacacgtcgcgggtttcccccaattaaaagcccgggcgaccgccgttctgaacaaccagggactccgggccacggcttcaacgggggccagggaccaatataa

SEQ ID NO: 596149 - DNA, 121 bp, Homo sapiens
cctatctcagaactcagtaacttcagatatcaaacatttattatcatagtatttctgtgtatccagaacccagatgtggctttgttgggtgcctctgtctctaagtctctcacgagttagg

SEQ ID NO: 596150 - DNA, 829 bp, Homo sapiens
gcgagatactggaggggcccatgcacgctcgggatggctggctggcatctggggttccagtggaccctctcgcttggctctggcagtgtggctggatactggcctgcctccgcttaccagagttcccccagcctcctccctgctgtgtggctgcctgcgaggagatggggtggggtgcacttacatttgtcgtctttccagcccctggtgcatctgattaaccagtttcttccatggccaagctgttgggggtgaggtgcagcccgaagcagccagaccagcccctgagcctcccgggtgctggcagctgtcatggggctaccctgggggcagtctcacctagggctgcagatgctcctcctggtcgttgatactgtctccggcccagtcctgagcctggagctggtgccctacacaccacagataacacgcattgggacctgtgaaggggaaggtcacagccaccagccttctcccatggagcagccgagctgtgatcttcgatgggcttgaccagcgcctagcggataccgtctggctcgtggtggccttcaacaatgcctccagggggcttccagaacccggagacactggcttgacattccgtgctccccacagaatgctgaccgatggccactacatgacagctgcccctgtctccggaccagtctgctcctgtggcgaccccatggctgggcagctggaggctgcccccgtgctgcgggtgggcccatgaacacggctgtcaccagcagtccttcttgcaacgcgcccatcctggcctggaccctatcgggtgaagttcctcctgatggacaccagggtcacc

SEQ ID NO: 596151 - DNA, 3106 bp, Homo sapiens
  misc_feature (116)..(116): n is a, c, g, or t
  misc_feature (212)..(212): n is a, c, g, or t
  misc_feature (289)..(289): n is a, c, g, or t
  misc_feature (567)..(567): n is a, c, g, or t
  misc_feature (594)..(594): n is a, c, g, or t
  misc_feature (610)..(610): n is a, c, g, or t
agcggtacagtttattcttggtttttttttttaactttagaagtaaattaatatggtaactagtggagcgtgctttagattgaagactcatctgaagtatcacagactcctatttngtaaagcattccacctttattgatacagttggtggcctatacacttttaaaatttattttttaaaaggtgatattaaaattggtatttaacctgtngtattcatcctcattagttaagtttttctttttatgttttaaaacttagtgacattaaacttttcacgtggttgttngtgaacagatgaatatataaccacgatgtaatccagtgttgtgctgctgaatgtttaacaaccatctttcatgaaagaaaaaaggccctgtttggtagcatttactaatatttatggtataaatactgtcttcatggtgattttacctgccaatctgatgtcattaaatgcagttggatgaaagagatagccaaccagtggctttcccaagccttggcaaaccagcttcagcacagcaaaggacatacaattccacaactcattaattaaatgtattngtcatttgatgattatatccagtattnggagagcttttatatngttaattcatttagcaagcatttgaacactgtgtttattttgtagagatatactgggcactgaggtatttaatctgcaaagacccaagtatcgtgaaccttggttttaaaaagtccaattatgtgctcttataggggttgcacattcaaggcttacactgaattctgtctgcagttctgtttgtgtgaccagcacagtgttttaaaacgttgcattctgaatccatctttttgaaatggggcatgtactcttaaggtggccactagcttaccattcccaatttttcttagtctcaaacattcacatgtttttcaaggccttggagttggcaaatcctgaatatatagtgaaggtaggaaatagctcttcttatgccacatcttagtctgattttgaagtcagttgtgtaagtttgggctgacagtggtattttccagtgaagactatcgccaagaatgcatatcattctgcttattttattctagtggataaaaattcaacgtatatttaagtgtatttttgacatctgtgcttgtccaacacagggctgtagggactgatgaaaagagaatgttgtgatttgagcttttataaaaaaagataagtgatcctagataaaatattttagatggtgattaaaatgcccatagattaattttttaatcggttctctgaaatcttgagatgttatccaagttacaatttaagcaatgagagtaaaatttgaattctaaattctcagcatcttccctcattcttgagtggagagacagaggaagcaaacgccaaggagccttctaattttgactatatgatcattaactaaaggcagcaagggattgtaaactaatcttacatagtcaatgtttcatagaatgctttggttacaatcaggttttttaaagactttaaaggtttttttgtatgctataatatatgcttatgatttctaaaaattatgcagtatacacaaagggcataaagtcaaaaagtgtgtctccctctgtgactttattctcataccccagaggtatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttgggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatcttgtgcttccatttaagaaattcttccatttaaagaagaaaaaaaatctctctaattgactatctgaagatatatgaaaaagcctatgcttttaaattaaactgttaagacagtccattgaaagattgtggaagttcacatctattttgcaccttaattttttcattgtccctactcatgactctaaaaagtgcatggcttggggctatactttgttttgcagtttgttggtatcgtgcctttccttatctacattagcttagactataccttatttttaagaagagaaagtggaaattaactgtggcaaaacctattttggcacaaccacatttgttcattatacaaaattagcttcctatgctttagaaaaaatgtgagttattactctgaaagttgtgattctgattcctcatggtttggagctcagaaatttcttaacatgtctttgctgttagtcaagcacaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaaatgttaatacgccatgatttttgaagaccaattttagttcaggaggtggttttaaatattggatgaaaacttacaggctgttttcaatattcatttctgaaatactttagtatgatagataaatttggttaagttcttgttcattgtgaaatactgttggaagaatttttttcaaaataaagacttctgaatttgtggtaccaaaaaaaaaaaaacaaaagcaagcaacaaaacttgtttcgggcgcccctgggagccctggagaaaagttctacaacaccatttcggggggcccggggggcccatcggttagttgaacgggggccaacgcggttaccaagagaaaacggggcataaacacgtcgcgggtttcccccaattaaaagcccgggcgaccgccgttctgaacaaccagggactccgggccacggcttcaacgggggccagggaccaatataa

SEQ ID NO: 596152 - DNA, 124 bp, Homo sapiens
  misc_feature (8)..(8): n is a, c, g, or t
  misc_feature (38)..(38): n is a, c, g, or t
  misc_feature (77)..(77): n is a, c, g, or t
tacactgngaaaatgtacaaagaaagtatccccaaatnatttacaaagcctaaatgtccttgatacacatacacggnagtatgcagacaacaaagattaaatgaagacactttacacttttcgg

SEQ ID NO: 596153 - DNA, 2790 bp, Homo sapiens
  misc_feature (251)..(251): n is a, c, g, or t
  misc_feature (278)..(278): n is a, c, g, or t
  misc_feature (294)..(294): n is a, c, g, or t
tgagccggtcccatgtgatagtgttaaaaaataatgggtaaaatgctacaagaaaaggccctgtttggtagcatttactaatatttatggtataaatactgtcttcatggtgattttacctgccaatctgatgtcattaaatgcagttggatgaaagagatagccaaccagtggctttcccaagccttggcaaaccagcttcagcacagcaaaggacatacaattccacaactcattaattaaatgtattngtcatttgatgattatatccagtattnggagagcttttatatngttaattcatttagcaagcatttgaacactgtgtttattttgtagagatatactgggcactgaggtatttaatctgcaaagacccaagtatcgtgaaccttggttttaaaaagtccaattatgtgctcttataggggttgcacattcaaggcttacactgaattctgtctgcagttctgtttgtgtgaccagcacagtgttttaaaacgttgcattctgaatccatctttttgaaatggggcatgtactcttaaggtggccactagcttaccattcccaatttttcttagtctcaaacattcacatgtttttcaaggccttggagttggcaaatcctgaatatatagtgaaggtaggaaatagctcttcttatgccacatcttagtctgattttgaagtcagttgtgtaagtttgggctgacagtggtattttccagtgaagactatcgccaagaatgcatatcattctgcttattttattctagtggataaaaattcaacgtatatttaagtgtatttttgacatctgtgcttgtccaacacagggctgtagggactgatgaaaagagaatgttgtgatttgagcttttataaaaaaagataagtgatcctagataaaatattttagatggtgattaaaatgcccatagattaattttttaatcggttctctgaaatcttgagatgttatccaagttacaatttaagcaatgagagtaaaatttgaattctaaattctcagcatcttccctcattcttgagtggagagacagaggaagcaaacgccaaggagccttctaattttgactatatgatcattaactaaaggcagcaagggattgtaaactaatcttacatagtcaatgtttcatagaatgctttggttacaatcaggttttttaaagactttaaaggtttttttgtatgctataatatatgcttatgatttctaaaaattatgcagtatacacaaagggcataaagtcaaaaagtgtgtctccctctgtgactttattctcataccccagaggtatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttgggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatcttgtgcttccatttaagaaattcttccatttaaagaagaaaaaaaatctctctaattgactatctgaagatatatgaaaaagcctatgcttttaaattaaactgttaagacagtccattgaaagattgtggaagttcacatctattttgcaccttaattttttcattgtccctactcatgactctaaaaagtgcatggcttggggctatactttgttttgcagtttgttggtatcgtgcctttccttatctacattagcttagactataccttatttttaagaagagaaagtggaaattaactgtggcaaaacctattttggcacaaccacatttgttcattatacaaaattagcttcctatgctttagaaaaaatgtgagttattactctgaaagttgtgattctgattcctcatggtttggagctcagaaatttcttaacatgtctttgctgttagtcaagcacaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaaatgttaatacgccatgatttttgaagaccaattttagttcaggaggtggttttaaatattggatgaaaacttacaggctgttttcaatattcatttctgaaatactttagtatgatagataaatttggttaagttcttgttcattgtgaaatactgttggaagaatttttttcaaaataaagacttctgaatttgtggtaccaaaaaaaaaaaaacaaaagcaagcaacaaaacttgtttcgggcgcccctgggagccctggagaaaagttctacaacaccatttcggggggcccggggggcccatcggttagttgaacgggggccaacgcggttaccaagagaaaacggggcataaacacgtcgcgggtttcccccaattaaaagcccgggcgaccgccgttctgaacaaccagggactccgggccacggcttcaacgggggccagggaccaatataa

SEQ ID NO: 596154 - DNA, 162 bp, Homo sapiens
gccccccccccttttttaaaggggggcccccccccggggggtccggggggggttgccccgccttttttttccccctggccggggggggggggggtgttttttgaattttaggcccccccccccttcgggccccctccccatttacccctttttttgggggga

SEQ ID NO: 596155 - DNA, 3052 bp, Homo sapiens
  misc_feature (116)..(116): n is a, c, g, or t
  misc_feature (212)..(212): n is a, c, g, or t
  misc_feature (289)..(289): n is a, c, g, or t
  misc_feature (567)..(567): n is a, c, g, or t
  misc_feature (594)..(594): n is a, c, g, or t
  misc_feature (610)..(610): n is a, c, g, or t
agcggtacagtttattcttggtttttttttttaactttagaagtaaattaatatggtaactagtggagcgtgctttagattgaagactcatctgaagtatcacagactcctatttngtaaagcattccacctttattgatacagttggtggcctatacacttttaaaatttattttttaaaaggtgatattaaaattggtatttaacctgtngtattcatcctcattagttaagtttttctttttatgttttaaaacttagtgacattaaacttttcacgtggttgttngtgaacagatgaatatataaccacgatgtaatccagtgttgtgctgctgaatgtttaacaaccatctttcatgaaagaaaaaaggccctgtttggtagcatttactaatatttatggtataaatactgtcttcatggtgattttacctgccaatctgatgtcattaaatgcagttggatgaaagagatagccaaccagtggctttcccaagccttggcaaaccagcttcagcacagcaaaggacatacaattccacaactcattaattaaatgtattngtcatttgatgattatatccagtattnggagagcttttatatngttaattcatttagcaagcatttgaacactgtgtttattttgtagagatatactgggcactgaggtatttaatctgcaaagacccaagtatcgtgaaccttggttttaaaaagtccaattatgtgctcttataggggttgcacattcaaggcttacactgaattctgtctgcagttctgtttgtgtgaccagcacagtgttttaaaacgttgcattctgaatccatctttttgaaatggggcatgtactcttaaggtggccactagcttaccattcccaatttttcttagtctcaaacattcacatgtttttcaaggccttggagttggcaaatcctgaatatatagtgaaggtaggaaatagctcttcttatgccacatcttagtctgattttgaagtcagttgtgtaagtttgggctgacagtggtattttccagtgaagactatcgccaagaatgcatatcattctgcttattttattctagtggataaaaattcaacgtatatttaagtgtatttttgacatctgtgcttgtccaacacagggctgtagggactgatgaaaagagaatgttgtgatttgagcttttataaaaaaagataagtgatcctagataaaatattttagatggtgattaaaatgcccatagattaattttttaatcggttctctgaaatcttgagatgttatccaagttacaatttaagcaatgagagtaaaatttgaattctaaattctcagcatcttccctcattcttgagtggagagacagaggaagcaaacgccaaggagccttctaattttgactatatgatcattaactaaaggcagcaagggattgtaaactaatcttacatagtcaatgtttcatagaatgctttggttacaatcaggttttttaaagactttaaaggtttttttgtatgctataatatatgcttatgatttctaaaaattatgcagtatacacaaagggcataaagtcacttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttgggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatcttgtgcttccatttaagaaattcttccatttaaagaagaaaaaaaatctctctaattgactatctgaagatatatgaaaaagcctatgcttttaaattaaactgttaagacagtccattgaaagattgtggaagttcacatctattttgcaccttaattttttcattgtccctactcatgactctaaaaagtgcatggcttggggctatactttgttttgcagtttgttggtatcgtgcctttccttatctacattagcttagactataccttatttttaagaagagaaagtggaaattaactgtggcaaaacctattttggcacaaccacatttgttcattatacaaaattagcttcctatgctttagaaaaaatgtgagttattactctgaaagttgtgattctgattcctcatggtttggagctcagaaatttcttaacatgtctttgctgttagtcaagcacaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaaatgttaatacgccatgatttttgaagaccaattttagttcaggaggtggttttaaatattggatgaaaacttacaggctgttttcaatattcatttctgaaatactttagtatgatagataaatttggttaagttcttgttcattgtgaaatactgttggaagaatttttttcaaaataaagacttctgaatttgtggtaccaaaaaaaaaaaaacaaaagcaagcaacaaaacttgtttcgggcgcccctgggagccctggagaaaagttctacaacaccatttcggggggcccggggggcccatcggttagttgaacgggggccaacgcggttaccaagagaaaacggggcataaacacgtcgcgggtttcccccaattaaaagcccgggcgaccgccgttctgaacaaccagggactccgggccacggcttcaacgggggccagggaccaatataa

SEQ ID NO: 596156 - DNA, 2740 bp, Homo sapiens
  misc_feature (116)..(116): n is a, c, g, or t
  misc_feature (212)..(212): n is a, c, g, or t
  misc_feature (289)..(289): n is a, c, g, or t
  misc_feature (567)..(567): n is a, c, g, or t
  misc_feature (594)..(594): n is a, c, g, or t
  misc_feature (610)..(610): n is a, c, g, or t
  misc_feature (2666)..(2666): n is a, c, g, or t
  misc_feature (2679)..(2679): n is a, c, g, or t
  misc_feature (2698)..(2698): n is a, c, g, or t
agcggtacagtttattcttggtttttttttttaactttagaagtaaattaatatggtaactagtggagcgtgctttagattgaagactcatctgaagtatcacagactcctatttngtaaagcattccacctttattgatacagttggtggcctatacacttttaaaatttattttttaaaaggtgatattaaaattggtatttaacctgtngtattcatcctcattagttaagtttttctttttatgttttaaaacttagtgacattaaacttttcacgtggttgttngtgaacagatgaatatataaccacgatgtaatccagtgttgtgctgctgaatgtttaacaaccatctttcatgaaagaaaaaaggccctgtttggtagcatttactaatatttatggtataaatactgtcttcatggtgattttacctgccaatctgatgtcattaaatgcagttggatgaaagagatagccaaccagtggctttcccaagccttggcaaaccagcttcagcacagcaaaggacatacaattccacaactcattaattaaatgtattngtcatttgatgattatatccagtattnggagagcttttatatngttaattcatttagcaagcatttgaacactgtgtttattttgtagagatatactgggcactgaggtatttaatctgcaaagacccaagtatcgtgaaccttggttttaaaaagtccaattatgtgctcttataggggttgcacattcaaggcttacactgaattctgtctgcagttctgtttgtgtgaccagcacagtgttttaaaacgttgcattctgaatccatctttttgaaatggggcatgtactcttaaggtggccactagcttaccattcccaatttttcttagtctcaaacattcacatgtttttcaaggccttggagttggcaaatcctgaatatatagtgaaggtaggaaatagctcttcttatgccacatcttagtctgattttgaagtcagttgtgtaagtttgggctgacagtggtattttccagtgaagactatcgccaagaatgcatatcattctgcttattttattctagtggataaaaattcaacgtatatttaagtgtatttttgacatctgtgcttgtccaacacagggctgtagggactgatgaaaagagaatgttgtgatttgagcttttataaaaaaagataagtgatcctagataaaatattttagatggtgattaaaatgcccatagattaattttttaatcggttctctgaaatcttgagatgttatccaagttacaatttaagcaatgagagtaaaatttgaattctaaattctcagcatcttccctcattcttgagtggagagacagaggaagcaaacgccaaggagccttctaattttgactatatgatcattaactaaaggcagcaagggattgtaaactaatcttacatagtcaatgtttcatagaatgctttggttacaatcaggttttttaaagactttaaaggtttttttgtatgctataatatatgcttatgatttctaaaaattatgcagtatacacaaagggcataaagtcaaaaagtgtgtctccctctgtgactttattctcataccccagaggtatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttgggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatcttgtgcttccatttaagaaattcttccatttaaagaagaaaaaaaatctctctaattgactatctgaagatatatgaaaaagcctatgcttttaaattaaactgttaagacagtccattgaaagattgtggaagttcacatctattttgcaccttaattttttcattgtccctactcatgactctaaaaagtgcatggcttggggctatactttgttttgcagtttgttggtatcgtgcctttccttatctacattagcttagactataccttatttttaagaagagaaagtggaaattaactgtggcaaaacctattttggcacaaccacatttgttcattatacaaaattagcttcctatgctttagaaaaaatgtgagttattactctgaaagttgtgattctgattcctcatggtttggagctcagaaatttcttaacatgtctttgctgttagtcaagcacaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaatgtatccccagatttgagncattagttagagnggttaatatggtgaactangctgtcatatcatttgaacttagatgtgttgtaagctgctgg

SEQ ID NO: 596157 - DNA, 493 bp, Homo sapiens
taaacaaatccaaatataacatttctcatatcaggttgtaagaagtactttaataacagtaactcattatagacctggtaaacacgaatcttatgtcgtaactgttccctgggtctatcttgacccgaagagaaccatgatggcctaggtagagttgcctactgatcacccaataagagaaggagtcaaatttgaacccaagaaggctgatctccatattatacagtctaacacttcttctgcatccactctctaaataagataatacatgtatgtccttgattagagtctcttttttttcattttgacactttcaaaattgagatgtatcttacggaagctcgagatcatacgaagaagatacttactgtcttgctccctataaagctattattaaatcgcatggtatatcttaaaattattaggtgtccttgaataaaggaactatgataagccatgtgtatattgaacacatatagctccatagtaatag

SEQ ID NO: 596158 - DNA, 335 bp, Homo sapiens
ccccagactccccctttccatccttagtcacctgcggtgttcttcgtcatcattagtcacctgctgtgtcttagtcatccttagtcacctgctctgtaaccatccttcccaccaaaactactcaccccgcctctctggctcatacccctgctctctttaaaatagccagttggaattagcttagactgtgcagtccaaccccagccaataggggaaagacacagcagtagggactagctgcattaggaataagaaccccttcccctcccttgtccagtgtgctcttgccattgctccatccgtgagatgaacccttctgtggatggaaaggggat

SEQ ID NO: 596159 - DNA, 780 bp, Homo sapiens
aagaagagagaggacacaaaatactaatatcaaatgaaagagggaacatcactacagagatgtcccacagacttttaaagggtaataaaaacaaaaaagatgaacaactctggcgcccaaatttgatacctgaaccaattccttgacagtacacaatctcccaaaacacgggacgaaatagcacaatctgaatacgggctatgtctgtaaaaatacagtcaattcaccaattaccttccaaaatagaatccatcgggctcagcatgggttcacttcatgacttctaccaaacatttaaggaacagaaattataccaggctctctataatctcttccagcacacctaaccaacacagcagggacatccttcctaactcactcatgaggtcagtgtcatccaccccaaatgccaaaaaccaaacagacactttcccacgccaacaaacggaaactaccgaacagacacctcttcatgacaccatagacagtggcaagaattccccaacaacaattcattgacgcacaattcaatattcccaccaagtgtcctacaccaaggaactctaatcttacccactgaccagagtggggaattgggtccccagtgttacacagggcgtggtcccaaccttcacccgaacatcacatcacatcgttagtgtccactgctaccacaatcacccacgcggccgccacacccctgtggcctacaaatacatcgagcacaagcttggaccaaatccaacctgatcccgcactcccattaccaaccaacactag

SEQ ID NO: 596160 - DNA, 532 bp, Homo sapiens
gtgatatttttgcaagccaggccagcgctgcatggcctggcccagctcctcgtggagaaaacttccggcccatctccatccaccggggcatggcccaggaggagcgcctgtcacgctatcaccagttcaaggatttccaacggcggattctggtggccaccaatctgtttggccgggggatggacatcgagcgagtcaacatcgtctttaattacgacatgcctgaggactcggacccctacctgcaccgggtgggccgggcgggttgctttggccccaaaggcctaaccatcccttttgtgtttgacgagaatgatgccaaaatcctcaatgacgtccagggccggttttaagttaatgtggcagaacttccaaaggaaattgacatttccccatacatcgagcagagccggtaacccccccgtgccaaaaccgcccccccggaaccgcccgcatgcaggtttccctcccctttccaggggcccctgtttaaaagctaaagattgtattagaataaacttgtttttatgga

SEQ ID NO: 596161 - DNA, 467 bp, Homo sapiens
cagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatttcttacccattttatgttccaaattggtttttggtccaaaccatttatcaagattttacctgcctttataattttgaaaaaggggtttaaaaatttccccctgcggtttttttaaaggttaagcttcatttctatgagcaaagagctcatttagcaatgtagttatttcagtatttatttctattatggaatccctggggttcagaatgtaactttgtacatgagatatatataaatatgtatatggacatgaa

SEQ ID NO: 596162 - DNA, 657 bp, Homo sapiens
ctagatctgcagcttgccacatcagcttaaaatctgtcatcccagtgcacggacaggaaaacaatatgtataacagaccacttcctgagtagaagagtttctttgtgaaaaggtcaaggattaagactaaaagttattgttaccatatgtattcatctgtaggatcttgtagaacatgagaagggctttattttcaaaaattgaatcttcaaaataagtgtataaaatgcaactgttgatttccgtcaagatggctcacaaatttctatcccaaatcgttttctgaagatgaagagtttagttttaaaactgcgactgccaacgaagttcacttgcatatataaagcgattattttgtactcttgtgaggtgaatataatttatattacaagtggaagaagcttcgtttaatactaagtatttgttcaggtcttcaccgaagtatcaaagtaataacacaagatgaatgtgtcgttatgtcaaaatagtccagatgactcctcacagtctgttatcttattataaagaactatttgtagtaactatcagaatctacatttctaaaagagaaatgtatttttgctatgccaattaacatcttttagagttgatgagaatcaagtatggcaccagtagggcatactcttactgatacct

SEQ ID NO: 596163 - DNA, 506 bp, Homo sapiens
catacagtgtaatgtcatagcctgatatcacattcataagaatatatatacagaggggtcatctagaggggtcaaggaagaatgtgcctaatcaattattggctccagcgaagagagatgggagcatttcccctcttgccattatcctccattggccgccttactccatagactgttaatcccttcacacttctatgatgtgtatgcatcgtgaagggaagatttgcatgtatatgtggggttgcagaacgaaagaaaagacccagtgaggtgaagtgctatgaagtgaggtaagatgagatactgaagttatacctttgtgaagtttgttgccacagcaatgtctgggtgaaaaggtatgcctacagcatgtcaggtgaggctcaatatattcccaatgcaacatttatttgaagtcaaaaaagaaacaacaaataaagggaagcaaaaagaatgcaatagcaaaaagagcggaaaataatgacataaaaacatgcaacagaaag

SEQ ID NO: 596164 - DNA, 442 bp, Homo sapiens
gacttgaggatcccgactagtccaaacatacagaggctgaagtgggaggattgttgaacccaggaggaaggttgcagtgagcatgatcatgccactgcactccagcctgagtgacagagcgagacgctatctcaaacgcccgcaaaaaacagatacaggtggatgattggatgggtcagtgatggatgaatggttggatgggtggaaggatggatacagggtgggtggattgttggatagatggtgggataaatattcgggtggtgtatggttggatggatggtaggatggtggatggtggataattggttggatggatagtaggatggatggatgttggatggatggattgaacagtgtggtggtagatgggtagataaatggttggatggacaggaaggatggtgagtggtaggatggatggattgatggatggaatgga

SEQ ID NO: 596165 - DNA, 707 bp, Homo sapiens
gccgggcgcggtggcgcgtgcctgtagtcccagctactcgggaggctgaggctcaagggatcctcccgcctcagcctcctgataagctggaaccacaggcgtgcaccaccgtgtccggctgatttgttgtgttttttttttatttggtagagacaaggtctcactaggttgcccagacagggtctcactatgttgcccatcctgagctcaagcaaccctccgacctcagcttcccagagtgctggggttctaggcgtgaactaccgcacccagcctgctatcaccttctaaaaatcctctcaaccaggtggaacaatgtggttaagaagagactttaattcgtgagaaacttctcagggtaaaaggcaggcatttgccatcagaaccacttttgacaaatggcacgaaacaactgtgtgtgtgtatatgtgcgtgtattccaattgtggtgcatacatgggaaccttctcatttgcctgagagatgcagtgcttattttaatagcagctgtcaaaattgagaggggattttcaatgaaatgcatttaaacatatttcaatcggaacttcagagcatggagtgtctctctgtcacccaggctggagtgcaagtggtgcagacctctgctcacttgaacccctgcctccccagtgtacaggtgattctccttcctcagcttctgagtggttgagaaccacaaggcaccc

SEQ ID NO: 596166 - DNA, 807 bp, Homo sapiens
  misc_feature (265)..(265): n is a, c, g, or t
tggtgtaagggccccaactgctgcaaacaaagtgtggtgatacccccaaaccatagggtaaaagttgggattagggggctatttcctgctagggggtgaacgcggatgattaaaaagattcctgctacaaatatattgtgcttaagtggagctatgggcgtgaaacggggttgtggcgccatactatggctagagtgggatctcagggttggatgacctaaatggggcgtgattgtgccttgtatgctagctagagagagaggcnctacgatagttgcagccagaggcggcatgtgccccagtcgcgcccgaaagaggagagcacaggagttcgcatgaatgaaagtgtccgcttggtgttcagcctgtaggaaatatcagaaacgtcgtgaggggtgcacccgtttggtcgcccccgagttatgccacgtatgagattgcttgctcttgtagcgcctattggtgctatttgtgccgttgccgcaattggctatattggagcagcgggtatcctcctggaggcgcggagtgctacacctcgagattctgttgaccctgtgaatatgttgcctcccctcttggctctcagttttccctcctgctggactaaatacacggcagcatttgcgccccgaaatgccggatccccccgtagtaccttgtccccttgttgcaatcactaaacatgccaaaacccgtgtggtgggccctcagcccatgttggtgcgtggagatccaaatgggtactcgcgggaaattccttccgcttggcctcctgtgccccttgatgtggtgtggattagaccc

SEQ ID NO: 596167 - DNA, 122 bp, Homo sapiens
gcggattgaggaaaccgcagatagtttttctctttgaagatagagattatacactacttaaaaatatagtcatagggactaagatattgcttagcgtaagtttttacgcaattttaatagct

SEQ ID NO: 596168 - DNA, 116 bp, Homo sapiens
ttgaacaggcttgtgacttcttacttcccccatcatcactactgtggtctcaggatcatcacctttcaaataggattattgcagtgacctacccattctcgtgcttgagctccttg

SEQ ID NO: 596169 - DNA, 264 bp, Homo sapiens
acctctcgcggcctgccggttagtcctgacactctgatgctggcaaccacttgtttatgccgggtcaggccggctaccgggataactctgcgggttacaactacgatcctgaagctgctaagaagggtctggacgaggccggctggaagaagcagggtggccaccgcgtcaaggatggcaagactctgaccattaattacgctaagttgactggcgtccccacctccgagaacgagggtgcgctgttcaagcaggacatgtcgt

SEQ ID NO: 596170 - DNA, 803 bp, Homo sapiens
gagcgaacaacaggtactcacaagaatggtcgtcagtggcgtgatgtgtccgcgccccagtactcatgtgacagagagaagaaagttctggaggtcaaactggtgggagcttgacaagtggtggatattgatgccggtgacttcagtcctagtggcattatctgcgagcgtttcagagaaggttactacggtgtagtaaaacaagtacatcattggtgaatgaacggggaggcatctcaggggatgtaccatgggtgtgggcattgcatacagtgactcttaaagcgtgactcctttgccctacaagcatctcaagcacgagtcggtccgcaaaagtaccagtgtagagagggacacactctgaaccgcaacctgagaataacgaacctgggtcccgagcctcctccgcggagggaagcatactcctccaagtcgtagctgcagatcctttgtcattatcgctaaatagggaaatgaagctccaagagtaaagagatgaggttgctagatataaaagggggaaaagggcgtgaaaattcaataatatgtcggagtggtcgggtgtgtagagccaagcaataaatgatctttgaagacagaacaaatttgtttgtggggagtgggcggggacaagagggggtggccaggaaggctctattggggaaacaaacgaggcagggtcacagcggaggagaaatatctggagggggtagacatgagactgttgggggtggcctatagagatacaaatggtgctcgtggtgaagatatggcggttgtatacagagaacagggggaataag

SEQ ID NO: 596171 - DNA, 127 bp, Homo sapiens
caggagaccctagagcacagaaactacctgattgtaccccaggactcaccgtggacacaggagggataaccaggatatcacatgaattacaatagacaaggggcagtgtactaatatcctggatgct

SEQ ID NO: 596172 - DNA, 178 bp, Homo sapiens
  misc_feature (77)..(77): n is a, c, g, or t
  misc_feature (82)..(83): n is a, c, g, or t
  misc_feature (122)..(123): n is a, c, g, or t
gcactgttacaacctttaaagaaggagctgtctgcactgaaacttgaacctttttccccaaatctaatggatatagnaaggnnattatatttatattaaataaatgtttgactacctttgannataactttatctcatcttgacctgttcctttgaaaagatataatactgatatgtg

SEQ ID NO: 596173 - DNA, 1078 bp, Homo sapiens
gtaaatcttcaaagcggcggaagactcgatgggcgttactatttatagacgtacaagcgtgtgtccccgatgccgtcgctgggctcctgtacgctgcgccgtctcaatggatgagtatccttcagacggggattacccgtgctaagatcattccctaattagatatccagacatgcggaggttcaccgccaggatcggctgcgtagtaagttgccagcacgtcagcccgcgtgagtggggcgtaatgtcgtgtcgcgtgatgcgcattgttggtctgccgtttgattgccgcggcggtggtgggcacgggacgccacggccatccactgaatcgcagtgctctgttgtccgagtggggcctgcctgtgatctcgctcttcggtcacgtccgactcagcagaccggtgcggtgctggagtagtcgtgtgggtgcggggttccgggcatcactgtaggctgccccttttatgttgacctgggaaggaggagtgctctcgtatggagaaaacgtgcacttctcgttgtgcttagcgggcatgcgtgagtgctcggtcgctgtgcggtgtgaggcggtatggatacctgcttcgtggggatctgcgatgtagcgcactcacggctgctcccctgtcacggtgggtgctggacgtgccattcgggagcgttaccccggagggctgtgcttgtgggctcagagttcgtgccgtttgcgggcttgtggctgagccaatgggggtgctgagcctgcgaatgatagatcacctcccgccgactccctgaggtctgatggccgtagcgtcctacattcgcagtaggctcgggacgacggcatgagtcggtgctcccggtggaccatgagcgtaacgatgtggttgagggcaaatgccaggtcggacgggggttggctcagcaggcgtgcccccgaagaaacaccgcgggtgggaaccgcctcttcgagaacgctggcaactcctatcgatgaccggggggggacataaacaggtgctggacggcacaaccagtccgtcagacggtagacagggaaacaccacgggtgggttcagcccctccctccgag

SEQ ID NO: 596174 - DNA, 176 bp, Homo sapiens
ttctcatgagctcgctagtaagtcaactgagttattcgtgttatacgctactactctagtatgcgatttgaggtaacagttttgtcttgtattaatactagaaccaaatatattgaccaataagcagtctagatttaaattatcttcttgggttggtctgaggttgctgatggatt

SEQ ID NO: 596175 - DNA, 1195 bp, Homo sapiens
  misc_feature (170)..(170): n is a, c, g, or t
  misc_feature (173)..(174): n is a, c, g, or t
  misc_feature (187)..(188): n is a, c, g, or t
  misc_feature (203)..(203): n is a, c, g, or t
  misc_feature (220)..(220): n is a, c, g, or t
  misc_feature (252)..(252): n is a, c, g, or t
ggaggatctactacgacactggggaaggcttactgactgtgtggtaatgagggattctgtcatgccacagatcaagaggatttggttttgtaactttttcatccatggctgatgtttgatgctgccatggttgtaagcatctccttcatttgttgggagagtagttgagncannacgtgctgtagcnngagaggaatctgganaaccaggtgctcatgtnactgtgaagaagctgtttgttggcggaattanagaagatactgaggaacatcaccttagagattactttgaggaatatggaaaaattgataccattgagataattactgataggcagtctggaaagaaaagaggctttggctttgttacttttgatgaccatgatcctgtggactaaaatcgtattgcagaaataccataccatcaatggtcataactgcacgaagcttcacgaacagcgcttcgtctagaccacacgcacaatgcaggaagttcacgagttctaccgaagtggaacgacgcacggccggacctggactactgcgcacaccacggctggtggcgctacccgaagcgtgcgctcatgaccaactatggacggacgcaaacttcatgcgcaacctggcaacttaccactgcatccttgcgtacaactcatacaccagccaaacccttctaaacctaacggctcccaatcgcaccgacgtgaaacacccttgagtttagcgtagccaacggcaactcattgtcacgagcgaaccacactaactgctactgcgcagagcagaaaccctaatgcgtcccccacgcagcacaaccatgccatccacacatataggtagcagccaaaatacaatgacagaacagaagccccgtccttatcctgagaccctacatctaccctaatttccgtccaacggtcgacaattcacccaccgtcatcataaccttcactagactcaaccaaaatcgcagcaaaccccctcaacaacagcgatacaacactaaacacccactccaatcttacagccttacaatccccaaacattcataacaacacttaaaacacaaaaacctccttctaatactaccaactccactattacaacctacaaattcatctacccatcgcaatcactgaccacaccaacataatcagctaacacaacaacaatctcccttccaacacccatat

SEQ ID NO: 596176 - DNA, 498 bp, Homo sapiens
  misc_feature (129)..(129): n is a, c, g, or t
agggaggggggaaggtgaattatggtacttttaatgatctattcaggcagtagagctcttaaggaaaaaaaaaacccagtttctctcaagcagtgtatttaggggttgttctcattggtgctgctgcancacctgtcttatgtagtacttgagaccatctgcaggagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctccttttttttttttcccaagtggatttgaatttggttttttcccccccaattaaaattattgttagtttccagtttgaaggtaaacttccagtgtggagtgattttggtgtctatttataaacttgtaaccaaaattcagacttctggtacggttcttggcttggaaatgggtccctgtgg

SEQ ID NO: 596177 - DNA, 142 bp, Homo sapiens
acttaagactgggatgaaggtgtgaaaacagatgtgaggatatgaagacgatgtgttaaggtgagaatgaggcctgggcatggtggctcacgcctgtaatcccatgtcactgtgtggaggccaaggtcagattgatcatctg

SEQ ID NO: 596178 - DNA, 142 bp, Homo sapiens
acccgaggaccaagcataagtgcggtacttgacgtcgatggagacatgagcagtaaccgcagctcccttacccttgatgagaggctgtacgacgagtttattcggcttggtggccttgccgatggataccgcgagagcacta

SEQ ID NO: 596179 - DNA, 455 bp, Homo sapiens
tgtccctatgccgtcatttccttttcagactagccatacgcctttccgataggagtagttgccgttggaacttgcggatataatctgccataaaaggcttacgagttctttatctccgctcatcacatcattgagccagtcatctacgttccaacccttaatattaggtgcttaggcattagcgttgtacttggtcgcaatcgttgaggtaaagacatacttaggacagaatggctctacattttgcattttcttattaaaaataccgttagcaactgggataagatgaggttctgcggtttgtttcttaacctctgctaaggtttcaagtttaaatataacttctttagcacgtgcttgactataagacggctctagccagtaaatgagccgatgaaagaaattttcgtttgtttcgtatattcctaattcaggtcgacgcggccgcgaattta

SEQ ID NO: 596180 - DNA, 220 bp, Homo sapiens
atctagaggatccttggaggcaggacactggtcccacctccgctcattgacagacactggccccgcctctgttcattgacactgtccctgcctctgctcgttgacagacactaaccccgcctctgctcattgacagacactaactccgcctctgctcattgacagacgctggccccgcctctgctcattgacagacactggtcccgcctccgctcattga

SEQ ID NO: 596181 - DNA, 379 bp, Homo sapiens
agatccccctttccatcctgagcttggcctatacccaggaatgagcaaagatagctttgaggttagaaccaagacagagtcagccatgtcaaacttcttttaccgtcacaattttgccatggcagtttcacaaacatatgcaaatggtcataccagccttattatatcatacaatggactaatgctcagcaataaaaaggaatgaactattgatacaagaaacatgaatgaatctcaagaataattatgctgagtgaaggtagctagacaaaaaaagagtattgtatgattccatttatataaaactctagaatatgtaaacaaatctacagtgacaaaaagatcactggtttcctgacagggatggaaagggggatct

SEQ ID NO: 596182 - DNA, 222 bp, Homo sapiens
aggtgataatcattcataagggtataacataccactggatacattttcaaaaaacaaggtaccagttttatttaaaaagtcaatattatacactatgccagaaaatgaattctgagcaactttaaaatatgatgaataatcttatacgtaaagctttaaaagttaagttttcggcgtgggagcagtgtctcatgccgggtaatcccattcgtaggggtggct

SEQ ID NO: 596183 - DNA, 1780 bp, Homo sapiens
  misc_feature (28)..(28): n is a, c, g, or t
  misc_feature (1158)..(1158): n is a, c, g, or t
ctacgatgggtcgagcggttgggcagcngctactgtgtgtaggtcgttgactggtctttggtcgcccgtctcactcaatggtctgcgtgcttgttcctgctagccattcttctctgtctgagctcctctcggctagttgagttggcttccttgttagcgactctgttagatgccccggctggcggtggtggtctctcgccgccatctccgccctcgagaggtcgctctcctacacttgttgctcctgtcgccgtacctttggttggtcgcacaccaaccgaagttgttccgggtgtgctgatcttgcccccagcgtgtctatggagcttttttatgtccccgccgtggagaatgttgtcactgagcggcgcctctacctctgtggtttctgtttgtcagcgtcacttatgtgtgttatcctgctgttgatgggtgtggtccccgatcatcgacactgtggtggatgcaccctctttgtggatgggaacgagggtgatgcctctcttgttgggggcgagcaccttgtgggggggggttatcctccagtaggactcgacttaccaacgtgggctgcgacgtgttccctcagcgagatcttgttgtctggtgctgcggactctcccccatggttgttttgtggtgtgttcgtcccggtgccgaactgttccccgaggttgccgcccacagtgtgtgcccaagggggttttgccaccccggggggcccccccccgccgtgtggtacacttgtctgagcaccgggagaggtttgcccctaagacgaattgtcttggtccccacacgggtgttgcggcgttgccccaagagtaaacccaatttccgacaggggcacacccccgcgcctacaccatgtggtcataggcgccagggagtccacacattggcgtgtgactatagaaggccgggtccccctgttggtgtgcgattgtttcacgaaaacgtttttccttttctcggggcggcccatacattcacacgatgttgatatgttgcccacgttgtgatgcgtctacgatagggtgtacccccagaccttgattagacgccgaggcatagacagtgttatgtaccatatgtacttggggcgcccccaactcctgtgcccgaagatatacatttggggacacccaccccaatggngcccgcaggggtgtcttggcccgacaacatggccccctgtgttctggaccctgtgagtgacaccacataccgctgcgcaactgtgagaccatcaccacgccattcggtgttggggcccgcggcgttctgataggcacccccccaggcctccccagttcttggagagcaatggcctcgtagcccccccaaaatgattcccaggagcctctgaggtatacccatgaaagagacgaccaccaccaggaacttgtagcatccacctgtcgcccgaggtgaagagacaggggtgttggcgttctcgctttgacccggccgaagggtctcaacccttctgtggccccaccaccaccaccccactacaggcagcaaagaagttgtattccctccatatctacttccgcccattccattccatactgtcccgtcccatacccattccagacaagccatttcatttacagacattttactccaggccatgatggccccataacttgtaatccccgcttattgggaagacgtatgagaatgggcgcgatggccttgaggcccgagagtttgaggccgacccacccgggccaccccgtgagacccccttctccaaacaaaaatactagataaa

SEQ ID NO: 596184 - DNA, 1001 bp, Homo sapiens
ggcctctcctgatcttgtgttcttgctctcttccccggtacaggtatgactttcagcgcacgtcaggactccaacatatcatcactaccgcacgctacctcgggttcctctgagcgctctgtccaggcgtgtcagaatacgtgcgtcccggtcgggtcaacgaagcgtccgcccagcgtgctatgccctgcgcatgggtggcgtctgcgtccccaggaatcatcgcgctggttcctcggctgcggacctagcgttcaagaggggcaggccatgtggggttcgggcggaggcacgtggcccaacacggagaattatgcgggtggtgttggctggaaatggcgcaggtatcacagatagaggatcagatggagcaccatgcgacgaactgtaacagaacgatctggccatcttacctggttccaggagtgaaggggagcctgtggagcaccgggagaagaccgggcaccgcagtggcatgagctgaacacatcacgggccacccatgttagagcagcaaggagagcggaaccccgcaggagtacaagaaggactcggagaatctatgtattgcaaagcatctcatacgagcgcaccctgcaagggttccgatgatcctttcgcaggatcaggtgctgtgaccacatcgtcacgccaatctgttcgtgcagcatttggcgaaatgtgctcgtgttagctcggtgggaaagagtgttccaacacgctcaaaggtgatgagcaatgaaacgtaggcgatgacgcccatccctgctgaggagaatgcatgatcctatggaccttggctgggggttggatagcatgaccagcaattattaaatgaagtgtccgtctgtgaaaacgaaggatcgcaggttctccaggaaggagctgctcttcatgtcagtgacgaaacatcaagggagaagttgtaggtctttaagccgggattggcagctctggattgccgcggggttcatcccccaatgggagaatcccattccggc

SEQ ID NO: 596185 - DNA, 239 bp, Homo sapiens
  misc_feature (64)..(64): n is a, c, g, or t
  misc_feature (160)..(160): n is a, c, g, or t
  misc_feature (234)..(234): n is a, c, g, or t
atttatgaaggataaagatctatcatgaacagcagaatgtataagctagcatttactagcatgnctctgatgcttttgtcattctgttaatcgtcatttctgcccctctcatggaattttatacttgctagggtaagagtttgtagactctttcagcagnacagattttaataaccaatttatttgttttattttaaaaattatttttgaataaccatttaatataaatttatntgaac

SEQ ID NO: 596186 - DNA, 110 bp, Homo sapiens
gacttctagctcggtaccccgaacaatcacgacatcgcttttaaccgccgcaggggtgaaggctgaaaatttccacagtcaagttgaaattcttgttaaagttctggacg

SEQ ID NO: 596187 - DNA, 426 bp, Homo sapiens
gctcaggatttggggtagagttggtgtaaaagcacagtgtcagtaggatttggtttggggctggaagaaagctccatcaagatggagttaagaccaggcacagtgcttatgcctttaatcccagcacattgggagaacagggtggacagatcatctgagctcaggagctcgagaccagcctggccaacgtggtgaaaccctgtctctataaaacatacaaaaatttccagcctggcaaacatggcgaaaccccgtctctactaaaaatacaaaaaagttaggcgggtgccgtggctcatgcctataatcccagtttcttgggaggctgaggtgggagatttgcttgaacctgggaggcggaggttgcagcgagccaagattgtgccactgcactctagcctgggcaacagagcaagactctgtctg

SEQ ID NO: 596188 - DNA, 97 bp, Homo sapiens
  misc_feature (9)..(9): n is a, c, g, or t
  misc_feature (61)..(61): n is a, c, g, or t
  misc_feature (89)..(89): n is a, c, g, or t
aaacaaaanacaaaacatacaacatagaaacaaagaagtataaataagcggtacaaaaaanagggttacaatacatcattagggctgtnaaacaaaa

SEQ ID NO: 596189 - DNA, 610 bp, Homo sapiens
  misc_feature (24)..(24): n is a, c, g, or t
cgagttaccgtgacattcaggtgntggccctatggttatgcgcttgtcggttgtgaggcgctgattcgtgacttcaaacagtatgacaacggcctgctgggcattcgcgtcgaaggtggccgtcgtttccgcgtgcgtgaggccggcgtgcagaaagaccagttgctggtggccgatgtgcaatggctgcaagaattgccggaccagccgctgggcgaagaggacgccgacttgctggcgttgcttgaggccttggccgaacacccgatggtggcctcgctggacatgggcggccaggccgaaggccagcaagccctgagcaatcagttggcctatctgcttccatttaacgaggccgacaagatcgacttgctgcaactggacgacccaggacagcgcctggatgcgatccaactgttgctcgatgaattgcagggtgaactgttcacctgatgttcggatttgtctggcaggactttcagactttggtcggtcgcctccactgcgccgcctgcactattttccgatcgcacaacaatgatcggagataaccatgattcggctgacccaatcacttaatgtcacgggtacgagccgaatcgtatcatgc

SEQ ID NO: 596190 - DNA, 148 bp, Homo sapiens
caggatcttccctcaatgctggacaggacaacttcaggcacaccacagatgatacccagagcagaacctcaaataagaatccctgccctttggtacagtggaatcacgcctgtaattccagcactttggaaggccagggaggatagtt

SEQ ID NO: 596191 - DNA, 205 bp, Homo sapiens
gacagtgacatgtgcaggacacagtcgatgaagcactgagcagaagctggaggcacaacgaaccagaaactcacagcaaggaaggaactaaaaacataacccacactgaccaggaggcactgggaaacctagaaaaggctgtgagctaaggaaggagggtcttcctttggcatgagatggggatgaagtaaagagagggactgga

SEQ ID NO: 596192 - DNA, 323 bp, Homo sapiens
  misc_feature (10)..(10): n is a, c, g, or t
  misc_feature (48)..(48): n is a, c, g, or t
  misc_feature (51)..(51): n is a, c, g, or t
  misc_feature (81)..(81): n is a, c, g, or t
  misc_feature (86)..(86): n is a, c, g, or t
  misc_feature (96)..(100): n is a, c, g, or t
  misc_feature (125)..(125): n is a, c, g, or t
  misc_feature (129)..(129): n is a, c, g, or t
  misc_feature (143)..(144): n is a, c, g, or t
  misc_feature (147)..(147): n is a, c, g, or t
  misc_feature (152)..(152): n is a, c, g, or t
  misc_feature (160)..(160): n is a, c, g, or t
  misc_feature (167)..(167): n is a, c, g, or t
  misc_feature (209)..(209): n is a, c, g, or t
  misc_feature (213)..(213): n is a, c, g, or t
tctgtgcaanctgcgaggatggcttgggccgaagggttgctctgcccnccncgctagctgtgagctgagcaaagccctggnctcanaggaccccannnnnctgtggctcatctgcgtctgcacanacantcaaaaggatcgtnngtnttgtnttaaaganaggtganattggcttggttcttcatgagcacatttgatatagctctttntctngttttccttgcccatttcgttttggggaagaaatctgtactgtattgggattgtaaagaacatctctgcactcagacagtttacagaaataaatgttttttttgtttttc

SEQ ID NO: 596193 - DNA, 894 bp, Homo sapiens
ttcgcccccccgtgggtatcgcgtgtctggttccccctcgcccgggttgttggctccttgccgcccgctcggtgcctgtttgctcgcgcgggttctgcccctgtatttggggtccgcccccgccgctctcgatgccaactcgagggctctgttgtcgtgctggcgacaaaagctttcggtccccccttgtcgtggtccaaacagctttgcgaggacgcggcttcgttgtcttcttgaagcgcctcggttggtccgccaccgctgtgttgctatcacggtccctggcggcacgcccccgctgttcgtgcgagcttttcccggcgcgttagcccccctggggctcgcccttctccgcttgtggcagtcttaagccgccaccccgagtaccgggcaggtgtccacccacagcccccacggggccaccaaagggcgtgttgcgcagccgtgtccacagggcatgccccctacaggtgggtacgcccaccaaagctccacaagaggcgcgcgtacacgtctgtaatttattgctccgcctgagtacggactcccccccccctgtgtctataccacgtcgggtcgtgagaagacgccgtctgtccataagccattctttttcccacaatggcgcgccccattacaccttgatattacattacaatgtgtggcaacataggactccacgcatcgttgtcaaccactctcccaacagaaagatgacatctatgcgtagccccctcctgtggtttttctttctattgtgctgcaccgctaatgtaactgatcttcttaatcaaaatcccccactatttttatatgaacctacccgtgccccacaatgttatccaccacgaagtttatcagccgccccctaaaaaaataacaacccacaaaaca

SEQ ID NO: 596194 - DNA, 384 bp, Homo sapiens
atttgtggagtccctagagttttgacaatcagagaatcagaagaggataaaattgaagaaactaaagaagtatgactgaataatttaacctaatagagaaaattatcattactgaaaaacagaaatattttcctaagtggcgtgaaagtaatacagtgaagcataatttttactacaaaaccaaaacaagtaggagtatactttacagctacctaagtggtgcaaagtcggggacagattttcaaagcattaaatgggagcttatccacctgatctctattagtgctaatgagaaccacaccactcatggctttgaacattcctcctaggtgtttccctatgaatatttatgcaatcagaagtaaaatgctaagtatcaccaaa

SEQ ID NO: 596195 - DNA, 121 bp, Homo sapiens
accattatgtactcactctgtcccccatactggagtgcagtggtgaatcacagctcacagcagctcgatctccccggtcaggaatcttccacctcagcctccgagtagctggaccaccatg

SEQ ID NO: 596196 - DNA, 656 bp, Homo sapiens
  misc_feature (249)..(249): n is a, c, g, or t
  misc_feature (264)..(265): n is a, c, g, or t
  misc_feature (268)..(268): n is a, c, g, or t
  misc_feature (271)..(271): n is a, c, g, or t
  misc_feature (274)..(274): n is a, c, g, or t
  misc_feature (285)..(285): n is a, c, g, or t
  misc_feature (297)..(297): n is a, c, g, or t
  misc_feature (299)..(300): n is a, c, g, or t
  misc_feature (305)..(306): n is a, c, g, or t
  misc_feature (311)..(311): n is a, c, g, or t
  misc_feature (318)..(319): n is a, c, g, or t
  misc_feature (335)..(335): n is a, c, g, or t
  misc_feature (338)..(338): n is a, c, g, or t
  misc_feature (366)..(366): n is a, c, g, or t
  misc_feature (369)..(369): n is a, c, g, or t
  misc_feature (381)..(381): n is a, c, g, or t
  misc_feature (398)..(398): n is a, c, g, or t
  misc_feature (400)..(400): n is a, c, g, or t
  misc_feature (421)..(421): n is a, c, g, or t
  misc_feature (434)..(434): n is a, c, g, or t
  misc_feature (447)..(447): n is a, c, g, or t
  misc_feature (454)..(454): n is a, c, g, or t
  misc_feature (456)..(456): n is a, c, g, or t
  misc_feature (463)..(463): n is a, c, g, or t
  misc_feature (469)..(469): n is a, c, g, or t
gtggggtcccctcaagcctcaggcttgttaatctgttgggtaactctgagggctttctatcagccgttccaagctcgggcaggtcaagctcggtgcgcaaattgtcgtacagaattcggcacgagctagtctcgagtatacttttccaacagtaattacattacaaggcattgtattagcaaccaggcgaatgagctgcttatccctctataacagtatagagcaggtcatcaggcccaggatggaganaggttatcaaaggtnntgnggngtnctttgctgcangtgcttagggcntnnaagannaggtngtggcannagaggttggcaggaantgntgttagtcaaaacaccaaaatcctgggnganagcccctatacnttccttctaactccacntnaggtgggagcattccaggagncagagaatgtgancaggatgcagcantgtcatntnaaccccnggcttngttcagtgctacttcactagccagccctccactcttctagcctaatagtgattaggtatttcaagcactcatactcagaccatgcgatgtctgtggagggcatctggtaatttaatgtggccagcacccctagacagtgagcgatagccacacagacagagagagagatagagagagagagagagag

SEQ ID NO: 596197 - DNA, 315 bp, Homo sapiens
gggacaggggctgctgagcagcctcccgcctctcccggctgttgggggccccactgagtatgtcgggaggagagcgacatggacaaaggccatcaagggaaacttcccattttgggaggaattacagttatcaattggggcttcagaaggctgggaagcctggaattgagtggtcccagttgagagtctgtgtaaaggaaatctactcaaggaccggtttgcgctgaaaattcttctagatcggcccaaagctagatatgaggtccgtctccacatgatgtgtccaaacaccaaacatggtccagatatggagtg

SEQ ID NO: 596198 - DNA, 101 bp, Homo sapiens
  misc_feature (26)..(26): n is a, c, g, or t
aataaccataactgcaaaaacccaancaaaaaaaaagggggaacaaaaaaccccaaacccccaaaaaaaccagaaaaaaccacaaaaaaaaacccctcctt

SEQ ID NO: 596199 - DNA, 411 bp, Homo sapiens
cttacttgtaacctgcgaaattgacctgtccgtgtagaggcgtccatgacacatcaagatgagaagaccctatggagctttaatctgttagtgcgaacagttcctatcacacccacaggtgctaaactaccacacctgcattataaattgccgatgaggcgacctcggtgctgaacctaacctacgagcagtacatgctaagacttcatccatcaaagcgaactactatactcaattgatccaataacttgaccaacggaacaagttaccctatgtataacatcgcattcctattctagagtccatataagcaatagggattactacctaaaggattgatcaggacatcccgatggtgcattcgatattaaagggttagtttgacaacgattgtactacgtgatctgtgtt

SEQ ID NO: 596200 - DNA, 220 bp, Homo sapiens
aataagttagaactaagattctatcattggacacaccagctatcaccaggcacggaaggttagtcagctctaactataaatctttccactcttttgctccagtcgccgggtgtgctcttttaggctgtacttcggtcgctcgtctgattacgggggtcttagcttaggctctccttgcaaagttctttctagttaatacattatgcagcagatgaggtgg

SEQ ID NO: 596201 - DNA, 1245 bp, Homo sapiens
cataaaatgtatgctttaaatgaatatggtttattatatgcaaaccatatttcaatgaaattgattttaaaaatcactgcatcagatagcatagacttgaaatccatttctaaagtatacaacaaccctttctccataagatttttcttcatgataattttatctgttgttcatcaaaattactccaaacacagtgtcaggcatgtaggtaccttttttttctttttttttttttgaggaaaggggatgtgccatcccgtgttgggccccaaacgcggggatgtaaatggggcacgatacctcaagcctcatgtgggaccaaccaaacacggggcgcaaatttcgggtagatttaacgacacaactgggggtgttccaccaattcttgtgggccaggggcgtggtctgagaacctcgtgtagaccctacataattatatctcgtggccgtgcatgtggggccttccacaaaagggggcgggagaaattaaccggcggtgtgagccacacacaacaccacagccacacgcgtgtgtttttgttccctctttaaaacaagaattaaagggcaacggctaaatttctcaccaatctcttcctatctccacagactgttcttcacaccccttctgtactggcggcgacagggtagtttggtcacagagccaagcgcagaatttatcccactctttacatatgtgggtcaccaggctcccattatgaaacacctcccataaaatattattcacccacgtggtcggcaaaaatcatctcaagaaagggtttccccagaggggccttccactaatttaaaaaattactcgcctcttatgtgggttggaaaaagacggctttagacaattttacaattttggtgggttgggcggcccccaatgtgtgaatccctttttttttatactcataccaaagcttcttttaaagagggggcagaaaatttttttcaccataaagggggccacaagaatttataagagggggggggaacaattttttttcgacagaaaaattctctggggggagtttaaaacagaggaagcgtggctgggatataccaggttcggggaataatctcggggggagagaaatctttttatatctcacaccctaaaattatctttcaagattattaaaccaaagggggtgttgagagaatccgggcggcatcaaacatttctgccggtggaagaaattttttcttcacaaaaataaaataaacgacaaacta

SEQ ID NO: 596202 - DNA, 889 bp, Homo sapiens
  misc_feature (1)..(1): n is a, c, g, or t
  misc_feature (32)..(32): n is a, c, g, or t
ncaggagagggcatggggggactgggtggcgncggtgcgtttcggtgcagtgtggcgtgtgtgtgtccacgcgtggtgcgggctgtcgcggcggtgtgccttgccagcgcccgtctcgtgccgccgatttcgcggccttggctgtcggcggggccgtgctcggtattgggggagcggccaccttggtggcgccacctacgcgttatgccgcgctggaatgccgggttcgccttgtctcgggcttttcctcggcccctttttcccgtatctccccctgcgcggaccacagggtaagggccggcgcgcaaatcgtttctttgggggttacaacccgcggggggtttcttgtgcgcgcaaattatttggccgctgaatcacaaagcggtgtcttctttaacccattcccgggatattggggatcatttctcccaagcaggaggccccccgcaacgggtgttcccgcggtgcacaactgtgccgtgatctctgctcgagttgcccaccccaaacttcgtcggtgggcatagctgtgctagcccccccctcacactttttgcgccgcggaacattcctttgcccgagcagcatctatggggggcttcttggagcacctcctagcaccctctgtgcgcacgccgaacaaattgttgcctcaatcctttccgcgcacagtttgcgcctctccccttgatgtttcccccccctattcacatggtcttactaggagttcccattatagccgccgccgtcggtcccccccccgcgaggtgagtacgctccttctggcggtagacccacaggtgaacgggttcgcgtactccctcggacgcctgtttgcctcccattcgccctgggttttacaaaaaaggcccccccgcccaccaaaaca

SEQ ID NO: 596203 - DNA, 395 bp, Homo sapiens
  misc_feature (22)..(22): n is a, c, g, or t
  misc_feature (57)..(57): n is a, c, g, or t
  misc_feature (70)..(70): n is a, c, g, or t
gcccccgggttaagaggttaangggaaaaacccggataaatggggcccctccatccngaattaccaaccnccctatgccatccaagaatgccctccccagggtgaaaaaaatagccgtatagaatggaagaaaatattgccaaatccatataatcctgataaaagtttaatgtcccagagtatgtaaagagtgccctaaaactcaataacaggaagacaatcctaatttttaaaatgagcgaaggatttcattagacatttctccaaagaagatatataaatggcaaataaatacatgaaaagatccttaacatcattagtcaatagagaaatgcaaatcgaaacctcaaggagagattacttcacacctactgggatggcaattaaaaaaaaaa

SEQ ID NO: 596204 - DNA, 803 bp, Homo sapiens
gttatgcccggttctcacgtcgcgcgtatcagtagcttggcctagactgatgcccacggatacctggacacaaattcatgctcgtccagactgtctgccgtggcctagatatcaactggcgtagagacttgtattcggtagccttgttccctgttgtgctgtccccgtacgcgcgtcgactgagaaggaggtaaggcgtcaatggcatggcggaaatctctgtagagggtccacaagtgccgggcgtgcacgtgtcgtgacgtgaactacacgttgtgacatccgttgcttcggcatgtgtatcatggtgatgtgatgacgctccatcgagcactatgatgtgattcactcaggcgaaatgtgacaggatctaaaccatttgcacaaataataagtaactatgcgctgcccattgtacatcgagtatgcctggatcgacactttgcaaaggtggctattgatcataaatactcccatgcctcttacggtgatccggtaatcggatcaacgcactttgcgcataatttgaaatctttcatgacgcgagcggacgacaatctttttaccttccgctagcgaatatgttgaccgcgtaacgggggaaaacggtcataccaggtcctcacttgaagtaccccccacgtaaatgtgggctttgggccaaaggtagtctaattctctgtgggccggcctaatcacttttcaggagtgggtccaatttcatatgcaattggcaccctgcacttggtctcctttcacccacggaaataaacacaaggcccgactttccatacacttagatt

SEQ ID NO: 596205 - DNA, 144 bp, Homo sapiens
gtcacattctggttatctgtgtacagcgtgcaaagcggagcccagacatcccgaagtcttgcttggtatgcccacatcacatgggtcctctgggggtcaggtagcctttccaggcttaggacactgcggtacccaacagacttc

SEQ ID NO: 596206 - DNA, 369 bp, Homo sapiens
tgtcggagtgcaatggctgtcaggaagcgtgtctggggaggcctcaggaaactgacaatcacggcagaaggcgaaggggaagcaggcacgtctggccatgttggagcaggagagacagagagagtgaagtgggagggctgcacgcttttaaacaaccagatcccacaagcgctcactcaatatcacgagaacagcaagggggaagtcggcccccatgagccaatcacctcccaccaggtccctcccacaacactgggaattacaatttgacatgagatttgggtgtggatacagagctgaaccatgtcaagggtagttcaaccgctgagattgattgattgattgattgactgagatggagtcctgctc

SEQ ID NO: 596207 - DNA, 291 bp, Homo sapiens
atcccgctcggtgacctgcccctcatccacagtagcccttcattttctccattatgtatctctggccccttgaactcttagacacaataaccctgctacctgaccagtcatctgaactgttccgttcgacagcagttaatgtgtatcatttcctccccttatgatattctgcaaagtcgtacagtagagatttagcacatgaaggacattgctacggcctagctctctcccaccccttctttccctggcccggtgatctgttgagctctagggtgagtctcatggacaacc

SEQ ID NO: 596208 - DNA, 191 bp, Homo sapiens
ggatccggttgcagtgagccgagatcacgccagtcacctccagcctgggcagcagagcgaagactccagcctcaacacccccgacaaaaaaaagagacactatcccagttgtcaagatgagttaataatgagactgcagtctagaatttattcaattttactcataattctaggcagagggcaatggtggt

SEQ ID NO: 596209 - DNA, 216 bp, Homo sapiens
agacgaccctagaggatcctcccaccgccagtttgtactcagccgcaaaaatgctctccgagtctctaaaaatagtgctcgctgtgattacaggcgtgagccaccgcgcccggcaattggtgtatttttagtagagacgtgaaatgtttctttggtaaactgtattctagatgaatatgtttcattctgtttgctggtagtacaacctgccggagg

SEQ ID NO: 596210 - DNA, 367 bp, Homo sapiens
atcgatgccaccataatagcctggagggttggttttcactggcaattagggctacttatgggaggcagttggatagacacggcagtgtcctcccgggagcaacttggagtaacactcatcctaggcggtcttatctaatcttcacttcaaccggcaagggggttataaacgtgggtttacagctgaggatcccaaggttccatatcataatcctgggtcaagtccagaccattggtgaccgaaagcttaaatccagcggccaggatacaaaagccggttctcttatcctctcggccctaccataattccatcagggctgggttcatagtacttgggattggtggcatcgataaacaccgggtaccga

SEQ ID NO: 596211 - DNA, 229 bp, Homo sapiens
  misc_feature (68)..(68): n is a, c, g, or t
  misc_feature (90)..(90): n is a, c, g, or t
  misc_feature (168)..(168): n is a, c, g, or t
  misc_feature (194)..(194): n is a, c, g, or t
  misc_feature (219)..(219): n is a, c, g, or t
acccgcctgctgttgtactgtagactgtccatgtatcggatttctacaaagaaagaacttcttttatnagaaagaaaagaggaggactcncatacaactctgcatgaaacaccaacaactgggaatcactaccgagcaatcaccagccttgaaaggcagcaggtgccnaggtgaagctggcctgttttctaaanggaaaatgattgccacatcggcaanagcgatcgca

SEQ ID NO: 596212 - DNA, 276 bp, Homo sapiens
tagacgtgatgcgagctcgagctggaccttttacagctttactgagatgtaatcatagactatacagttcacccatttcaagtgtataattcagtagctttttagtatattcacagacttgctgtcctcccccaaccacttgtattccctcaggtcccctagctctcaaagctagacaagccaagctggaaacgtgtcctactaattctcccagttctctttccaactttaatggtttcaagtcttctcatttccatcactccttcacccaagcta

SEQ ID NO: 596213 - DNA, 159 bp, Homo sapiens
atgcgcaataaggctgtatcaatggctgatctatgtaatcacagaggccagtatgtacagacaacagtgggaggtttatatattcttggtctcttcctcctagggtaaattcttgatgatctccgtccttcttggcctggaggcgctcttcacggcgct

SEQ ID NO: 596214 - DNA, 198 bp, Homo sapiens
gcatgtcacgaattataaataaactactgatttatttgttgcctgaaacattgttgcgaagacaaattatgtgttgagaaaaaaattaggcacagttaaataatgctacgcttaaagagaattttaaatacccttatgaataattctgatgaaatatatcccataatgttttttattcaatcatattaatttagcagg

SEQ ID NO: 596215 - DNA, 451 bp, Homo sapiens
  misc_feature (243)..(243): n is a, c, g, or t
gggcgtggtggcgcttgcctgtagtcccatctacccgagaggccggatcgcttgagcctggtaggcggaggttgcagcgagccgtgatcgtgccactgcactccaacttgatgacagggccagagccttcctctaaaaaaaaaaaaaaaaaaaaaaaaaaaaatttggtgggcccgtcctcgggccctcggaaaaggttctttctcttagaaccctttccgttggggcccgcgggccccaggntgttatgtggacctgggcccatagcgtgttccctaaggagaatccggggtcctggcacctggtggctgggtttctcccccaattaaaaaacgcccggggggcaccggaggcgtttctgaacaattcccaatggggttctcggaaggccatcaaggggtctccatttcacgggggtccagggagctcgattatcattttacccgctgtg

SEQ ID NO: 596216 - DNA, 824 bp, Homo sapiens
ggagctgcgagcgcgctccctgtgaggtgggcaagcggcgaaatggcgccctccggagtcttgcagttcccctgcagtcctggtgctgttgctttgtgggtgctccctggacgcactgggctgggggagcaaagtgtgggggtcaatcaggggactgagaacgtggagagaacttgcttggaaggagacttgatgatagaattttatgcccttgtgtgttgctgtgttttgttcaaaatcttcaacgggaagtgggaaagtttggctgaatggggagaagatcttggaggttaaatattgcggaaaagtagatgtcacagagcagccatggacttgagtgcaccggtttatcataacgtgctcttccttaatatttatcagtaagtatttgaaagactctaaattatggagaaggatgccttataggtgtactcagaaggtagtagggcctcctgggtgtggatcatgctggaagaagcttgagttgtaaaagaatggtgaattaaggcgctaatcaaggggtccaagggaccttaagaagggcctttcattacaactttttattcacgttgatacaaacgaacgtttgcgaccggagttcttcggcagcccgggttcccataccagtggttgggcgacccaaggcgttacttggttcctggagtgacgctagtatggtcccggcacttttttcacgctattctactatgtggacttcccggcatgtgccaataaacttacttttcttggaagcccttgggatttggccgtggggggaccactattccgggttccgctacgcaacttcttgttcccggcatggc

SEQ ID NO: 596217 - DNA, 393 bp, Homo sapiens
catcacgatccccgggtggggagtcggaatgtctaggtcctgagcgaaagcatgagttgagggacaagaactatattgtgcttcccatcaaattgccactacgttaccatgtaatggactagcctcagaaaaaattagataaactcaaatgtgaccatcaacgatgatctacgttgggtgccactgaatacaccatagttcctgatcaatgcgagattacgtgtatcaagttgaaaccacccagataccgagaatgctctcttggagtttgagaatactggatcttagcttgatgcagaccttgagatttaggtctatggagtgtcttcatattctatgacttgacagctaattacttttctggcaaacggatcactgattccgtattcccta

SEQ ID NO: 596218 - DNA, 101 bp, Homo sapiens
  misc_feature (66)..(66): n is a, c, g, or t
gtgacttagaggatccggcactatgtgtggtggaggccgtgtggtgctggctgagggttctgctgntgtgtgccaccccattaaagtgcagttccctccgg

SEQ ID NO: 596219 - DNA, 193 bp, Homo sapiens
gccttgctactcggatgttccacattaaaatttgtgctcaaatcttggggagctcactcaaatcccacttttttttacagcagaaagctaccccatgattaatcaaatttcttcgggggaaggtcaccaccacctcttgctccaaatcctccacggtcacgatcccggtcccgggaagtataaagcagttgag

SEQ ID NO: 596220 - DNA, 754 bp, Homo sapiens
gccgaataggaacagctccggtctacagctcccagcgtgagcgacgcagaagacgggtgatttctgcatttccatctgagaccaggtgaccttttctatttcatagtaaacaaacttcatgagtactgtgccggagtctagggataagaatgcactacaaatatcaaagccaaagggttgatgagctggtggcatgctatggaaattatacagaccctagtatggatgtcagagaaacagaaaccgagtcatcacgcctgaacacatgggcagctaagaaatggagtctcactctgtcacccaggctgagtgcaatggcatgatctcggctcatgcaacctctacctccatggttcaagcaattcccctgctcagctctcaagtagctggggatacaggggagcactatttaatctctgtggtaatttaattagtgagcctcagattccaaaatctgtgtccgtgtgtggatatccagtgggtggctgattcagctttagtcagacatgtcttttgacgctgagtacacgaagcttattcgtggagtataccaatagctgctacaggccctttttatattgagatcacttccgtggctttccagcaagggacactcccggatgtgggactccaccaaggtgtgctattacgcgtggaaaatggtccctttctacaaaagctggccccccatattaatttggtgcgccgattgtggaacacaggggggggggcccttcacaatcacaaaccaggg

SEQ ID NO: 596221 - DNA, 289 bp, Homo sapiens
  misc_feature (1)..(1): n is a, c, g, or t
  misc_feature (31)..(31): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (50)..(50): n is a, c, g, or t
ntttgagggtcatatccttcttgtgagcagnacttcacnananatcccanaagcattgttatcacaggtgatgacagctctaagcctgttattgctccaaaagacatccagtgggacaagatgtggaggtggaagagagtgatgttgattatctaactctgtgtaggcctagactaatgtgctaatttgtgtgtttgtgtcctagtttttttctaaaaacaaaaacgaaaaagtttaaaaaataaagaattcaataaatttaaaataaaacaaagaatataaattaaat

SEQ ID NO: 596222 - DNA, 180 bp, Homo sapiens
gtcggacgagtttattcgactcaggagaacgtggttactagcacagagagttctcccagtaggttaatagtggggggtaaagcgatggttagcagcggcttgctagcaagtcatcacaaaagctattcagtgggagtagagttttgacgtccttagagacgaggattatgcatggcagct

SEQ ID NO: 596223 - DNA, 719 bp, Homo sapiens
  misc_feature (229)..(229): n is a, c, g, or t
ggcccactcggtctggtgcccactttacgggttgtgggcccccctggccctcgggtctccacccctgggtttgggttgttatacttcctctgggggaatatatttctcttggggaggggccccccacggcgtgtgactaccaccagtcagtatccgttttgggtcagtcttgtgtcaaccacccagccatctgtttggtgggcccacaagaattgttttcttataatgngtgtctcttttttgcgcacagaactcttaatatagtgcacctctcgaccaccggagtgtatatatactttatactccacggctcggttataagagagtgagagcgccacaattgttctgtctcaacggtgtgttttgtccacccacagagaaattctcacacagagtctcacacacgcccacactctgtagagagggccacgccacactacccacccacgtttaaagagagaccctctgctaagggtataaggaattccctgagaacaccacgggggcgcgctacactcttctctctctctcgtgtgtgcccacaagcccacgttagaagagacacttccactggaaagaaattaattttaccgcttttataaagtcgtcagattttcccttatgtattgagttttgccacttaggatgtttttgagtcccactgggtcacttttgagattgtttaatctttgttatttaaattccttgttaaacccgga

SEQ ID NO: 596224 - DNA, 321 bp, Homo sapiens
  misc_feature (225)..(225): n is a, c, g, or t
ggcacggagggacatctgagtcattgtgtcgttccccaagcacccagaggatgagttgagactcggatgtccatttatggagaatgagagtttatagcattggggttggcagtttacaaagggatgctggctcataaaaactctgatcattgtacaactataaatgtaataaaattcactgagtaataaaaaaaactctctgaacatgcacattagtcccgagtngaatgatccattcatctgtccgtccattcattcaacagatagttactgagcctctgtatgaggtccagcactagggctccatggttatgaaataat

SEQ ID NO: 596225 - DNA, 387 bp, Homo sapiens
  misc_feature (116)..(116): n is a, c, g, or t
  misc_feature (122)..(122): n is a, c, g, or t
tgtttcagtcccttctgggggtagaacttgctttgatcacaatggtaactattttttaatttattttgtttctctattaaaaaaatttttttatctttttttttctgagacagggnactcanctctgttgcccaggctggagctatggtgtgattatggctcactgtagcctcaacctcccaggctcaagtaatcctcccacctcagcctcctgagtagctgggaccacaggcacgtgccaccatgcctgattaattttttgtttgtttgttttttgagacagagtctcgctctgtctcccaggctggagtgcagtggcgtgatctccactcactgcaagctctgcctcccgggttcacgccattctcctgcctcagccgtcgacgc

SEQ ID NO: 596226 - DNA, 275 bp, Homo sapiens
ttgagagaggatatgattgcgactgtgagtgcgtctgtatgtttgagtttgctagtgcggcatagtaatgaggatgtaatgtcctgtgggctgcttatgagaatgactgcgccggtgaagcttcagtggggtttggatgagaatggctgtaactacgagggctatgtggctgattgaagagtatgcaatgagctgattttatgtgtcttgtttgtcatatgtgcatgatgtgagcttgttatacattatgcctcataggtgatatgtacacatgg

SEQ ID NO: 596227 - DNA, 734 bp, Homo sapiens
ggagcccgtgtctgtcgggtgccgagccaactttcctgcgtccatgcagaccccgtgcgggcagacggctgcactgcctcccctgggtccgaggcgccagtgggcccgtagtcctccagcgacccgtctgctcgctgcatgctgctgttgcgtcgctcccggtggcggagcccgggggtccggggaccccgacgaccctgggcagcctcaggatgctggggtcccgcgcaggctcctgcagcaggcgggcgcgcggtgcttcacttcttcaacttccggtccggtcgcccagggcgctacgagtgctggccgaggtgcaggagggccgcgcgtggattaatccaaaacgagggatgtacagttcacgtggtcttcaccacagagcgctaaacccagagtctttacttcaggaaggtgagggacgtttggggaaaatgttctgctcgagtgtttccaagaaatcagaaacccagaccaacatcaatgtaacttgtacacggctcatcgagaacaagaagaagacaacacagaggattacctgctttacaagcaaatgaacgcactgaaaaaccccttggaaatagtcagcatacctgataatcatggactctattgatccctctcttgagatcatctgggattggcttccttggaagctcttacgtgatgtggggaaatgacaaccccaggtgtcacactactactttggaacagtccactagtgtgaggcagtg

SEQ ID NO: 596228 - DNA, 260 bp, Homo sapiens
  misc_feature (17)..(17): n is a, c, g, or t
  misc_feature (19)..(19): n is a, c, g, or t
  misc_feature (30)..(30): n is a, c, g, or t
  misc_feature (34)..(34): n is a, c, g, or t
  misc_feature (255)..(255): n is a, c, g, or t
attaggtttagcagtantnatttgtaaggntatnctgagattactggcagatattgaagagagattcaaggtgtaataaaattatttgtaggttaaatattgggaaatctgggttctttttccaactgtgctaatagttattgggggaaattcagccagatattgggcggaattcacccccaatatttcacgtaggttgttttcattttccctaaatgttggctggtctgagaaataaagggatagagtacagangtggt

SEQ ID NO: 596229 - DNA, 308 bp, Homo sapiens
cgaagacgtagccatgtctctgggcactttcagatcatactcgccgtccacacgtgggatcacattcagctttttgctcgatggccgaaaattgctggtcttgggcagagaactgaaggcatcagtaatctttcctgcagccttgtcggtcaccagcttggtcactttactctccacggctgtgagggtgtcccccgggggcctgctccgttaagaggccagctcttcgcagattggagaaagataacaaggtgcccaaggccataagctctgcagatacttgtgttttcaagagatcggtaatcctt

SEQ ID NO: 596230 - DNA, 879 bp, Homo sapiens
  misc_feature (59)..(59): n is a, c, g, or t
  misc_feature (107)..(107): n is a, c, g, or t
  misc_feature (164)..(164): n is a, c, g, or t
  misc_feature (366)..(366): n is a, c, g, or t
  misc_feature (387)..(387): n is a, c, g, or t
  misc_feature (512)..(512): n is a, c, g, or t
  misc_feature (609)..(611): n is a, c, g, or t
  misc_feature (613)..(613): n is a, c, g, or t
  misc_feature (627)..(627): n is a, c, g, or t
  misc_feature (641)..(641): n is a, c, g, or t
  misc_feature (643)..(643): n is a, c, g, or t
  misc_feature (647)..(647): n is a, c, g, or t
  misc_feature (666)..(666): n is a, c, g, or t
  misc_feature (670)..(670): n is a, c, g, or t
  misc_feature (710)..(710): n is a, c, g, or t
  misc_feature (722)..(722): n is a, c, g, or t
  misc_feature (755)..(755): n is a, c, g, or t
  misc_feature (801)..(801): n is a, c, g, or t
  misc_feature (806)..(806): n is a, c, g, or t
  misc_feature (809)..(809): n is a, c, g, or t
  misc_feature (830)..(830): n is a, c, g, or t
ggaacttcgttgcttgcttgcctgtgcgcgcgtgcggttcatggcctcaaacgattatncccaacaagcaacccaaagctatggggcctaccccacccagcccgggnagggctattcccagcagagcagtcagccctacgggcagcagagttacagtggttatngccagtccacggacacttcaggctatggccagagctgctattcttcttatggccagagccaagaacagctatggaactcagtcaactccccagggatatggctcgactggcggctatggcagttgccagagctcccaaatcagtcttacgggctgcagtcctcctaatcctggctatggccagctgccagctcccagcagcncctcgggaagtttcggttgcngttctcagagcagcagctatgggcagccccagagtgggagctacagccagctgcctagctttggtggacagcagcaaagctatggtcagctgctaagctatttatccccctcagggctttggtcngctgaacctgttcaacagctgctgtggtggtggtggtggtggtggaggtggaggttactttggccaagatctttcctccatgagttgtggtgagtannnantagtggcggttatngaaataaagaccanantggnggaggtggcagcggtggcnatgnacagcaggaccgtggaggccgcggcaggggtggcagtagnggcggcggcggnggcggcggtggtggttacaaccgcagcagtggnggatataaacccagaggtcgtggaggtggccgtggaggcagaggtngcatnggnggaagtaaccgtggtggcttnaataaatttggtggccctcgggaccaaggatcacgtcatgactccgaac

SEQ ID NO: 596231 - DNA, 351 bp, Homo sapiens
gagagtcttcatcaccctaaattattatgggaccattaactaggccacctttaacagagcacccctttgaaagttttataggtctgaaatatatgtagattttgtaaagggttttaatttttttttttttgatggggtgctgtgtaaatcttgtattaataaatgtaatgaaggtattgccagaaaaaaatatatacaacttttataaaggattgtgtactgactgaatacttttaaaagaaaatatatttggaaacctgttctgctatgaccagagataacatatcttttaactatgctatgggtttaaaggtaaagcttcctaatgcataataaattttagggttgatg

SEQ ID NO: 596232 - DNA, 133 bp, Homo sapiens
tgaggaccccctgcgcataggatgcatacttattgaatactatcttgggtttaccgtttttccaacacacgatagtaaggagcatctagcagtgattgaaaggattcttaggcctctaccaaaacatatgata

SEQ ID NO: 596233 - DNA, 94 bp, Homo sapiens
caagctgcctccacctctacctacaatggcccctccagtgttggctccttcattggcaccaccagtgatgccccctgccctccctgctacagag

SEQ ID NO: 596234 - DNA, 491 bp, Homo sapiens
cgcgccaaaacccctcccacggggtggtgttttttttttttgccaaaaattgcgcttttcctttggcggggaaaaaaacccccttttttaaaaaaatgccccaaacgccccccgggttcctttttaaaaaatggcgcccccccttaaattaaaaaaaaaaagaggggggtccccttttttttttaaccccaaattttggctttgaaaaaaagggggggttaaaaattttttttaaaaagtgttccccccgggaatttttggaaaaattcccaaaaaaaaaggttttaatattccccccggttttttttttttaaccccctgggaaaaaaaaaatgggggtttcttttttggagggcgggccctttttttccccttttggaaatgttgcccaggcccccccgggtgggggatttaaaatccttttgccccccccgaattggaaaaaatttgttttttaaaaattttttaatgggcggggggcaaaaccccca

SEQ ID NO: 596235 - DNA, 1838 bp, Homo sapiens
  misc_feature (1557)..(1557): n is a, c, g, or t
agttgtcgtgcgggtctagagcaacgggtggggtttgtgtatatcgccctttagtggggacggaacacatacgtggtgggggccacattcggcgataggtgtatgtgataaggtcgccgcctgagagatgtttgttggtccgtgctcgcggtacgccgtctgggtgggaggaacgtccacccgttggcagtgagttagatagtatggggcggactctcactatgtgagtgaggagttaataggaagtcgggtttggcgctagctgaggtgcagtcgtgggcgcggcagcacaaaaggagggggcgcacggcggtcgcgcaagactagttgtcgtctcacagggggaggaggggggagagtggtgtgtgtgtgcgccgcgtgggatgtgggggcaagatctgttgttactcaatgaaaggcgttggtgtgtagcgttgtgggaaagagtatggggggggttgtgtgctgttgagagacgtgcgggggggaagtcattgtgtgcgtccgtgtgaataagagagtgtggggcggttataagtgtctcgttgggggaaagtttttgagtggtggtgtgtgtcgtgacgagtgttaagcacagcagcccgaagtctcgacggggggcacacggtgagaagatgcccgcgtggtaggttgcgtgttgaggccgccggctctgcacgggagaggcacccacgaggagtggggtgtctctcgtggggcgggtgaatagagaagggggggcgccggcggcgggggtattttttcgggggaaaccttgggatgttgggcctgtgggagagtgtgcgacaagaagaagagagggttgggttgggggggtgtttggcgcagccaggggagggcgcccaccggggttaaagagaggcggcgttgtgaggaggtggccgtgtgagtagaaaaatgggggggggccgccaccacattatgaagagaggggtgtcttggtggtgtgggccccacatgtgggcccccacaggggcgagagagggggtctgtttttgtcggggggtcacgcaaaaacctccctctatagagagagagggcgctttggcgtctgtgtgtccggagagggggccccgctgtcgataatttggggggggtgtggctcgtgttcgcggggtttaactctctacgagtgtgagaagagagggttgtgggggccgcaccacaagaggcctgctcgcagagaaggtgtgtgtgggggcgtgtctgtgggggggagaaacactctccgcgagagggaacacagagagaggagcgggttgagaaattccccagtgtgagagagtgtgtgtgggtgaagagagtgtccctctgtgaggtgtgagtctctcacacaccgcgggagataccccgctgtgggtacacattatgttacaggcggttgtgacacacgtgggcgtgtgtggccgcccccacacatgtgttggcgtcgcagacacacagagaggtgtgtgtctgtgtggccacagtcaaagagagatgtgatagagatctcagagctgtgcgccacctggggagacaccccacacagtgggnggatagagagtagtgtgccctttaagagtagcccctgtcctgtacccacagtgagaccattggtggaacaccccaagatattagaattcttgccccacaccaccccctatttccaggcacacacaaagaggtgggaaacccagaaccccctgcccatagcgccccagaccccgtctccccccagcattaccgcggtcttcccttggccgctgtattttggaatcttggtgatattgctttcctataagaccctttaattaaattttggaccaagacccata

SEQ ID NO: 596236 - DNA, 168 bp, Homo sapiens
tggacaatggctatgggcactgtctcttagacaaaccagaggctccattgcatctgcctggtgactttccctggcacaggactatgatgctgacctgccagtgccagcgtgaccttcgtgtgcccgatctcactgccatatgtccacacgctgtgcgccgacccgtgt

SEQ ID NO: 596237 - DNA, 513 bp, Homo sapiens
gcttgcctgggcatattggcaggaatatgagaatctggaccacagaaggctggaagctcagggagaggagaagcggctgtgggttttattcagacccgtgtcagtaggtgtagataccagtctccattcatttccattcactaacattaaacactagtccacaagcgggttttcagtaaccccacactccgaacagggcatttttcctcctacaattttttgtctcagatataatgccatggttacatcttgacagatgttactggtttaaatcctgcttcaacactgctctgatttcccaggagcacctgcaaaggaatctttgggcaagtgcccaaattcctgggcccagagagaccaggctgtgcacagtgttggagtctgacaagggacagtatctgggaagatcaagtctagactcaccccaggccactctagttttaggcaccttgaccgtgttgtgtctccattcccgatactgcagctggacaaaaggaagagaggctgatctat

SEQ ID NO: 596238 - DNA, 83 bp, Homo sapiens
ctagaagattcagcaaagtacttttgtgctctggcttcgccttcttccagtactggggggatacgtacaccgataaactcact

SEQ ID NO: 596239 - DNA, 437 bp, Homo sapiens
  misc_feature (257)..(257): n is a, c, g, or t
cagtactcattgttttcccacttgcgcttggtgtagccagcaatgaaggtggctgctatatattgcatagagcccaagtccaaggtcaggtaatcactgccatcgtagccatactgccaatgccctgtggtcctgttgtaccgcatctcacagccgtatgtgaactggagggtgtgagggcctagaagccccggggacaggcatgtcagtgaccccacagatgtatttcccaggcctctccatcaatggtccctgcntgccctaagcactgctccccgattccttgggttctccttagaggacggcttgttcacactctagataacctaaggctggcttttccacttgatacctttggaagtgctgttgaagctctgacaggggaactagaactcggggcttttgctgttgtcacaggctcttcaacctctgtggct

SEQ ID NO: 596240 - DNA, 277 bp, Homo sapiens
agtatgaggaaattcctaattaagccattgctttgtgactgatgtataatacatgccctagttctccctctactgagaacaactttacctaaaattacaatgtctttctctgacactataacattaacagtactccgggctaccctacacgcttgaatttaggaggttggaatcgaagacttagcctttcacatagaaaatcgtcctggtctaagcggggagagtaggtgacatgcataatacatctttcgtggttcattacgactgtcactctgaa

SEQ ID NO: 596241 - DNA, 159 bp, Homo sapiens
ggacccactgctcatcatagcggctgccatcgggatgtctgtcaacatcgaggtcgtaaaccctattgttgatatggaccctagaataggattgcgctgttatccctagggtaacttgtcccgttggtcaagttattggatcaattgagtatagtagtt

SEQ ID NO: 596242 - DNA, 163 bp, Homo sapiens
ctagaggatccagttccttctctaattcagcaaactactttttatatgaaagtaaaaagtaacagggtcaccaggacagaatttggtggttcctcccccagtacacaccacggatgttggcctcattcttctgggctttggaaaatgggcttttgtggtccat

SEQ ID NO: 596243 - DNA, 162 bp, Homo sapiens
tccataccgcgtctatacgcgcgaagaatgggcgcgtctgcgcgacgatacgccgatgacgctggagccgggtgagttcgaccggctgcgttcgctgcacgaccgcctcgatctcaagggagtcgaggacatctatctgccgctgtcgcgcctgctctccgt

SEQ ID NO: 596244 - DNA, 305 bp, Homo sapiens
ttttttctgtccatatcgctgtccgaatggaaagactcattctgcatttctgtatccactcccttattctccctgtcgctgtcatcatctgactctggctactgtttgtgtctgaacgcatccacagtttctgattcactggcaggccccttctgaggcccctcactctcagagtcactgactcggggtttgggttgctcctcattttccgaatcactggcctggtaccttggggtatcctcactttccgaatcaatgattcggggttcgagaagctcttcattttctgagtcactgacctggtg

SEQ ID NO: 596245 - DNA, 369 bp, Homo sapiens
tgacccttcagcagacaacagcacagtagacgacaaccccgacttcgacaactctacattgtggcacagggattaagaggagaagttctttgattaagaagaaactgagggatgcgccagcccagagctgggatggggactgatggccgccacccttcccaccgcctgccccatccccatccccaacaaggcagctgattccaggcctgctcagtgaccctttctctagggggacatcagggcagtgccccacaacccacacacaccaccatctcactgggtctagtctcatctcagacaacccccacccccactgtttctggggttccctttctcatctctcccaccctgtctcctgcctctgtcttt

SEQ ID NO: 596246 - DNA, 133 bp, Homo sapiens
ctgggtcgagtgaaggagctggcatatactatatattgatctaggtggttgttacaccagtgtatacacatatataaattcaccagagctgtacacttaaagatctgtgtacttcaccgtattgtacaaaaaa

SEQ ID NO: 596247 - DNA, 245 bp, Homo sapiens
ttgcgcgcttgccccttggatgttccatatgagtgagcgacttactttagtcaatgaaatgtgagcaaagtgtggtgtatgactcttttggctggaagcgtttaagcactagcactcaattctccctactccctttctctgccacgatgaacactgaagtctcatgctgagatagtggcaacataaaatggatggcctagatggtcagataccacgtattagcacagctagagacacagcagact

SEQ ID NO: 596248 - DNA, 869 bp, Homo sapiens
  misc_feature (1)..(1): n is a, c, g, or t
  misc_feature (96)..(96): n is a, c, g, or t
  misc_feature (101)..(101): n is a, c, g, or t
  misc_feature (106)..(106): n is a, c, g, or t
  misc_feature (111)..(111): n is a, c, g, or t
  misc_feature (118)..(118): n is a, c, g, or t
  misc_feature (155)..(155): n is a, c, g, or t
  misc_feature (159)..(159): n is a, c, g, or t
  misc_feature (165)..(165): n is a, c, g, or t
  misc_feature (168)..(168): n is a, c, g, or t
  misc_feature (171)..(171): n is a, c, g, or t
  misc_feature (175)..(176): n is a, c, g, or t
  misc_feature (179)..(179): n is a, c, g, or t
  misc_feature (181)..(187): n is a, c, g, or t
  misc_feature (197)..(197): n is a, c, g, or t
  misc_feature (205)..(205): n is a, c, g, or t
  misc_feature (207)..(207): n is a, c, g, or t
  misc_feature (217)..(217): n is a, c, g, or t
  misc_feature (222)..(222): n is a, c, g, or t
  misc_feature (362)..(363): n is a, c, g, or t
  misc_feature (365)..(365): n is a, c, g, or t
  misc_feature (370)..(370): n is a, c, g, or t
  misc_feature (469)..(469): n is a, c, g, or t
  misc_feature (523)..(523): n is a, c, g, or t
  misc_feature (525)..(525): n is a, c, g, or t
  misc_feature (531)..(531): n is a, c, g, or t
  misc_feature (533)..(533): n is a, c, g, or t
  misc_feature (539)..(539): n is a, c, g, or t
  misc_feature (561)..(561): n is a, c, g, or t
  misc_feature (563)..(563): n is a, c, g, or t
  misc_feature (569)..(569): n is a, c, g, or t
  misc_feature (573)..(573): n is a, c, g, or t
  misc_feature (606)..(606): n is a, c, g, or t
  misc_feature (777)..(777): n is a, c, g, or t
ncacttggtggatatttaaacacagtaggaagaaataatgaccagagaggaagaatgtgccagtatttctccagagctattccacagagtattttnacagnggganatcangagcggngtgaccctgggtaagacctcttacctccctgactctngagngccccncanaanggannggncnnnnnnngagaggcagnggcacgcngnggcccaggcnggagngcaggggcacgagcggggcgcacggcaaccgcggccggccaggggcaagggaggcgcaggccacagccgcccgaggagggggaggacaggggcaggccaccaggcccagcgaaaggggggaggaggaggagagacagggnngngccangggggccaggcggggcgcaaacgccggaccgcaagggacccgccggccgcagccgcccaaagggcggggaggacaggcaggagccacgacaccgggccncagaagggagggcggaccccaagagggagagacgccgaaaaggggaggtgaaangncaaagngngggacnggcgggaacagaagagagaggnangaccgngggnccaagaggccagcaattataagagcacaagttnttgagaggaaggaaagaacgacaaggagaggaaggaacccagcaagggcaagagaggggcggagggcagaagcaggaaaaggggaagaaagggcgagcgggcaagggaaaaaaaagccgagaagaagaagaaggggggcgcccaggcggggcaccagaggccaggccgggnagcccagcacggggggaggccaaagcagaaggagcacgggaggccaggggggcaagaccagcccgggcaacacagcgagagcccagcgccac

SEQ ID NO: 596249 - DNA, 162 bp, Homo sapiens
tggcagtggcatgcacatggcttatgatgtgtctccgagtggaaaagactggttggtgggtggctggctgtaactcggctgtggagggctgtagctgctgacggtgggggtgctggtattggcgcttgagccatgttcatgccactgccattaaaggagctg

SEQ ID NO: 596250 - DNA, 697 bp, Homo sapiens
gcagaattatcaaaggagaccaatcctgtgggtatgagatgtggtgcggacggtgaaccgtctagggcggataactatggaattattttcaagcatgttcctcggactgctgagaacttcagagcactatgcacgggagagaaaggcttggtttcaagaattccatttttcacagagtaattccagatttggtgtggccaaggaggagatatcaccgaaactatgatggagcaggcggacagtccatttatggagacaaatttgaagatgaagattttgatgtgaaacatactggtcctggtttactatccatggccaagtcaaggccagaataccaataattctcaatttgttataacagctgaagaaagcagaacatttggactttaagcatgtagtatggggtcgtgaaggatggtatggatacggtgaaaaagatgtgaatcatttggttctcccaaagggtctgttggtcgaagaataacgtatcacgagaatgtggacgatataaaatcatgtgtgtgtgtcatagaaaatttcatctggtataagcagttgggatgtgaagcttagctattacaatttgatagttatgtcagcttggtgacaatggacgtttccgatttacaaagtgtaaaattgcagttatagttgttgtcactttctaatgtgttataattgacttgctggggtgaaa

SEQ ID NO: 596251 - DNA, 1128 bp, Homo sapiens
  misc_feature (575)..(575): n is a, c, g, or t
agcgggtggtctgtgtgccccagtcctcccaaagcgctgggattacatgcgtgtgcagcccactgtacgccccagccactttaaagacagtattcataaacgcgtcccttgaaagtcttgctaatgagaaagtgatatgggcgcttgtgtagtccaccctctgtctcagatacgagcaaactactgtacatttctctcttatccattacgactcttagagctattactcggacaggatttaccttaagaatggtaggaagagagatctcaaggctgctcgtaattagatttgacgcttgtacaatacaggacagatagcatggtttattcttactgaagtatacaacgaattggtgtaccagtaacgcagttgagaagtacgatcagcgctatatggggatgcacagatatccacgtatacatggagactttgtctgcaactgtactgtggcaattggttgtgtaatatcgtaccggtgctcggccccctcgcgattgcttgacacattactagcgaggactagaccgtccagcaaaggagagggccaagaccccctcgtaaactatggtgatgngcgtctaccgtagtagctccttaaaccgacagacagtacgaaatctatcttaatttgctctgtgccgattagggagaacacatagagtaagttggtccggctagtcgtcctcacagttaacgcttactttgccggaatatttttagtttacaatgagacggtagtttcatttaatcgttagttagtttcctaaccacgaggcataccactttctccacttcgaataagaaaccacctcattgtaacgtatgtcgattgaagtaagacctgggcattcctagaatttcgggcaactaactgtttcccgaactacggggtgataactttgccacggcacaatttaagagattttttatcgtccccttggcaactcaacgcttaaaaaaaccagtctttgaccaaaaccaatgtattaaggcttttcacacaggcgttgtttgcccacattggggaaccgacaacgaatgtcgcggtgaaaaggaagccttcggctaggtgtaaaagccaaggaaatctcgggccaatgtccctacttccaaaagggctagtccca

SEQ ID NO: 596252 - DNA, 107 bp, Homo sapiens
tctgagcagctgtgaagctgcaggagccagttctactggggttgataacggatggtgatggctgacacttttactgaatgtcggtctttttttgtgattattctagt

SEQ ID NO: 596253 - DNA, 266 bp, Homo sapiens
gccctaaataaatttaaaatctgaccatacccaggtcttgtgaggatccagggaaacaggaactctctaacacggctcaggacctaatcgcggtgagcaataggccaatttctaaaaatgtgaaaaatgggcccacccacagactcagcagctctaatgatatgccctgaaacgcagttcccaaaaggtgctctgcaacccctgtggctacctgaaacccttccaaaaacctgtgcagccaaaaggatctcctaaccactaaaacg

SEQ ID NO: 596254 - DNA, 310 bp, Homo sapiens
tgcaccatccggcgatgtactgatccaacatcgacggtcgtaaaccctattgttgatattgactctagaatagtggttgcgctgtttatcctctacggtaacttgttccgtctggtcaatttattggatcaattgagtatattagttcgctttgactggtcaattcttcacatgtactgctcgcgagcgttgggttctgctccgcagtgtcgtcccgaccgtaaatttcttatgcatgttcggttaactttaggacctgtgtgattgtttatctccctgataatgcattaataaattaaagctccatagg

SEQ ID NO: 596255 - DNA, 128 bp, Homo sapiens
tgtgtgtacgacgtaagagttgtaggcggcagcagcactagttttaatggacatgtacttatataggtatagatagggttgcaatgtttcataatgggcttgtgatatgtgtatagtactactaagtg

SEQ ID NO: 596256 - DNA, 102 bp, Homo sapiens
gaagcaaaaagtatactacattttccaagacaggaggatacagatagggaggaccataaagctgcttcaacatatattggttacatatctagttctagtagt

SEQ ID NO: 596257 - DNA, 393 bp, Homo sapiens
agcgtgtagtgagagagcaagagcttatctacaaaaaagaaaggccacgtatataaaaggtctaacaaaaagagagtaagcaagtgtctgctctcaaacagttaaacagctgctctcacattcctggatggaagtctccatggtgctctcaagccattgagtgatggtgctggcacacagcaaaggctggcctgttcagatcacatacgaactgaccaatcacttgtgatcctcagtgtcctgtgtgtgaggccaaacttgcccttgaaattgcccagtagaaggcccacagaaggatttggtgcaacaaagggggcggatggtgcgataagaatgctgggtcacatcccccatcagagcgggacctcaaactattctgcccaatagccccag

SEQ ID NO: 596258 - DNA, 401 bp, Homo sapiens
atagcgacaccgtacagatgcctttaaaaggcaaaagcacacgtgtgggtcctggtgagcacacagcaatgtacccatgaaggagataaagcaacgatgcttttgcttttttcatgaagtaagatgataggtggtcttccagtcctttttcgcttatttgagttttctacttaaacacatggaaatctgcatagcagaggtaaatgctttccaagcagcagacccccagtccttggtgtgtgaagcagtctgagaaggccatggataaagggaatgtgatgaggtctaatgaagaggggcaagagaatgtaggccatagttaacaagttggctttgactctgatgagatgccaagccctcaggagactttgagaagaggagtgactttatctgactttggt

SEQ ID NO: 596259 - DNA, 492 bp, Homo sapiens
catctagaggacccccaagccgtaatactgaccagactgttttgaaaaattagcaagagaagactggattgggaaagcatggtctacaatgggttgtgaaattctgaagctatgaagaataaatgtatcaactttggattatgaaaccccattaatgatttcctaaatacacttgaaataaaattgattaaactaaatttgggtccagtgacattactatgcactgcattaatccattatacgtatgtacgacttttttgtctttggttcaaattaatgacgtgagagtaggtgtgaagcaacagaaaatcaaaccagagaatatctgatccctaatacggtgaatgtatataatatggaggcataggtagtgcagctaaagcacggacattgatgccttgggtaaccgatgataggtataattttcttataaacatcctgggagtatgtctagcttaactgaatgaaattcaatggcccttgttaaaatga

SEQ ID NO: 596260 - DNA, 108 bp, Homo sapiens
  misc_feature (39)..(39): n is a, c, g, or t
atgtatcctgattactttgccacccccacacagtggaanaaactgcggagggaaagctgggaacgagaggttaagcagctgcaggaggaaacgccacctggtggtcct

SEQ ID NO: 596261 - DNA, 1074 bp, Homo sapiens
cctcttcctgagtctacacctaggtgtgacaacctggaattcggcattatgaaggcgaacaacctccgggacatgtagaccatgagattacagctgctacaatagcggtacatcaacgacttatctacttcgtagatctcattcgtgcctgactggcccaaggtatcagtgtccattagttcaatcagtgtggtgaatcagcgcgggtgcctcgattaaacgtcacacttggacggaatagtcgatacaaggaacggcgccacacgtgcacgtgtatgcgccggaaagccttggggtacgtgcctagaaggcatgcgaaagacgtgggggatcatagatacgactcactactagggccacgccctagagcaccaagcttccgtccccacctgggggtggcaacgactcgcgctctcctcgttctgcgcctcgtttggggagttcctgaggtgggacctccgtgagagaagcgacgctcggaaacaagttctccaacacgaccataggtggccgtcgatagctactccaaatcctcggcgcgctatcagctggaggttatcagcgcacatcaccccatttttttatatcacacttttgtgtaagcaaacacactcaacttgatctgcaaacgttccctcaatcacacactaaacagagcatccttggcccatgtgggacccaaggccctatcatctgttgaccatggttggacagcgatacgttccatagcggagggtgcggaagacattggaacggcttacgtgcttcccttgtcccccaaggtatgacgggcgttctacgaatttcttgtccaggcgcgattaggcgcatgaaagtttagaccgagcaaggagggacggccttctgcgtaattaaccatcggagggctctgtggacttgtttcgctccgaagaaagctaactaactagaggggtttgcccggaacttcgggtctcccgcacaacttgcctcccattccatggaagggatgagcccatgcttaattatcctgtcgataggttttcccctggatacaattgggggaatccatcagggaaccctgaaccccttacc

SEQ ID NO: 596262 - DNA, 278 bp, Homo sapiens
acggtgcatgatggcagagcgtgcccacagactcggctctcgcaccggggcaggagggaaccaggtgagctgtgcagcccacaggctgggcgggctgggtggccaccgccccccaagttggccacgctgagtctctgggcgagtggctcccaggcgaggcctggctgagccggccgagccccctgtgtaccccagggcagactgtgaccccctgccctccagtccccaagaaccaggcctgtctccactcataccacgccacctacatgtgaccgtcg

SEQ ID NO: 596263 - DNA, 155 bp, Homo sapiens
  misc_feature (20)..(20): n is a, c, g, or t
atatacagttcgttggagtntttaccactttttttttgcagttacctagtgtaaaattaatattgggtttcaccttatattacaggggttcccttaactcccattgaacacctatttttcccggacattggtttaccccttttttcttttggaaa

SEQ ID NO: 596264 - DNA, 959 bp, Homo sapiens
  misc_feature (92)..(92): n is a, c, g, or t
gagcggggggatgaccagggaagccaggtggtcccagggacagaagtggcggttgctgacgcctggaaattcccctgaaggtggagcaccanccaatccccctgggtccaaagacacttcacggcccgccatcaagccacgcaccaagcacaccccagagagtggcacgcggctgtacgcgcaggggcagattccctagagagacacgcgatacagaggcgagcgcggccagaggccgaagaacacgagcgtgcaggccaagcacaagcgaacgcacggcgacggcgccccagatcggaggagacactgcgcagcgtgcccacacaccacgcactctggcgacaccacaacacaggggatggacgagacaacacacagcaacaagagccaaacaacgagataacaaggagacaagacacagaacagcccacaaacacacaaacgagaagacaagcagcgacgcctacatatgcgagccacggacccgaccgaacccacacaggacaacccaacgcacaccaactacagacacaacacaccacggacagaacagggacgacacgcaccaccggacccaagcaaaaaagacagaacccacgcggaccaatcaggaccatcaaacggcacgaggcaccaacacagaagacgaggagaaccagcacaaagagcaggacaaggacagagaagcgcatgaaaccaaagcaagaagaaagaagacgacgaaaacgaccgcaaaagaaagcacgcagaaagcaacacaccaagaaaaacagcgacacaggaagacaaaaagacaaactacacaagaaaccagtaaaagcaaaccacaacagacaaaaggcaccaagaacaaagagaagagaacaacgacaacaaaaaaaaaaaacagagcaccaaaaaaaaacaaaaaagaagaaagagagaaaacgcaaaacacaagacacaaacgcaacaaaagc

SEQ ID NO: 596265 - DNA, 1102 bp, Homo sapiens
  misc_feature (1023)..(1023): n is a, c, g, or t
  misc_feature (1033)..(1033): n is a, c, g, or t
  misc_feature (1050)..(1050): n is a, c, g, or t
catttgtgccctctccccggtgtggtgttgctaaacacaatgggggcgccaaatgaggtggtgaagatcggggcaaggggggagagtacaaatcggggttgcttgtaaggtgcccgcgattgggtgagagtattctaaagggggttcaaatgcaaaaagcgacccgtcatttttattgtagtggggcggtttcacaaaatagctacaggggcagaataaaacgccggttacagatgaaaaagattactcgacaagcgtgttcgttccagaaggttataagagtgggacacagaggggggggggggggcggattatatttttgtgtataactgtgtgtccaccctcctttttagtgcaacacgggctatccaactgtgtaataacactaacccctctatgtgtatttcaacagacaccacactacacgaattttaaagggggagacaccctatattatgagaactccgataaggagttcccacccacaaggtttgttaccacacaaaaacccaaggccggttgtgataaactggccggcgcccccagtatacactatatataccggtctcctaaaaggtgatatctgagagcgccacttgggtggcggagaatttctggccaccgagggccccgggttgtctctgcgtcttgtcgtgtgggagagggtctattctctataggggggagaaaaaaccgtgggggttgagagaaaaaagagtctccttggtgctccgcgcgccacagaggccccaacagcgcgcgcgcgcctctgttctgcacacatgctcctctggagaaaaatttgagaggagaaatctacaaggaactttctctggtcaccacgcccgagcgagaaaggagatgcccaaatttgtctacagagtcacaagagaaaaataaaggagcacaacgtgagaagtttaaagtttgagatgcacgcaagagataaccctttaacacaccctggtcaatcacctgagacacaagagaaggcagaggaactgaagccgtccctgccccccngtttggccantgaagggactgaaatgnacccagacaccctgattgggactgtattatatttaaatacttaaaatccaaa

SEQ ID NO: 596266 - DNA, 407 bp, Homo sapiens
  misc_feature (338)..(338): n is a, c, g, or t
  misc_feature (400)..(400): n is a, c, g, or t
tctagcaggagctgaggttaagggctaccaaaaacaacagaatatacattcttcttggtgcacatggcacatactctaaaattgatcacataattggaagtagaacactcctcagcaaatgcaaaagaactgaaattataacagtctctcagaccacaggacaatcaaattagaactcaagactaagaaactaactcaaaactacacaactacatgaaaattgaacaacctgctcctgaatgactcctcggtaaataatgaaattaaggcagaaatcaagaagttatttgatactatgagaacaaagagacaacataccagaaatctctgggacacangttaaagcagtgttaaagagggaaatggatagcactaaattgcccattattcaaaaagctangaaagat

SEQ ID NO: 596267 - DNA, 433 bp, Homo sapiens
  misc_feature (339)..(339): n is a, c, g, or t
  misc_feature (354)..(354): n is a, c, g, or t
  misc_feature (364)..(364): n is a, c, g, or t
  misc_feature (381)..(381): n is a, c, g, or t
tctccggtggagaggttcttcttagaggtgtaaacacgtgggtggagaaaaggtctctctggtctccgccgccccgaagccccgcgcgccgccctctttctcgcccactgtccctctcgtggaaaattgtgagggaaatccaagagacatctcctgcgctccaccagccccgcaccaaagggaatgccccaatcctgctcaggatcccagaaaaaataagagacccacactgtgaagagttttaagagttctggaagccacccagataccctttaccacccctgggtctcatccacctgcacccaagaagaaagagccaggagaaaactgtgaacgacncctccctgccccccngtttggccantgaagggactgaaatgnacccagacaccctgattgggactgtattatatttaaatacttaaaatccaaa

SEQ ID NO: 596268 - DNA, 241 bp, Homo sapiens
cgatttgtaccggtagtatacacttagctttccttctggcttgttctttctctgcatctagtctaggcaaaatgctgtaacatggcactattttaggtcacctagggtatatcctggtgtgggaatctacacgtctatctagaataacgtgttctttggtcgtatacttgacatgtttgtttatgcttctccagtggcagcagtagtggtaactccttgtgcaccacactatattatcggg

SEQ ID NO: 596269 - DNA, 532 bp, Homo sapiens
  misc_feature (400)..(400): n is a, c, g, or t
atccaatgcccgtagacagcgggggaagtgggattccagcctttcatttattctttcacctatttgttctctttactctgtgtacaaaaaagagaggattatactatcatagactgttgtttctaaacagaaactcaggctgggcacagtggaatacgcctgtaatcccagcactttgggaggcagaggcgggcggatgacttgaggtcaggagttctcaaccagcctggccaaaatggtgaaaccccatctctactaaaaacacaaaaattaaccaggcgtggtggtgggcacctgtaatcctagctgcttgggaggctgaggcaggagaatgaatcgcttgaatccaggaggtggaggcttgcagtgaagcccgagacccgcaccaactgcactccangccctggggcaactaaagcaagactctgtcttcaaagataagaaggaaagaaagagagaggagagggagagagaaagaggaaggaaaggaaggaaggaaggaaggaagcgagcatcccatcactgagactta

SEQ ID NO: 596270 - DNA, 321 bp, Homo sapiens
cccccaaaagaaaagggggggggccccctttcccctcccctccggggggtccctcccctttaaaaatttttttaaaatagttcccaaaatttgatttttgaaaacccatcccagccgggggaaatggggatccctaataagtttcttcttttggatcagcttgggttgggcatgaaaaattttttttttttttgtccccccttgccccggggcaaattccatccccggggttttagtccccctgcccagccccgggccctggcttttgttttggttgcggttcctttttgtttcaaaataaaatcctttttggggccccca

SEQ ID NO: 596271 - DNA, 901 bp, Homo sapiens
  misc_feature (511)..(511): n is a, c, g, or t
cccgtcctttcgctatgaagagagcgacctggagcggggatacacgaagtgatcactttgtaacgtatgagcttctgaaagagagagaccattcaacttgaaatataaggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttatngaaggagtcctccatgggatattttaccctcatctacagcccaggcatgcctggcccatattgctctacaggttgtgcattgcacaagtccaagcagtgtcattcacatggaccacagtgttaatagtattccaagtcatgcttggaaccctgcacttggcgaactatcaaaaactttaatcattcaaaccatggattcacaggcaatagacgaacgtacaggaccagagaacaggatacccgagcgaccggacccggactcccgtccaatccccattacccaccttaacgtcaggatgttcgggacctcatttgtccctgcctggttcctgcacctcgcgtcttttgcctggactgtcctccgatgcttcccttatgccgtgcctttta

SEQ ID NO: 596272 - DNA, 813 bp, Homo sapiens
gcggatgaagaagcagaccaaggtggaattgccgcaggaggcccgagatctatgaggagagactctacgtcctactctatgagactccccgcgtcccgacaagtcctgctgggaggccacaagccgtagccgcaggcagggttcccgccagtgaagatgaggagacctttgaactgcgggaccgggtccgacgcatgcacgtcaagcggctacagcagcttacgagtgaaccggacagactcaggtcaccgagatcgtacaccatcgcgatctgaccaggacccatcaggggagatcaggggcacgggaggccctatctcgcgcagtcctgctggaaacccgaccccagttggtccaaccaccaatgtgctgacgtggcctgcacatgtgggtacatcctgacgtcctaggcaacccgagagcgcagtgtacaaggggccactggcgtccacggatgagtccacgaagaggtcctagaggcgacgaaggatggggaccacgattcgcccatgccgttgcgcccggtgatgctacgtctctcgggagacctgcggtgctggtccctatcttggtcaccatcatccttcctgcccgagcggaagcatggttctggtccctgggggcatatgggactgacccaactcctgctgagaagcttcccctaggccctgtgcagaagggcgtactggcccttagcggctcagcctggggggactagggcgcctctggtggctgtgaagggcccctggtgcgcaccagctagggaccggcgacatccacctacgggtgacacatgcagccggcattgcatcc

SEQ ID NO: 596273 - DNA, 81 bp, Homo sapiens
gccgactccacattcagaagattttgtggagaaactcagtgagttaggaatgaaagagactgatgaggaaggcagtcgacg

SEQ ID NO: 596274 - DNA, 897 bp, Homo sapiens
  misc_feature (511)..(511): n is a, c, g, or t
cccgtcctttcgctatgaagagagcgacctggagcggggatacacgaagtgatcactttgtaacgtatgagcttctgaaagagagagaccattcaacttgaaatataaggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttatngaaggagtcctccatgggatattttaccctcatctacagcccaggtagaaaatcctacatggctaaaagaagcagaagcaagtttcgaagtcacagtcaaggaaatcaatactaccaatttaacctaaacgctatgatatataacagctctagctagtggtaagtgcccagtcccaccttaatcaggtcaggaccattccattagaatggttctcttcacacatagaacctgaccggggcgagggtcgagctaagccagggttagaagaacatgtccgccacgtaaaaccagaaaggggcaaggaaaccgggacacgggtggcaaacaagccctcgttcaagccatttcatgaacaatcgcaaacggagaacggagaagtactaaa

SEQ ID NO: 596275 - DNA, 719 bp, Homo sapiens
gtgggctcgtgggttggcatgtatgagagctgtagtggcccgagtgttcgagatgaggggtgatctacggtggatcccaatggcttgtcgtctgagcgtttgacgcagatagccggaggtgcggggcacgatcgaggcactggctggggataggagacgggcggtcgcccagtgcgtttggggtgaatctgatcgtgggcgtcgatcgtggagtttcatggtgtcgtttgcttggaactgatcgtagctcgtggcagggggaactcggctagactgggcccacaggcaaccatgattgagtcaataacaactgagtagtaagacgttcatcgccgtgttatccttgagtaaatgaagcagggctttttgcgcaatgttgtccaggctggtcgtctacgtcctgtggctcaagcagtcctcctgccatcagtctcccaaaggtgctggaagttacagggaatgagactctggaagcccagccagggacaatgcacctttcacagagattctgaactaagtctgagtgaacggtctaacggtttggaatctccccctcatggagagaagcttgtatggctgtcatgcttagacagtgattcctgcaaggtaagaccgttcaggctggggagaggtggagagccatgccatgttcatccttccattgctatggacattttgcttgacagcaaaaatcttcccgcttggtgctgggcataatc

SEQ ID NO: 596276 - DNA, 756 bp, Homo sapiens
gaatggaatcacacagtatgtggttgactgcaatcagcttctttgacttagcatgttttcaaggttcatccatgtcgtaacagagtcttgcttagttgcccaggctggagtgcagcggtgtgatctccgggggtcaagtgatcctcccaccttaccctcccaagtagctggaactacaggcacgtgccagcacacccaactaattcttttgctgatctcaaactgctggcctcaagtaatactcctgccttaccctctcaaagcaatgggattacagtcatgagccaccatgcctggctcaattttttctttatagtagcaaacattttgataattattatacttaagaaagagatacagatgtcttttagttcattccctcattattagcatgttaaaattatactagttggataacttgatattctcattcttttttttggagatggagtcttgctctgttgcccaggctggagtgcagtggcatgatcttggctcactgcatgcaatcttctgcctctcaggttcaagtgactctcctgcctcagcactcccgagtagctgggactacaggcatgtgccactaccgacgactgttattcaataaatattagggtatttacaaagaaagaaacaggggacacaaccagtgtgcggacaggccggaaccacaaacatccggaaccctcggggaaacacaacccaccataagccaccacaagaaccggggacatcgcgggacatgagccaccaaaa

SEQ ID NO: 596277 - DNA, 362 bp, Homo sapiens
actctctagagatcccggttcgccatgtttccactgtgatatccacgtgcccccaagacaaatatgatcaacatttacatcgttagatatcacatactattacttctattttatcataccctatgtatatgagttagttttcatcctgctgttaaagatatacctgagactgggcaattgacacaagaaagagttttaatggacttacagttccacgatatgtgggaaggcctcacactcatggtggagggtgacaagtcatgtctatgtcgtgactgacaaaagcctagggcttgtgcaggccaactcccctttatataatcatcagatctcgtgacacttattcactattttgagaacag

SEQ ID NO: 596278 - DNA, 1490 bp, Homo sapiens
cagaacaagcccgacagtggtcgatgctaacagcacgatcacttcagcgttacacacgctattctctccagcgtggacgtttaagtctgatacgtgcaagccaacgacgttaaatcaaccagctcattagcaagcaagcaacgcgcaacaactgtagagatgaagtatcaggcacacgctatgcacgcctgcagcggcaccaacttgcaaccgcattctacgcagatcacaccactacctgcagactggctcgctctgtgcggcatatgcaggcgccggatccagcattcaacacggtggcgcacctcatccgctctgcattgctgaacatactggctgccacatttcctctcaccgcaaccagcccggacactgcacaaccgcctggcccgacgcacgcctcgcgcgggccgtcctacgcggaaacgcccaacactcagataaccgatgcaacgactagcgcagactcggaaacctctccgacaccatcgagatgcagcgaacccgtgctgaccggctacctgacgaccgcgctatagccatgcgtccttggctcacacaccacacgcccgactccctcatcacctcacgcgtcgatcacttgcaccgcccaagtctactcgggccgcaccactaacggcgctaacccggcacccttgggcagctcactcgaggtctcatacccagtccgaccctcaggcatcggacaaacaacccagacaaggcactcaacccataatccgccctaggacacgagaagcgaacacccgcccgagacgcgactgcacacaacgccagaaccccaacaccagccctcccccggcacggacgaaccactacaacccgcaaccacacgccacagcaaccaaccccagaccgaccgcgacaacccaacaacacaagcacacagcagaagcgcacacccaacccacggactaccacaagaccccgagacatccaccacctgccaccagcacgcgccaacacaaccgcacaaccaggaccacgccccactagacaccggcccactcgcaccgatgcccacaaacacaaccggcacaccgcgcacaccctccagcccaaaatatcccacaacgcacacaagccacacagcagccacaccgccacggccacacaccaacgaccacgcacacacacacacccacgcaacacacgaccagaccacacacaaggcacgtcaacacgacacgaacacagagcaaacagacaacacaaaggaaaaaagaaaaagagaaaagcaaacaaaacaaacaggaagaccacagagaaccacagcaagacgcgcaaccaaagcaacgctacagaaccacccgacaatcacaaacatcacagatagatctagcagatcacacagccaacaagctaaaccacgccaaaccacagacgagcgaacgagaccaacggagagcaaacaaaacacaaacgtacaaccaacccacgctcgagacacaacaacacacacacaacac

SEQ ID NO: 596279 - DNA, 403 bp, Homo sapiens
  misc_feature (208)..(208): n is a, c, g, or t
  misc_feature (223)..(223): n is a, c, g, or t
  misc_feature (246)..(246): n is a, c, g, or t
  misc_feature (256)..(256): n is a, c, g, or t
  misc_feature (271)..(272): n is a, c, g, or t
  misc_feature (285)..(285): n is a, c, g, or t
accccagaaaggaggggacccaggcccagtgaggggtacttcagtcaatcacaggaggaggagtttgcccaatcggaagagctctgtgcccaagccgcctcctgtgttctacaacaagcctccagagatcgacatcacatgctgggatgcagacccagttccagaagaggaggagggcttcgagggtggtgattagcggtggcgccancctaggctacccttncaaggccgcccacctgcattcancttctgccangacgcccgccgtgcnnatttcgcaagcantccgcctggcacccactccggattccggccctggctggggacttggccgcttccctaccacagggcctgacttttacagcttttctctttttttaaaaagttgataggagacttgtaa

SEQ ID NO: 596280 - DNA, 329 bp, Homo sapiens
  misc_feature (25)..(25): n is a, c, g, or t
  misc_feature (290)..(290): n is a, c, g, or t
  misc_feature (304)..(304): n is a, c, g, or t
ggtttgtggtctctgagtggatttnagccttcagtcatcggttgctttatacgtgaggttactagattgagacaccatttgtggggggaaaaggatgaaggatactcaaaggctaattgctacttgaaggcagaaaatagggaaaaacagcaaaaagactgcagttagcctctgctcatccttcctctaaataaatggtcacttgattgtacatgactatgactgccgcgtgacctggggcaaaagagaacatttatcattgaaggctcatttgctgtacagcgtgtgtnccacaacagatggncaaagcattgtttttataagatgga

SEQ ID NO: 596281 - DNA, 463 bp, Homo sapiens
taccagtttaatagttttttacctaacttacaggtccaaagggcaaatgacttgacccctttttttccccaatcccttgaactttttggatttaaaactttttttaggaaagcaaaggttaaaagccaaccgtaactaatttccaaataaagacaagatttcaaacctgaatttttttttgatagcaaaaggtccagtaaaaccaaaatttcttttctccacagtttacctttccatttaaaacttggatagtttaacccttgaaactgaaaaatttggtttcaggctttaaccaaatttaattgtttttggcaggtaagtacaggctttggcaaagttaccaacttttttggtcaacaaaagtaaagacaagtggataattttttttaggggagctttaaaaacctgtgagaagctcacattgactttttggccctccgccacaaaataaatactttttttg

SEQ ID NO: 596282 - DNA, 384 bp, Homo sapiens
  misc_feature (364)..(364): n is a, c, g, or t
attcgacacgaaggcgatgctaactaaaattaatctcttcctttaacattatataaatatatagttgactttatttctgaaattcagatgttccctaaatgactatagggcattgaattaaaacatactgtacaaatctgtagagagaaacttataagattttagtaatttgactaaagttgtcattgattcgactagttttgaccttttttaacttcctgcatttaaattgggaaacaaatattttgctatctcttgaaaggaacaagtaggagtttatttcccactgactcccatccaaaggggaaacttgacttccatggatttaatgctaggttttaaacaaggggaaaggccgcccaangcacatttttattttattaa

SEQ ID NO: 596283 - DNA, 772 bp, Homo sapiens
gagaggggcccgagccacccggtccggcgcgtcccgcggccgcggcggtcccccgccgggccgaccgagccgagccgggcggagcgggggtgcgcgcgccgggccgccatggacccaaaagcggttggttgcaggagcggccgccggctaaaatctggaagggccgggcaagggggataacggcgtggcggcccggaagggggtaacggggggcctattccccggggggggcccagggaggcgacgccactaaaacccataaactgtcggtcaaacgagggaataccacaaccaactctattccccgaggggggtttctacaagagaatttcacaagggggcgcgggaacctaggtcacacgcccggggttagtcacgggaccaaaactctacataattcgggggactacgaaatagagaagcggcagtctctacatggggttcaggacagagggctatggagtgtcgttgctgggccgggacactgggatttcacaccctgttttcgtggggccaagtactttcacggagggcacatgtaagattcactcgtttcccccctttgtggggctcaaccattaggggcattgtaatcgggccttttgagcacagaacgggccacattgcatgtgctccagccaaaactgggttggaagcccatatcttttccgctttgacagcgggcacacacacataagcgcccatggattttcacataacaccacaggcctcctctttcgtacccacacgatcaacattggttgtccaccac

SEQ ID NO: 596284 - DNA, 119 bp, Homo sapiens
tttgatatggctgagttgaagctgggcagtacatccacaggaagagtggtgctggtcagagcagacaggcccaatgcgccgggagtagaggcattagatacagccccagagctcaggca

SEQ ID NO: 596285 - DNA, 312 bp, Homo sapiens
agtaatattccatctctcgatgtaccaaatgtgttatcccctcacctcctgaaggatatctcagttcgcttctaagacttggcgattctttaaaaagctgctgtaatcatccatgtgcaggtttttgtatggacataagttttcaactcattcaagtacatgctaaagagattactgcatcgtatggcaagagtgtgtagttttgtaagaaactgccaacccgtctttcaaaacagctgtaccattttcattccaaccagcagtgaatgagagtccctgttattctacttcctccccagcacctgatgttgc

SEQ ID NO: 596286 - DNA, 130 bp, Homo sapiens
cctctgtcagtgtccagtagcccctgcgccctctttcccagcctctgctactccagagtccctcctcctcagacctgagcaagccaggcgaaaccccatcgctacaatatctgagacctgagcaagccag

SEQ ID NO: 596287 - DNA, 281 bp, Homo sapiens
gaggatccctgcagaggcgttagctggtgggctgcagaaaatggttgccttgtctacaacaaaacaaatgttaaattcttggctagtacgacagactgccttcaaattttagcttatggcaccaagaaagcaagctcatcatactggctagtggtggaccccacagctttagtaaatataatgaggacctatactttacgaaaatactactgtggacccccaagcagagtgcttgaagggtcctaatctggtctgctctagtaattagcccggctattgta

SEQ ID NO: 596288 - DNA, 284 bp, Homo sapiens
aaagggggggccccctttgggccccccggggcccccaaaggaaagttccctccggggggccccccccttaaaaatgggttagttgcccccaagggggactttttccccccgggcccctttgggggggtttttttgggccttttttcggtttttttccccaaaccaaatttgttttagttcccttgttgggaattttggggccgggtttttaagggtttttttttttacccgggtttttccccccggggccttttttttgggaaattaaattttttttcccccca

SEQ ID NO: 596289 - DNA, 399 bp, Homo sapiens
  misc_feature (160)..(160): n is a, c, g, or t
  misc_feature (180)..(180): n is a, c, g, or t
  misc_feature (198)..(198): n is a, c, g, or t
  misc_feature (211)..(211): n is a, c, g, or t
  misc_feature (216)..(216): n is a, c, g, or t
  misc_feature (375)..(375): n is a, c, g, or t
ccagctccttcccaaacccccatttaccattggcttttggctccaccgcacatgcagaatcggaacttaatcacagagcaacagttggaaatcttaggcatttccactaatccagataccaccctctctttgcactcaactcttcaaccatggtgtgtanaactacaacattcagttcanacattttccgttttaatntgaagtgataaanattcntgatttttatagcaggaatgtagtgctataagcatgtaatgttttcaagtatgtgaaagtacataggccagattatttgaaatgccctaaaataggataacccctctgctcttctcactctctgcacattgtccagttatgagtctctgtgtcagttcngtagacgcgcccgcgaatttagta

SEQ ID NO: 596290 - DNA, 581 bp, Homo sapiens
ttccggcggtgacgacctacgcacacgagaccatgcctttggcaagggatctccttaatccttttccagaagaggagaagaggaaccacaggaggaaacgcctggtgcaaagccccaattcctacttaatggatgtgaaaggcccaggatgctataaaatcaccacggtctttagccatgcacaaacggtagtttggggggttggctgttccactgtcctttgccagcctacaggaggaaaagcagggtttacagaaggatgttccttcaggaggaagcagcactaaaggcactctgagtcaagatgagtgggaaaccatttaaataaacacattttggccaaaaaaaaaaaaaaaaaaaaaaaaaaaaaccatgtcggccgcttgggccaagtcgactttagactcgggcaggctaatgcatgcggccgaaattggggctaattgggccaattggccctatagggagtcggattacaattaattggccgccgtttaacaacgtcgggactggaaaacccctggggtaacccaatttcgctttgaagtccccttttcgccggttgccgaataccgttggcc

SEQ ID NO: 596291 - DNA, 127 bp, Homo sapiens
tgaggcgacaggaactctgtcttcacttccaggacctccgctcctataaaagcctggctggaggagttggctgagagcaaggtaggcctcagagttgtacggatataacattggacgagatcaggtt

SEQ ID NO: 596292 - DNA, 224 bp, Homo sapiens
aggctccagcttaacgatatttggatgtcagcacggtgctcacgtgtcgacgcgaacttgtactgggaggcatgcaccgtagtggtgtatacacgtcgacctggctccatgtttacgtgcttgggacgtccgcacggttctcacgtgtccacggaacttgtccagggaggcatgccccgccgtggtgaatacccgtcgagctggagccatgcctgcatgctcgg

SEQ ID NO: 596293 - DNA, 322 bp, Homo sapiens
tgtggtagtctagaggtccccgagtgggtcctgcagcctgatatttggccaatttagtcctgattcccgacgagctcaatagcagtgatttgatttctccaggtgtgcagcatctcacgctgtagctgacgccgtgctgtgctggcagttctcagggatggcccctcctgcatgcaggattgtcatcagctgcttcatgagtcagaggagacctttgaaaggtctcagtgtggccatgagtggctctgcccacccattccttacaatatttgaagggagtgtaaaaacaggagggggaacggctgtttatgagggtggatgg

SEQ ID NO: 596294 - DNA, 509 bp, Homo sapiens
ctttttaaggagggagtcatggtggccaagaaggatgtccacatgcctaagcccccggagctggcagacaagaatgtgcccaaccttcatgtcatgaaggccatgcagtctctcaagtcccgaggctacgtgaaggaacagtttgcctggagacatttttactgggcccttaccaatgaggggatccagtatttccgtgattaccttcatttgcccccggagattgggcctgcccccctaccccgtaaccgtccaaaaattggcaggcctcggcctaaaggtttggagggtgagcgacctgcgagactccacagaggggaagctggcagaaaatccctccagacggagtgttgggccccctggggcccccaaaaaaaccgaggctgggggtgggtcaccaaccgaattccagtttaaagggggatttggttgtggagggggtcaccccccccagtaaaattggaggggatttttttgccttgaataaacttccagccaaaaacccttta

SEQ ID NO: 596295 - DNA, 127 bp, Homo sapiens
tgcacggtcccagccatcaggacatctggtccatggcgagagagccatgtgttgtcggtttggctttttctttgttattctctttcggacccggttgttgtgtgttctttgagtgctgccagtccca

SEQ ID NO: 596296 - DNA, 741 bp, Homo sapiens
  misc_feature (679)..(679): n is a, c, g, or t
  misc_feature (691)..(692): n is a, c, g, or t
ggcctgagttaagtctgcgtaaggacgatagctggaagtgcttcagtgtggggagcatggcgatgttgttgcagcagcagccttttactggcgcatatcgcaccgggaagccggcctgagctaatgagggccgacgtggatatgctcaagcattacgtcccaccaaaacccgaaacagctattgagcgtgacgacagcgccttggcgtcggtacttcaaaaggttgcagaggctttaccgtatccttccaaggatgcattggcgtacctaggcggccgtggaatatccgagcgtgtagctcgggaagcttgcgatcgcggcattctgatcacgatccccaacgacccctgtcaggcaaaagcatttttgacggaagtggccggcaaggaactgatggaaagggctggactttggaaaccagataaaaaagcaccagcgtgtgcgttccgaccgctctggtttcgctcgcagtcacactgtgccgcggaattcaggcttatgcgtgaacccagagagggggagaaaaaagccatgcgttacggtggtaaatctccatggatttgggaaggtgaacacactgaggagtacatgataattgaaggtccgattgacttgctctccgcagttgagatgggttcaaaacgaactatcttcggccttcctgggtgtgaaactgggnaccgactggttnnaatgatggctgaagaacgtgtcatgcgcggatctgacagctggtttgcg

SEQ ID NO: 596297 - DNA, 196 bp, Homo sapiens
tcatgcctcagagccagccattgccctcctcgcccgcccagtcacccgtggtctgacctcagagccataacctgtcactcgtctagctatgagtttgtccagtcacgacgttgttaagacggcagtgcctagatatatacgactcatatagggaccattagaaaagtggtcggtagttgggccctcgagggtatct

SEQ ID NO: 596298 - DNA, 893 bp, Homo sapiens
gactctggctgcctagcctggtctggggaagatgttgctaccatatctccctagaggcgcgaaatgctggtggaatcgcgtcgagttcgggcccaagcttggtcaacaaggtgaagcaaaagctcttcagcgagggtggaggggacctgcacagggaaggtatgggttggtcaagtggcgtgatcagcagcacttgacgaagtactaggtgcgtgggagtgatccagaccaggccgaggctttggtccttgtagtaccagtgaagatacaaggccagttgttttccggcgcattgtaaaggggaggtcgtggagtgctgttgtacagctcaggtcaacgaaggttggacgtctatcacatgaaattgggcccatgttcttgcttcatcatctcgagattccatcccttcagagatggagtttgatcctaactccaaaccaccatggttacaagacaatggatgaggatattgtgattcagcaggacgaatgagatccggttaaaagcacttgtggggacccgtgtggcacaggaatgacagtagatcgcgatggtgctcaccgtgactggaacgacttactttggcggctatgtaacgcttgtagctcgtaggtgggctcggtcactaagccttggggatcgcatagctctacggaagtgttgattggtcagcagacaatagatgtagtccaaaggtccacgtctaggcctggcttgctagcgaggagggacaaggacaaggcaaacctcaatccccaagaaaaggccgtcttggactgctttccttggtacgccttaggctactggacatccctcaatatttccaggggatcgtggtatctacggcaatcaacaaggtcgttgcgtcctccaggaagaacagataccacaac

SEQ ID NO: 596299 - DNA, 151 bp, Homo sapiens
cttatatttgctcaatagagttaatatgctcgtgcttgaggacaatatattgatatgcttggcacacggtgattcacgtgtggaagacttctttaaggtggagatcgagctatgatatcgtggacagcttagcgtgagtcatagatatgcc

SEQ ID NO: 596300 - DNA, 260 bp, Homo sapiens
cctgagtgaaggagtgcaagaggcagatgctgacggcttcacacaccctggccactgctccctaaggccagcctggtccatgcagggggctcctgggggttggggaggtgctcacatggtgcccctagcctttatatatggacatggcaggccgatttgggcaccaggctattcctatcccttcatcttcggcccatcagatgctcccttaatgcacaaggaagctggggagggacttttttttgggggatcaggcagcc

SEQ ID NO: 596301 - DNA, 294 bp, Homo sapiens
ttgagaatttagctgtaatatgctatctttttttttatccatatatccatccctggatatgtgcattgcttctgccttttggttactgtgaagaatgctgctgttaacacagatgtacaaatatctgttcaagtccctgcttttagttcttttgggtatatatctagaagcagaattgctggatcatatgataattgtacttttaattttttgaggaacctccattgtgtttttcatggtagctacactattttacattcttaccagcagtgcacaagaggtccaatcttccgg

SEQ ID NO: 596302 - DNA, 1462 bp, Homo sapiens
  misc_feature (1)..(1): n is a, c, g, or t
  misc_feature (1045)..(1045): n is a, c, g, or t
nactcccgcggcgtcgggtttacacccaccgctggtccgccgggatttttcctccccccgcggattaattcttgtttcatgactcccccacacgccgtgttctctccccgggaaatcgccctcttggtgtttattcttctgtgtgggcgtcccccctccgtggggggaggcccccttttccacactcgttgttttaagggttatattgtccacgcgatgttgtttcttcttcccccctctctttgaggaggttccccttcctttggggaccgcgtttttggtcgcgcaattctgtaaccccctcggggggcttccccgcgtcgggcctgtaatgtcaccctttccgcggcccaagccccggttgttttaatatagagttccacgccccacaaagacccttgggggggggaggggcctccgcgaggtagccccgtttcttctggccctacgccccccccactgagacgctcgtgtgtcctttcccctcgggggcccctctctgatttcgctcgcctctttggtgaatagtcttctggtggcacagactcggggattttcctcgggccgcccttttttaacacttcttgtgagagcgccctttctcttttgggacccctcgcaatattgccctgtttgtgttggtgccgccgccggcgttagttctcccgaggacccacattctcgctgtatgacctgtggggacactttctgttctctcacactgtgtgtcacccacactcaccacaaagggtgactctccacagagggaaaagagaagacctccagcagttttgcgcccagacacatatatagagtggcccccacaagagacccccactctcacccacgaccatctctggtctcctctctcagagggtgtcctctggcgacccagagagaagtctcttaccaccacaccgcacatatagggcacatataagagatgtcctgtgagatatccggagaaattactcacagagaatacctgttaactctctcttttgtgtgtgtgtcacagagatattgtgtcacactcacagcgtgnggcctctctgtgtgaataaacgcccacagagaggagatatatagaggcccacagagaaggtgttgtttctcgtgttatgaatggcactctctctcggcgctctaattctctcttgtgttatgtatatactcgttggtgaccacacaagagtgttgtgttgtacacaccacacaagagaaacttaaatgctgcgtgattaaatataatttccacacggtggtgttagagctctcacacttggggataagatttcccacaagatgtaaggattttgttggagggaattaagatgccacaatattttttttgtattttaaaaaatttctttggaaaacttcttaagattctttgtggttctgccacatagaaattgtactccttgaccgttgatagattaaatatttttccatccctcca

SEQ ID NO: 596303 - DNA, 996 bp, Homo sapiens
  misc_feature (703)..(704): n is a, c, g, or t
  misc_feature (827)..(827): n is a, c, g, or t
  misc_feature (845)..(845): n is a, c, g, or t
gtgtttcagtcgtgtcttacagtagtaaccgccagagtgtgcatgtcggaaagaggtctcatgaggctgttatcaccgtcatggcctagaattcaggttaaggctgtctgatactagggagtcgacggtgtaaaatatagatcatatgactctgggacacatgagaattggtgttataaatgatggtatggaacaaatgagttatggctcaggtttatcgacgatgtaggagtatatggtgggtatagtgaagacgttgatgtttttgaatggggtgtataagaagggttatggccatatgcagtgatgggaacttgttgaccctaagtgttggcataattattcaattcatggctatatactatgtagagtatcggatactagacggagactagtacatggatatatcaacatggactgtatgtaaattgtcttgcaaaggtgacccaaactggcggggagtgaaaagtttaacgaaaaggccctcgtaatgggtcatttagtgggcggagcgtaatttcctctgacataaactggctgattattttaccatagttgaaaaatcacgagggatcaggtttcagggtccactgggcatgtaattgatcgcattgcacacttcacatgtttgttgcagcgtggatcattcgtggaggaatagcatacgctagcaacgcacccatttcgcattagcatttattcnntacatatttgtggtagcgcccagagggtggtctgttttctcaacagtgggagcaaagggtttcttccatcggaaggaggaatgggttttcgtttaaccaaggtgtggcgcgactctttggggncgattcgatttccagacncagagggggaacagaaaggcaaagtgtccaacttcaaagaggtggatacggtttggtcgcgtggagagagaggcaagagacgtgtgatgtttattttcttccacattcgtggttatttaaacacgctgatttggagtatgcttattcagaa

SEQ ID NO: 596304 - DNA, 654 bp, Homo sapiens
  misc_feature (20)..(20): n is a, c, g, or t
  misc_feature (30)..(30): n is a, c, g, or t
  misc_feature (546)..(546): n is a, c, g, or t
  misc_feature (548)..(548): n is a, c, g, or t
gctgggtgactctacaggancctaactgtnaggcggattgaaccgcccactgtaagcggattgaaccgttcactgtcaaggcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggattgcaaccgctcactgtcaagcggatgcaacgtacntnagcgatgcaacgtacttaagcgatgcaacgtacttcagcgatcaaccattcaacagatgcacgtcattcaacgatcacgcacttaacgatacacgacttacgatgt

SEQ ID NO: 596305 - DNA, 208 bp, Homo sapiens
ctgttctcatgtgtgacgatggcatagtctattgcctcagatctgtaacgaaacgtacacgccaaatatctcgagatctgcccttctcctttgtccactccaccccagcctatgatagggggctgccatttccccccatgtggccagggatgactcttggtagagcacccaggagctgttgcacacgagaacaagaccagttaggggg

SEQ ID NO: 596306 - DNA, 904 bp, Homo sapiens
  misc_feature (253)..(253): n is a, c, g, or t
gaaccctggaggtggcggttgcagtgagcacagatcatgccactgcactccagcctgggcaacaaaacgagacttcgtctcaaaaaaaaaaaaaaaaaacacttacgacattggggactcctttgggtcggggttctcccaaaatttcttttggagggtgtccaatgcgctcatacttgggctgcaagcttttggttttgggaaacccccttgcccagaaagtctgcatatatggctgggttcttcaaccttntgttccccaagggctgaggaacagaaaagtacgcctctgtttggaggagagggtgggaacggtgaaaggtattacctttaatttttttacacgctggtgaacgttggttccggggacccacactttttttacaaaaatgggcctggttttcccttacagttggttgtcctgggacaaggcgaaaacgttcataataaacgtattggtttaaccttggaattattagggaaatacgtttttttaacataaggggggctaattttgggaaaaaatttcgtggaggttatatgtctccaattggtttgtcggccaattacctttccaaaaggtaggcggtaaatatttcaagagaccaggtgggttggtggactcagggatgggtttaaagaagaaattttcgtgagaattttttcacattttcgaaagatatttccttattaaagggaagtgtctttgggaccttaagtttttaacccaaaaagatgtgacaacatttaattcttgtgcgacattttcccttcatttatcggggttaaccaagccttaggtttgcacaaccaaattaaaaatactttagggcttaaagaaaaagaacagaaccagcagactaaaaaacaatattttggtgggcggcttggcgctcgtagaaaa

SEQ ID NO: 596307 - DNA, 223 bp, Homo sapiens
taaattcgcggcctgtcgaccagaataactgttatctgtctgtcttctgcagtttgtcaatttgaggtggcaattgtttttcttgaagagacttgccctgttgcccaggctggagttcagtggcatgcatttatggctcactatagcctcaagctcctgggcttaggtgatcctcctgcctcagcctcctgagtagctaggtgctcgcctgtaatcctagtcg

SEQ ID NO: 596308 - DNA, 367 bp, Homo sapiens
acaagtcagtaccagtaataatttaacagagatatgtataaacatgtgtactcagatataattatcttgaagtagacaaccgataccatgctgaaataatcaaatgacctagagagtatgatcaaagttcctttataacaagagaagaaagcactgcaaggctcaagtctcaataatattttgaattgccgaagctaatactaacaatgattgcctcttagagttcaagttatctatggctatattcgaaataatatttatgtttaccaatacagggtctcgtctctgtcacccaggctgtacgtacaacggtgcaagtcacgactcacggtagcgtcaatctcccaggcacaacatagcatcaggc

SEQ ID NO: 596309 - DNA, 292 bp, Homo sapiens
acgggcaactgtccatcactcttaatctcggtaattttctgcaactgaccgacgatccgctctatttcgatgcttatctccagtcgctacaggtggctgcgatttcgacattttgctgtttactgatcggctatccgctggcgtgggcggtggcgcacagtaagccttcgacccgtaatattttattactactggtgatcctgccgtcgtggacctcgtttctgatccgcgtttatgcctggatgggaatattaaaaaacaacggtgtgctgaataattttctgctgtggct

SEQ ID NO: 596310 - DNA, 1787 bp, Homo sapiens
  misc_feature (688)..(688): n is a, c, g, or t
  misc_feature (723)..(723): n is a, c, g, or t
  misc_feature (727)..(727): n is a, c, g, or t
  misc_feature (1087)..(1087): n is a, c, g, or t
  misc_feature (1097)..(1097): n is a, c, g, or t
  misc_feature (1143)..(1143): n is a, c, g, or t
gctcgagagctgagagtcactgtcccggcgctagcccagcccgacccaggcccaccgtgtgtgcacgcaaaccacttcctgtgccatgctgctccctcctgcttctcagctgccttctgcctcctggaggctggccctggcctgccgaggtgaagaaacctgcagccgcagcagctcctggcactgcggagaagttgagccccaatggctggccactgctttgcctgatgctgcagctgcctggcctggccttcagcttgtaccaggccatggccaatggaccaggcagtggagaacatcctggtgtcaccctgtggtgtgtggcctcgtctgctggggctcgtgtcgctgggctggcaaggcgaccacggctgtcgcaggccaaggcagttgctagagctgcctgatgcacgctgctgctgaccgatgtgacgtgttgcactgcctgtgccttgtggcgaagctgcttgctgctcactcagcaactccactggtgctgcaactgtgacctggaagctggtgcagcctgacttgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgnccgaggtcaccaaggacgtggagcgcacggacggngccntgctagtcaacgccatgttcttcaagccacactgggatgagaaattccaccacaagatggtggacaaccgtggcttcatggtgacatcggtcctatactgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcanaaacactggntgggctgggcctgactgaggccattgacaagaacaaggccgacttntcacgcattgtcatgtcacgaaggacctgtacctggccagcgtgttccacgccaccgcctttgagtttggactacagatggcaacccctttgaccaggacgatctacgggcgcgaggagctgcgcagccccaagctgttctacgccgagcaccccttcatcttcctagtgctgggtacacccaaagcggctcccttgctattcattggtgcgcctggtccggcctaagggtgacaagatgcgagacgagttcatagggcctcagggtgcacacaggatggcattgaggcatccaaaggctcctgagtacaccatggtgtgctattggaggttgcgacggcggaggtgcaggtaccagcctttggataactccatggggtgggggtggaaagaagcagtaccggggtttcccgtgtgcctgagcggacctttcccagctagaagttcagtccacttggacattggggcccagattccatgatgctgagcccggaaaactccagattctgtgggacctcggccattagtcatgctgcctgccctgaaagttcacagatcaagcctgcctcaatgagattcatatttatagccaggtacttctcacctgtgagaccaattgagcaaggggtcagcagcctctttgac

SEQ ID NO: 596311 - DNA, 395 bp, Homo sapiens
ccctgaggatcccacctaaatggctgtatgactgtgttatagcaagtctgaacaggacctagtttgaggcactaagaaggataagacatcagcttgaaaaggactcctatcagagcaacatgaattctgctaaaattgaaggaagaataaacatcaaatttatggtaaagcttgggtggaaggatggtgaaatcattgatgattcacaaaaagtttatggggacaacactccaaagaaatcagcagtttacaaatggataactcattttaggaagggacaagacaatgttagagatgaagcttgcaccaacagactatccacatcagttttcaaggaaaaaataaatcttgttcatgccctaattgaagactgacagttaacagccatttaggta

SEQ ID NO: 596312 - DNA, 344 bp, Homo sapiens
ccacatgacgctgttgtctatatcctctcctgtgcctcaaaatgtttttcctgccgcgtttgtttcaccctcatgcctccttcaggtcagctatgatgacttgaggtcttctggttctttgatgccttagaacaggcgtcggcagactttctctgtgaaaggtcagataatacttgaggcttagtgggctatcatgggctgtgtcacaactactcacctactgatatgtagcacaaaacaaaccacagacaaataacataaaaaaagtgggacatggctgtgccaccaaataaaaatatatatacacaacaacaggcaatcaaggctagggtaccgaagctcga

SEQ ID NO: 596313 - DNA, 984 bp, Homo sapiens
  misc_feature (641)..(641): n is a, c, g, or t
atccagccctgggtagtatgacccaactaggcagaacttctcttatgtgaccggcctggactgctctgagacagtggagtaagccaagtgaacgtggatgaaatgatctgtgtgcttggaacctgttaaatatgaagtggtaccggagtgaagagatattgatgtaccctccaatagttcgtagttctggaatcccttgggcacggtggaggaataacttgcgtcatattttcgcgatcactaagactacgaggatcgtggaaatccttctaaaatcttcgacgacaaactatgcaagtactcatcaatctgcacgataggatggatctcatagatgcttggttgccgagaacccgtgaagatcgatcttgtccattgatctagctctgaatgtgtttctctcagtccatcctcgttcactttgtagcgtctttgcggcgtctcggtgctcgtctcctgcttccattgttatagcatggggaaccctcttcccatccgagtccttctggttctgggataatcgctcccgtcttagggttgtgtcgagagaagggtcgtgcgctttgcgcgagtcgttcctctagcgggaggacattgcttgatcggccctctgcttgagcgcactctcttccccccgaggngcttctgcttgcctacccgattgtaaatgtccccacggacatgagtagccttttgtgtgccactctcgggtaagagggatgaggacaagaaacccgagtagtaagtttggactttgtgggcgtgcagttctctttgggggttcacttaagacgttggtgggctttgggaagatgaacctgaggtagtggggccccaagcattgttgggctagggaaagactgcgtgggctgcgcccatggttgcggtaacttaaaaagacccttttccaaggtacttcccttcaaaataatagcaatttggagggaaacaacatggtttgtgaaggcattagggggcacaaaa

SEQ ID NO: 596314 - DNA, 571 bp, Homo sapiens
gcggcagcggcatattgaggtcggcagcggcacagctaggtcggcagcggcacagcgaggtcggcagcggcacatttgaggtcggcagcggcacagcgaggtcggcagcggcagcgagtgtcggcagactgtgcacatgcgatgtgtctgtgcagctggcagcgaggtctggcagctgtgcgctgctgctgtgctcttcctgtggactctgaatcatggcgaccacgtgccacgatggcgacctcgggctcggcgcgaaagcggctgctcaaagaggaagacatgacctaaacgtggaattcgagaccagcgaggaggtggatgtgagccccacgttcgacaccatgggcctgctgggaaggaccatgctgcggggcatctacgcttacggttttgacaaaaccatcagcaatccaagcaacgagccatagcagatcatcaaagggagagatgtcatcgcacagtctcagtccggcacaggaaaaacagccaccttcagtatctcagtcctccagtgtttggatattcaggttcgtgaaagagcacagcgcgcgccgctgccgacctcgct

SEQ ID NO: 596315 - DNA, 1443 bp, Homo sapiens
gtcacatattatacctagcatttaccatcgcacatcgtaggaatactatgttatatcgctcacacggctcatgtgctccctactatgcctagaacgaatgatactatcgctgttcactaatagctagctctcatagaccctcaacagccatgtccctcttagccatgtattgtgcctatttgccattactagtgctttgccgacttgtcgaggcatccggtgggcctagtccacctagcgtagtctcaatcttccaatcactatatggtcctagacttacgctacataacctaagatctaactccaagtgactaaacacataactcgatccccagagcaactgtattatttacctatccacatgatcacgttgacctttccaagacaaaagcaccaatagaatgttgatacttcatagcagctaataccagccacagacaggcctcccctgtaagtatacgccactcaatcccttcgtacgtactttttattaatccgaaaagttctaacatatcagagccctaatgttcagggctaagtttcgccctcgaaaccacgtattttccccttctcgggactcgctcgcattaagagcaaatctccttcgctcttcccattacacttaaccttaagcttaaacccctagaaaccttccctttgcaccccatttgaccaacattccctttgagccaaaaagcctttcattcgcccctagcgtgtacttcctccacgcttggaaaccccatctttaattgccattcggacaatttacaataaggtttcttaaaacttccctccttagagttacacctaggaagtttcttgcgcgcctaaacgaaagatttctttctcgggcggttaaatctggacacatccgccaacagcattctgaatctcctggacagtacggcagggctttttagcaatctggttggccacggaattttaaaatatggcccccctcaattttgaaaccattgtcggttccacgttgcccaagatcgttccgccatctcccagtagttagtcactgcgaatggaaaaaccagtgagcagacaccgctaggaacgtttctaccaaggatgcttccccaattgagcccgtttcgccacaagggttggttaggcttctgcccctttgcggcgggaaatcctcacacggcgttgaattcgaccctggttcccacatcttcacggccttgggcggattgtagatccacgccatctcggcctgagtaatgtcacccctggtctgcaaacgtgcctcatctgcaccccttttggagccgtgcctgtggagagcgatttcctcattagccagcttgggggcccccaagggacaatatcccgggccaacttctccatttagttttggacccctcagcgatgtgcacaccgccgcgtttgtcacagttgccaagaacgccttcatctccagaataa

SEQ ID NO: 596316 - DNA, 317 bp, Homo sapiens
  misc_feature (66)..(66): n is a, c, g, or t
gtccgatttagactcgaccacacaattcatgacaggactcacgacattctcaagagatcgcgatgncaagacacaaagatgctcactcatagtatcaggaatgcaatcaaacacatgagagacacaccatgagatggctatattttaaatggcaaatagtgtggtggggtgtgagaaatggaacctcatacatcatggtggaggtaaacggacagctgtgagggaaagttgacagttctcaaaaagttaatgtgcgatttcaacatgaccagcaactccactccagagcgctaaatcatagatggcctaaatcacta

SEQ ID NO: 596317 - DNA, 532 bp, Homo sapiens
atctagaggactgaggggcggcctttttttatcttcatagaaacagacaaaaatgggaccaacgggtttcacccaaggtagcactacaaggacgtcttccagttccataaggggtcttaaattacacatggtatctggttggtaaattaagtcacatataatacaagaatgcgtaacaaaaaccaggtctccacatgtctggccctggccccaaacaacattttacagtgcaaggggcaaaccttacagccagatgaccaatggacaattccattattggcttccttcaaccacttaatgggaattatgtatattagatcttagacatcatgcctggatgagcgaagtaccacataatttaataatatattcaccatacactggtgacgtacgataaatggtgctcttaaagccaagtttcaaagtaattattttcatttctaacggggatggaaagggaagggtcacatgcagtgggaccaaaatgactactaccactcagttggcacggtctcccctagctaaccatggg

SEQ ID NO: 596318 - DNA, 141 bp, Homo sapiens
tcatagtagacctctataattaatactatactagtaatatacataaatcggtacgccatggtttagaagaccacctatactagattcaggactcctgttcttcccagacatgaccactcatttagatgaccccagcgtgtg

SEQ ID NO: 596319 - DNA, 839 bp, Homo sapiens
gggaccccgagcacgcgcctgacagcccctgctggcccggtgcagcggcgtcgccaggccagctatggcccccgacccggtggccgccgagaccgcggctcagggacctaccccgcgctacttcacctgggacgaggtggcccagctgctcagtggtgccgatgtgagctggtgtgctagtgatcgaccgtaacggtgtacaacatcagcgatgttcacccgcgcggcatccagtgggtgctccctgggtcatccgccactacgccgggcaggatgccactggatccctttgtggccttccacgtcatgcaagggccttgtgaagacgtctagtgagctctctccgtgattggagaactgtctccagatgcagcccagctttgagcccaccaagaatagacgagcttgacacgctgagttccgggagctgccgggccacatgctggcggcggcttgcgggctcattgcacgcggccagtccatgtcttgctatcttgctgctccctgctgccgccgtcttgcctgtctggcactggtgcacgcctgtcgtcagcccctgcgggctcttcgggacgtcctgctcgtggcccgttcctcccctccttgtgcggctgcgtgctcagggttgtcaacgtcttcccatcgtccccagctgccttgtgctctgcgcctgcccagcccagtgaccgtctgggcggcaccgtgattcggcacacttcccaaccgatgcccttctatagatgggaatcccactcattgctacacatccagaatctggtgcaattcgggtcccacctttcacaggggtcgcccccccgtccacacttggcatgggaacc

SEQ ID NO: 596320 - DNA, 116 bp, Homo sapiens
gtgaagaaggtgcttgtttcccctttgccttccgccatgagtgtaagtttcctgaggtctcccagtcatactgctggttatttctgcagaacggtgtacttgtttgaaatgtatct

SEQ ID NO: 596321 - DNA, 938 bp, Homo sapiens
gaggaacgagatgggggactctctggaggctgagtgccgtgtgcggtgccctaggaggcgcgagcgtctgttgcttcgaactccagttgtgtcaagacctgctcatatctcagagatgtcttcaggaccgacctatcccagaatggtgtggagtgcagcacatacttttgtcaccgagtccacatatcgtggctccaaggctgtcatctctccgaggtggactagcgagaagggattggtcatgtgatagatagctcccatgggatctagcttatcgcggcgtgcgtatactatagacatccttgactcctgccgactggacctactaccactggactgacatgacacactcagctcattcatggttcacatggggggccattggaacaaagattgttaacatagagcttatgttcgatggaggagtgccgttgcgaggaaaggctgtcgccaagtgtatggggacattagtgggctacattgacaagtcattataatcctttatgacttgaggatataggatgatttagaagctaattcacggaatggtggaggaattcatggaaaaagaggatggatgggacaattgacctgttgaggaaagcagttgtgaaaactgatgataggcactattcaataacgtttgggaagaagcaaattagcagtgataattggccgtcattttgtgacctttcttggagctttggatcaagttgacgcggtattaaagtggttcgaagtagaagtttaaggggacaggatagagtaaacaggaataaagattcccatttggggtggggaacaagggaggtgcagtaacattattaagggacgacaaaggtagttacagtataggaggaaaaatttgtagatcgttattgagagcacaaagggtagtgaggggggaactggattatttgaggtatgttgaggaaaag

SEQ ID NO: 596322 - DNA, 186 bp, Homo sapiens
ggatattctacacggatcccttcatttaggcaattgattatataatatattatctctcaatacaatacttctctgtcttggatactacatatataagcaaataatatattcatttctgaagtttctttccttcacttgtaatgatctgatctcctcccactatgcatatattccctttactgttat

SEQ ID NO: 596323 - DNA, 147 bp, Homo sapiens
tcaggatccaagcgctgatagcctcacacctggcagttctagacacactgggttccataccagttgttgaataaaccggagacagaaagtgggaattctggaagtagagaagattcccgaaattgtgcatatttcccagagactgtg

SEQ ID NO: 596324 - DNA, 228 bp, Homo sapiens
ctaattcaaatcatttgaacaaaaaaaaaaaatggactctgataaaactgctttacagcctgcaggacaccttgggcaagctgggtataactctagaatttcactgtcgtcccaccccatttcttccaccccatttcttccttcaccaacatgcaagttctttccttccctgccagccaaataaatagacagattgggaaaggcaggcgcggcccctcgtttgtcaga

SEQ ID NO: 596325 - DNA, 132 bp, Homo sapiens
tcttccacttgtagtctcagctatttaggaggctaggtgggaggccacttgagcatgggaaggcagagactgcagtgagccgagatcacaccactgcattccagcctgggcaacagagcaagaccctgtctc

SEQ ID NO: 596326 - DNA, 742 bp, Homo sapiens
  misc_feature (24)..(24): n is a, c, g, or t
  misc_feature (53)..(53): n is a, c, g, or t
  misc_feature (74)..(74): n is a, c, g, or t
  misc_feature (97)..(97): n is a, c, g, or t
  misc_feature (255)..(255): n is a, c, g, or t
  misc_feature (280)..(280): n is a, c, g, or t
  misc_feature (405)..(405): n is a, c, g, or t
  misc_feature (470)..(471): n is a, c, g, or t
  misc_feature (640)..(641): n is a, c, g, or t
  misc_feature (648)..(648): n is a, c, g, or t
  misc_feature (656)..(657): n is a, c, g, or t
  misc_feature (661)..(661): n is a, c, g, or t
  misc_feature (663)..(664): n is a, c, g, or t
  misc_feature (670)..(671): n is a, c, g, or t
  misc_feature (684)..(684): n is a, c, g, or t
gtaaccgggactggcggccctggncgcaatgcccctgtgctgctagcgggtcnactgtgtcgtagccgacagcncggccttcttcctcgcagcgcgnccgcgattcaccagcctggtcccttctgcggtagagcgatgccgcttcccgacaccatgttctgcgctcagcagatccacattcccccggagctgccggacatcctgaagcaattcaccaaggctgccatcctgcacccagccggccgacgtgctgcnggtggtccgcgtggctatttttcangctctgtcgagcaggagatccacttcctgtaaaggacatgaatggaaatgcccacggcaacccagaaaacagacacaggcctgactcaaggactcctgaaagttttgcacaagcagtgtcaccanaagcggtatgtggaattaacagatcttgagcagaagtggaagaacttgtgcctgccgaaggaaanncttcaaagcgctcttacaactggatccttgtgaaaacaaaatcaagtggataaacttttaagcgcttggatgcagcatgcttggtgggtccttgaacactgcgctgaagcacctgtgcgagatcctcacggacgatccggagggcgggcccgctcgcatccccttcaannacgtttncctacgtnnaccngnnacttgnncagattagactcngatgtgtctccctttggagacggaatcctaccttgcctctctacaaggaaactataca

SEQ ID NO: 596327 - DNA, 787 bp, Homo sapiens
  misc_feature (24)..(24): n is a, c, g, or t
  misc_feature (53)..(53): n is a, c, g, or t
  misc_feature (74)..(74): n is a, c, g, or t
  misc_feature (97)..(97): n is a, c, g, or t
  misc_feature (255)..(255): n is a, c, g, or t
  misc_feature (280)..(280): n is a, c, g, or t
  misc_feature (405)..(406): n is a, c, g, or t
  misc_feature (685)..(686): n is a, c, g, or t
  misc_feature (693)..(693): n is a, c, g, or t
  misc_feature (701)..(702): n is a, c, g, or t
  misc_feature (706)..(706): n is a, c, g, or t
  misc_feature (708)..(709): n is a, c, g, or t
  misc_feature (715)..(716): n is a, c, g, or t
  misc_feature (729)..(729): n is a, c, g, or t
gtaaccgggactggcggccctggncgcaatgcccctgtgctgctagcgggtcnactgtgtcgtagccgacagcncggccttcttcctcgcagcgcgnccgcgattcaccagcctggtcccttctgcggtagagcgatgccgcttcccgacaccatgttctgcgctcagcagatccacattcccccggagctgccggacatcctgaagcaattcaccaaggctgccatcctgcacccagccggccgacgtgctgcnggtggtccgcgtggctatttttcangctctgtcgagcaggagatccacttcctgtaaaggacatgaatggaaatgcccacggcaacccagaaaacagacacaggcctgactcaaggactcctgaaagttttgcagccaagcaagttggtnncaccgacaaagcgggtcatgtgggcaattaaccagaattcctttgaacgcaaggaaacggtggggaacggaaactttgggtggcccctgccccggacaggggcaaacaatttccaaagcgctcttacaactggatccttgtgaaaacaaaatcaagtggataaacttttaagcgcttggatgcagcatgcttggtgggtccttgaacactgcgctgaagcacctgtgcgagatcctcacggacgatccggagggcgggcccgctcgcatccccttcaannacgtttncctacgtnnaccngnnacttgnncagattagactcngatgtgtctccctttggagacggaatcctaccttgcctctctacaaggaaactataca

SEQ ID NO: 596328 - DNA, 423 bp, Homo sapiens
  misc_feature (24)..(24): n is a, c, g, or t
  misc_feature (34)..(34): n is a, c, g, or t
  misc_feature (50)..(50): n is a, c, g, or t
gcatccggtaggcaggaaatccanggctccctcngacatgctggattgtngaacttaattatttttcggacattttactatttaatcattttcttaagtaattatttaattaataaacaatttattttattaatagtatttcatatcaattttatatataactaacatgtatacaatacataaaatatgtaaatatattatctattaaaatatttgacaaaattaatttaataatttaattattaaatttaaatgtattttcattatgttcttttcctccttcaagttatcccagattttctttccctccatactcacccaactttaatttctttctcaaacataaacaaaaacaaaatgcagaactctcccaaaccaagaagatgaactcccctccccaccaaaaaaacacagcaccaaaac

SEQ ID NO: 596329 - DNA, 347 bp, Homo sapiens
  misc_feature (44)..(44): n is a, c, g, or t
  misc_feature (280)..(280): n is a, c, g, or t
taccctgtcactagtaaaaatacaaaaatcagcccagcatgctngcaggtgcctgaaatgtaatcccagctactcgggaggctgaggcaggagaatcacttgaacacaggaggcggaggttgcagtgagctgagaccacaccattgtactccagcctggctgacagagtgagacttggtctcaaaaaaaaataaataaataaaaataaaaataaaaatggccaaaggatttgaataaacatttttccaaagctaggaacaaaggccaataaggcaaatgnaaaaggatgcttcaacattcattacttcatcaggggaaggtggcaaaaacccacacttgaggtagga

SEQ ID NO: 596330 - DNA, 272 bp, Homo sapiens
actgatttattctttcttatatatgtgttagaagtaatccatcccagagtatctgagatttaactggaaattcttgctgtgctttcatttatttatttattgagacggagtctcactctgtcacccaggctgaagtgcagtggcacaatcttggctcactgcaacctccacctcccaggagaatcgcttgaacccgggaggcagaggttgcggtgagccgagatcgcgccattgcactccagcctgggtaactagagcaaaactttttctca

SEQ ID NO: 596331 - DNA, 185 bp, Homo sapiens
  misc_feature (45)..(45): n is a, c, g, or t
tatagccatagtggacacggtgcttactaggccaagggcactccntgctgacatacccgaggatcctgtctatctcaaagcttgtcttagaatgcagctggtcgtctggaaattgagagacagtacagaataaacccgtctttcccccacctccgcctgcagagaaaagaaatgctgggaacgca

SEQ ID NO: 596332 - DNA, 175 bp, Homo sapiens
aggctatatgggatctatatcctgcgagagcagagctcagtggagaccttgtggttaggctatttgaggccttcttgatattaccaagtgtcaatggcagacacgtcaatatttagtcttcactttcatggccacacgtagaaattcttcttgtatctactcttcctgtggcact

SEQ ID NO: 596333 - DNA, 757 bp, Homo sapiens
acccaacatacgctagtataggccgcgttaacagcgttcctaagaagaaggaggctaagatcaggaaggcttgtgacaggctatcgcaagaatgaggcacctgctccgtcggcagcgtgactgaggcggtgagttccccgtgatctccgtgtgtgtggtgtacaccaactgcgtgaaagaccacgctgatcaatggcactgactgggctgatgccagccatccatgccactggtgaccagctgtatttgccactgctgtgactgtcacggcccactgctgggcacgctgccctcacgcaatgacctgtcctgtacgttggacaccatctggacttcctctcccagctgccgcactggactacatcgagtccttctccgccaccctgtgatagacgtggcccactcggatctcatcttgcacgtgagggacgtcagccaccccgcaggcggagctccagcaatatgcagctgttctgtccacgctgcgtggcctgcagctgccctgcccgctcctgtgactccatggtggaggttcacaacaacggtggacctcgtgcccggtgtacagccccactggaaccgacccgtcgtgccctgtgtctgccctgcggggcccacggcgctccaggatcctgacagcctgagctcgacggccggcggcctccgaaggctgacgggcgccacggatcctcactctccgtgtgatgctccagtggcgcagctctctggctgtcttctgcggcccccttccgaagtg

SEQ ID NO: 596334 - DNA, 313 bp, Homo sapiens
cattccctccagttgtccccagtcaccattccctcccgttgtcaccattccctcccgttgtcaccattccctcccgttgtcaccattcccccccgttgtcaccattccctcccgttgtcaccattccctcccgttgtcaccattccctcccgttgtcaccattccctcccgttgtcaccattccctcccgttgtcaccattccctcccgttgtcaccattccctcccgttgtccccagtcaccattccctcccgttgtcaccattccctcccgttgtccccagtcaccattccctcccgttgtccgtcgacgc

SEQ ID NO: 596335 - DNA, 947 bp, Homo sapiens
  misc_feature (161)..(162): n is a, c, g, or t
tgggagggaggggcccatccagctgggctgtgtgtgtgtgtgtgtgtgtgtgtgtgtgtgtgtgtgtgtaatatcaacgcagtgggattacaggtgtgagccactgcacctagccagaacatcgttaatgtagttcaatatgagataaattattatcttcnntgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcaccgggggacgagcagagatccgtctcagagaaaaaacacaactcgagggggggccggacccaattggctaaagtagtcgttcaaatacgggcgcgttacacgtctgacggacaccgcgtcccatatgctgtgaaaccctacgcgggaaatcaaaggcggcgacccccatggccgagaagagcgagcgaatatagacgaggatacaccccaacggcaggagctaaaccaggtgtcgcgcacacagttgctaacatggccgcaacgcgaaccagtgacacaacgcgtacaccgacacagaaccgagatcacacaggcacacatgccaacggcccgtcggcg

SEQ ID NO: 596336 - DNA, 382 bp, Homo sapiens
tgcagctgacctacatctcgaaggtgagcatagctaccccaaaacagaaaccaaaaactccattttgctttgttatcaatgccctgtctcagagatatttccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596337 - DNA, 3907 bp, Homo sapiens
  misc_feature (1087)..(1087): n is a, c, g, or t
  misc_feature (2516)..(2517): n is a, c, g, or t
gtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgnagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccagctacttgggaggctgcggcaggagaatggtgtgaacctgggaggcggagcttgcagtgagccaagatcgcgccactgcactccagcctgggcgacagagcaagactccatctcaaaaaaaattatctgataggttactattgctaaattaattggccattataaataacgctgattgtttcttattcagcaagatctctttgagaatgtgacaaattaaacatacatagaatccatatggtattatcctgataaagggaaacgaggacactaagactgtcaaatggaaatcttctgtcaatggcaaacacttgggaattccacattagagcatgcttgtttttaattttttttttttaatttttaaaagacagggtctcactctcttacccaggctagagtgcagtggtgtgatcatagttcatcataactttgaatctctgggcttaagcaatcctcccatgttagcttcccaagtagctaggactacagggttgtgctaccacgcctggctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcnntgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596338 - DNA, 161 bp, Homo sapiens
tctaatcttcttaaatgtaccctgaaatcttaccatgtacagaacaatatctgattactcaatttcttgtttaactaaattaaacaataatgcttataattggatgtatgataattaaaatgtatcaagcacttctatctgccaggctctgactgcactac

SEQ ID NO: 596339 - DNA, 3440 bp, Homo sapiens
  misc_feature (1087)..(1087): n is a, c, g, or t
  misc_feature (2049)..(2050): n is a, c, g, or t
gtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgnagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtgttagcttcccaagtagctaggactacagggttgtgctaccacgcctggctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcnntgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596340 - DNA, 3189 bp, Homo sapiens
  misc_feature (1087)..(1087): n is a, c, g, or t
  misc_feature (1798)..(1799): n is a, c, g, or t
gtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgnagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcnntgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596341 - DNA, 1999 bp, Homo sapiens
  misc_feature (608)..(609): n is a, c, g, or t
gtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcnntgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596342 - DNA, 1682 bp, Homo sapiens
  misc_feature (291)..(292): n is a, c, g, or t
ctggagtgcagtggcgcgatcttggctcactgcaagctccgcctcccaggttcacaccattctcctgccgcagcctcccaagtagctgggactacaggcgcctgccactgcgcccggctaatttttttttcgtatttttagtagagacggggtttcaccgcggtctcgatctcctgacctcgtgatccgctcgcctcggcctcccaaagtgctgggattacaggtgtgagccactgcacctagccagaacatcgttaatgtagttcaatatgagataaattattatcttcnntgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596343 - DNA, 88 bp, Homo sapiens
aaatcagcattccctgtaaaaaaaaaaatcgccataatattctcataatgatttctcctaataaaaatggatattgttccagttccca

SEQ ID NO: 596344 - DNA, 2802 bp, Homo sapiens
  misc_feature (1087)..(1087): n is a, c, g, or t
gtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgnagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccagctacttgggaggctgcggcaggagaatggtgtgaaccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596345 - DNA, 2679 bp, Homo sapiens
  misc_feature (1087)..(1087): n is a, c, g, or t
gtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgnagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcgaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactgaaaaaaaaaaaa

SEQ ID NO: 596346 - DNA, 2348 bp, Homo sapiens
  misc_feature (1087)..(1087): n is a, c, g, or t
gtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgnagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccagctacttgggaggctgcggcaggagaatggtgtgaacctgggaggcggagcttgcagtgagccaagatcgcgccactgcactccagcctgggcgacagagcaagactccatctcaaaaaaaattatctgataggttactattgctaaattaattggccattataaataacgctgattgtttcttattcagcaagatctctttgagaatgtgacaaattaaacatacatagaatccatatggtattatcctgataaagggaaacgaggacactaagactgtcaaatggaaatcttctgtcaatggcaaacacttgggaattccacattagagcatgcttgtttttaattttttttttttaatttttaaaagacagggtctcactctcttacccaggctagagtgcagtggtgtgatcatagttcatcataactttgaatctctgggcttaagcaatcctcccagctacttgggaggctgcggcaggagaatggtgtgaacctgggaggcggagcttgcagtgagcc

SEQ ID NO: 596347 - DNA, 755 bp, Homo sapiens
gggcagggaggaggtggtgggtccttctctaagggtagaagccagagctgctgctgagcatcccatagcacacagggtggtcctccatgagaaagaattatccagcccccagaagtccataatgctgctgtggagaagtcccacaggacatatggaaaatgagagtcagagggggcagtgatccgctccaagtcgcacagcttgttggcggcaggtccaagatataactgggttcctgactctgctgatctgtctgtggggccggcgttcagtgctgtgggtccatgggttgccaagtggactctttgtctccaggcactggttaggtattctttctaaatcatttcgatttccgggaaccatttatatcctgtgtcttgcatgtctcccctgtgtgtgtacacattttgtgcttctctctgggtaatcctaggcttgcaggcggtacagtacgacgtgtacctttccaactgacactgcccataacacatataattgaacaattacaagacgagaagaacaaagccaacaagcacaccaagcaacacaataccaacaaaaagacaacacgacaccgcgaccggcgacccacgaaaagccagacaaaaagtacggggagagcgaggcccaaaggcaaaaacagaagaggaaaggacaacagacaggaaacgaagcaacagaaagacaagacaaaaacaacggcgagagacagacagggagggagagagcgcaacaagaacacttaagaaaagccg

SEQ ID NO: 596348 - DNA, 124 bp, Homo sapiens
gactcttgaggatcccgagggagcatctgtcgtggccatggcaaatgaatacatttttaaatgaaatagaacctccaacagcctccccacaaccaccacacacaaagcacatgggtatcgatgt

SEQ ID NO: 596349 - DNA, 396 bp, Homo sapiens
  misc_feature (67)..(67): n is a, c, g, or t
  misc_feature (293)..(293): n is a, c, g, or t
  misc_feature (386)..(387): n is a, c, g, or t
  misc_feature (392)..(392): n is a, c, g, or t
ccccccccggaaaaatggggaaatccctccaaaaatcccggggtacaaagcccctttatccatatancctatgatttgccaaatattttcccctcattcccatagcttgtcttttcattattttaacaatgtcgtttgaagaagataagctttttattttgaatgaagtctaatttatcaatttcttttttaatggattgtgcttttggtgttgtatctaggaaatctttgcctaacccaaggacacaaagtcttcagttcctgaagctcaaaaagctgttgttgccaggcancaggtgtcacgcctgtaatcccagcactttgggaggccaaggtgggagggtcgcttgagcccagcttgggaatcataaggagaccctgtctcnntaagnatta

SEQ ID NO: 596350 - DNA, 1407 bp, Homo sapiens
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggcctttaccaagtactgcaagaaatggcaggatgaggatggcaagaagcagctggagaaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcagggatgagatgatcgacgtcatccggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaacccagaaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtttccaataaaagttattttcccctgttaacgaaaagaaaaaaaatatcga

SEQ ID NO: 596351 - DNA, 1484 bp, Homo sapiens
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggcctttaccaagtactgcaagaaatggcaggatgaggatggcaagaagcagctggagaaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcagggatgagatgatcgacgtcatccggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaacccagaaagaagcgggtgctcaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtctcaataaaagttattttcagtggaaaataac

SEQ ID NO: 596352 - DNA, 484 bp, Homo sapiens
cagcccagtttatgattcagtgaaaatcaatttcaacagtcactcatgagtatcctggcgccatctggtgactccccagaaattcactgtcagcctcttatatattgtcgtgggggaaagacttggtgccgtaaagtgattctgatcacactccttcaaggtcaaataaataatctcttgaaactggctggatatgcaaaccctaagggaattatgagaataaccctgtccacggttacaatccagcccccagccctgggcgaaaagcccctcactcctctttaccaccagagagatgagaccagaaggccctgattaaacactcaccccttcaggagaacccagagttatagaagggatgtcagtggcgctgagcagtagctttaagtcccagaaaagccttttcttactatgcaaacccactcgtgcctggatgcccactttacatttgtggtggctgcctccaccctggcagaacccattc

SEQ ID NO: 596353 - DNA, 1485 bp, Homo sapiens
  misc_feature (1362)..(1362): n is a, c, g, or t
  misc_feature (1374)..(1374): n is a, c, g, or t
  misc_feature (1389)..(1389): n is a, c, g, or t
  misc_feature (1440)..(1440): n is a, c, g, or t
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggcctttaccaagtactgcaagaaatggcaggatgaggatggcaagaagcagctggagaaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcagggatgagatgatcgacgtcatccggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaacccagaaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtcccanaattaaaatccnttcctctaccactanacttatgttgttacttaatctcttccatctctcggatattactagtatctnatataacaataactggtggtataaggggtaccgggagctcgaatt

SEQ ID NO: 596354 - DNA, 354 bp, Homo sapiens
cttctcaccctgcagattacacaaaatgtctcgggcttaaggtcacagtgaataattctagtcatagtgcaaagcatccaagcactgcagcatcgagtgggcaaactagcgaaccaaaggcagactgacgccctggcatttattcttcttgatgagctcatagaggttcatgctcagcagatcaaacgatcaatgcagatgatggattgcggaaggatgaaatatctccagcatatggatgacattcatagtgttatcctatgatccatgcttccgcaggatgttccaaggattcgagatctccatccgctgcttgccggagatggaaagcgcttctcacttccgcaccatcat

SEQ ID NO: 596355 - DNA, 1816 bp, Homo sapiens
  misc_feature (1382)..(1382): n is a, c, g, or t
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggcctttaccaagtactgcaagaaatggcaggatgaggatggcaagaagcagctggagaaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcagggatgagatgatcgacgtcatccggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaacccagaaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtctcaataaaagttattttccactgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaacaaaaaaacaagagagagaggagggaggagcgagagaggaaagagagaaagagaaaaagaaacgacaggagggggggggagcggcgcgcggcggaagagagagagcgacaggaggagcgagagagagggaaggaacggagaagcagagccacgagaaccacggagaaaagcgcgagggggagagaagagacgacagaagaaacgaggagagggacgagcgcgccggaggggagaagagagagagacagagagagggagaaacacgagcaagagaagagcaaggcggaaggagagagcgaacgagccacacagaagcgagaagaggcacgggg

SEQ ID NO: 596356 - DNA, 1911 bp, Homo sapiens
  misc_feature (1477)..(1477): n is a, c, g, or t
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggcctttaccaagtactgcaagaaatggcaggatgaggatggcaagaagcagctggagaaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcagggatgagatgatcgacgtcatccggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaacccagaaagaagcgggtgctcaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtctcaataaaagttattttccactgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaacaaaaaaacaagagagagaggagggaggagcgagagaggaaagagagaaagagaaaaagaaacgacaggagggggggggagcggcgcgcggcggaagagagagagcgacaggaggagcgagagagagggaaggaacggagaagcagagccacgagaaccacggagaaaagcgcgagggggagagaagagacgacagaagaaacgaggagagggacgagcgcgccggaggggagaagagagagagacagagagagggagaaacacgagcaagagaagagcaaggcggaaggagagagcgaacgagccacacagaagcgagaagaggcacgggg

SEQ ID NO: 596357 - DNA, 461 bp, Homo sapiens
tgagatggagtctcgctctgtcgcccaggctggagtgcagtggtgcgatctccactcactgcaagctccacctcccaaggttcacaccattctcctgcctcagcctcccaagtagctgggactacaggagcccgccactacgcccagctaattttttttttttatttttaatggagatggggtttcaccgtgtgttggccaggatggtctcgatctcctgacctcgtgatcctcccgccttggccgcccaaagtgctgggattacaggcatgagccaccatgcccggcaaggccaggaatttcaagaccactctgggtaacaaagcaagactgtctttacaaaaagttaaaaaatgagctgggcatggtggtgcacacctgtagtgttagctattcatggggccaaggtgggagcatcacttaagcccacaaattcgagacttcgagggctgcaggggtag

SEQ ID NO: 596358 - DNA, 323 bp, Homo sapiens
gccgatgaacccaccacttacactccagtcctgggccaaagaacaatgacccattcatcagaacatccaaaagattcttaaaaattgagaaacaagaaatgtcacatactatattagaaatactgtactggttttgttgtatattcttctctttttccttctgtcatctcccaccttctacaacatatattcagatagctatatccttccttcattataccacaagatatgaggctacttattgggggaagaaataactagaatgttctcctaacatttcactaaagaaggtaaaaaacatggtttcctagaatatacctaac

SEQ ID NO: 596359 - DNA, 1386 bp, Homo sapiens
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggcctttaccaagtactgcaagaaatggcaggatgaggatggcaagaagcagctggagaaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaacccagaaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtttccaataaaagttattttcccctgttaacgaaaagaaaaaaaatatcga

SEQ ID NO: 596360 - DNA, 559 bp, Homo sapiens
  misc_feature (1)..(1): n is a, c, g, or t
  misc_feature (69)..(69): n is a, c, g, or t
  misc_feature (87)..(91): n is a, c, g, or t
  misc_feature (93)..(94): n is a, c, g, or t
  misc_feature (100)..(100): n is a, c, g, or t
  misc_feature (102)..(102): n is a, c, g, or t
  misc_feature (106)..(106): n is a, c, g, or t
  misc_feature (109)..(109): n is a, c, g, or t
  misc_feature (111)..(111): n is a, c, g, or t
  misc_feature (192)..(192): n is a, c, g, or t
  misc_feature (224)..(224): n is a, c, g, or t
  misc_feature (245)..(245): n is a, c, g, or t
  misc_feature (250)..(250): n is a, c, g, or t
  misc_feature (253)..(253): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (326)..(326): n is a, c, g, or t
  misc_feature (330)..(330): n is a, c, g, or t
  misc_feature (337)..(337): n is a, c, g, or t
  misc_feature (342)..(342): n is a, c, g, or t
  misc_feature (381)..(381): n is a, c, g, or t
  misc_feature (395)..(395): n is a, c, g, or t
  misc_feature (402)..(402): n is a, c, g, or t
  misc_feature (405)..(405): n is a, c, g, or t
  misc_feature (434)..(434): n is a, c, g, or t
  misc_feature (436)..(436): n is a, c, g, or t
  misc_feature (439)..(441): n is a, c, g, or t
  misc_feature (443)..(444): n is a, c, g, or t
  misc_feature (446)..(447): n is a, c, g, or t
  misc_feature (449)..(450): n is a, c, g, or t
  misc_feature (454)..(454): n is a, c, g, or t
  misc_feature (457)..(457): n is a, c, g, or t
  misc_feature (460)..(460): n is a, c, g, or t
  misc_feature (490)..(490): n is a, c, g, or t
  misc_feature (495)..(496): n is a, c, g, or t
  misc_feature (528)..(528): n is a, c, g, or t
ngatatgggtataggtatcattagtatgctttataatttattcacgttagatatactctttatagatangagagagtagtgtgagcnnnnnannatttcntnaaancgngntgtggtggaaataaatgaacacatgaagtgtccgctgaaagaagaatcagtgtttcttgggaagaaccaagattccctganagaagctaccctatgtagaggacaaagtaggncttcaataaatattagttggnttacngcntttcccaaggatacatcnggngggnctgcattcctttctcattggtgccgcctgagcacagaactagcttttnccgngacagcnaaccnaaaccccgcagtgctaagtgctgagacggatgagaagangcggccaccggggngagacanaanatcagggaagcaaagcccgaccgacgcgngnaannnanngnngnncaanccntanccccgcccccccctcacccccgccctcccnccttnngctccttatcctcctccccccccacaaagatngtcgtgcccccccctctccctccctagcgct

SEQ ID NO: 596361 - DNA, 911 bp, Homo sapiens
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggcctttaccaagtactgcaagaaatggcaggatgaggatggcaagaagcagctggagaaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcagggatgagataatccacctcatccgggggagccaaggggcgggtttcaagaggggtaccaattcggttggcccaccacgttgcccgaagagacacccagggcttgccaaggggggcctttattggggactggatcctctccggtccttctcttggggcccgc

SEQ ID NO: 596362 - DNA, 1464 bp, Homo sapiens
  misc_feature (447)..(447): n is a, c, g, or t
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgcgtgcatacgttggaacaatccctctcgcatgagcctccagggaccctgtcacacgcatcgtagttcntgttgtcatgacgcacgagtcatgtggactagtagatgccaagacggcgtcttcttataatgaattttgggcgaatacacaattcttgaacgaaggtacatgggctctttaaccagcgttacttgcgaagggactactgtgcaggcatgatggcatggcatacgtacacgctagctggggaaggacgtcgtcggcttgaatacgtactgcctatggttggtccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaacccagaaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggacccctgaagaaagaccgaattgcaaaggaagaaggagcttaatgccaggaacagattttgcagttggtggggtttccaataaaagttattttcccctgttaacgaaaagaaaaaaaatatcga

SEQ ID NO: 596363 - DNA, 992 bp, Homo sapiens
  misc_feature (558)..(558): n is a, c, g, or t
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaagaagaaggagcttaatgccaggaacagattttgcagttggtggggtctcaataaaagttattttccactgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaacaaaaaaacaagagagagaggagggaggagcgagagaggaaagagagaaagagaaaaagaaacgacaggagggggggggagcggcgcgcggcggaagagagagagcgacaggaggagcgagagagagggaaggaacggagaagcagagccacgagaaccacggagaaaagcgcgagggggagagaagagacgacagaagaaacgaggagagggacgagcgcgccggaggggagaagagagagagacagagagagggagaaacacgagcaagagaagagcaaggcggaaggagagagcgaacgagccacacagaagcgagaagaggcacgggg

SEQ ID NO: 596364 - DNA, 1208 bp, Homo sapiens
  misc_feature (662)..(662): n is a, c, g, or t
  misc_feature (761)..(761): n is a, c, g, or t
tcacgcctcgcgtagctccaaacacgcgaaacacctaacaccaacatgaactacccctaagcgcgcacccaccccctaaggctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccatttgtagagacaccacccatgggtggttgtgggcattgtgggctacgtggaaacccctcgaggcctccggaccttcaagactgtctttgctgagcacatcagtgatgaatgcaagaggcgtttctataagaatttggcataaatctaaggaacgcacatggccgtttaccgatagtacttgccaagcaatatggacaggcatgacggataggcaacgaatgcatggctggatgcacacggatcttgcagcctaggcactgtagggaacgtactggaccggggatcactaccggtggtccatctcgtcgccagcaacgcacaanggagtagtcgcctgactatccctctggcgtcctaagacaagaagaggccccaaacactagaattgtgaggatgcaccagggtaggacaccggaagggcnacctaagttgcgccgcgaagaacatgccttgggcaactgggagggccccctgccgcaaggacgagcttccgaaggccatggccaattgggtagcccgtcgtttgcagacctccacaggtgggtctcctggggggaccaaggcgcacgttgaaggcacttggaaatccggaaactgggtgccaattacctgcgctggctttgaagcaccgagatgcgcggcacagaaaggtggcccttgaacgataaacgcgagggcttccaaacggccgaagataccagcttctcagggacgaaccaaccgcgaaaaggcaaaaggccctggactcccacggtccaccatggtagccccccaatcgcctggactggccccccttgcccaggtccaaaaagggctaggggcccccgtgggttacctgcacggggcggggccacttggggcacattccc

SEQ ID NO: 596365 - DNA, 446 bp, Homo sapiens
gttctagatcgcgagcgccgcccttttttttttggttggtgttttatcagaattggctggactatgctggcaagggacttggtttacgatcaaatggtactagtgtctgcagggttggtcagtactcgtcaaagccaagtccaattaaaaaaaaaaaaaaggggcggccgcccttttgtttataagtgcctaagatttggacagcaggaagaaaacaattttttaaaaatttctcattacaatagacgcacaagaatatgtcacattaaagaaaaatgtgtttagaatacgggttttctattatacgcatgatattttcctaagtaaaatggccaatgtgggacatgggaagtccagaaggaaaataatttacattaatggctgggtggatcttaacaatattttggtgcctacaacgctttaattaattaaaacaaaacaacaac

SEQ ID NO: 596366 - DNA, 120 bp, Homo sapiens
ggagagattaccaaggcagacttcttccagagactccagcaagccactgtaccaactatgccttattcaaactggtgtgcagtatattcttcattataataaaaggtctacccatacaat

SEQ ID NO: 596367 - DNA, 180 bp, Homo sapiens
tccccacccatggccacagtataatagtacctccctcctatgggttgctgagtgtttaacattgaatcaggcacacacaagcactcagcacagagcttttcctcagtacaggctgcttaggttatgacctttgccacaggctgtgtccagccacggtagggacgggtcgaaccaggacta

SEQ ID NO: 596368 - DNA, 327 bp, Homo sapiens
  misc_feature (31)..(31): n is a, c, g, or t
  misc_feature (70)..(70): n is a, c, g, or t
  misc_feature (81)..(81): n is a, c, g, or t
  misc_feature (223)..(223): n is a, c, g, or t
  misc_feature (237)..(237): n is a, c, g, or t
  misc_feature (267)..(267): n is a, c, g, or t
  misc_feature (270)..(270): n is a, c, g, or t
cctcaggagcatgcacaaaataagccctganatcctgggcctcttcagacagcttaatatccctaaagtnctgtaactcanagccctgcaggtggccagcatttgccgagagaggaccatcttcttgccctccccctcacctgcatcaccacactctgtggtgcggtcagaggctgggctagggagacagagggcatgggcacaagtcctggctctgcccctngctcaccagctctnaggccttagacaagcaacttgacctctctntgncactgtttctgtttccgtaaaatggtgataacaaagagtacctaactggtaggctgt

SEQ ID NO: 596369 - DNA, 125 bp, Homo sapiens
gccaagcgcatagctcagcaggcggcaggcggcctgagcttcagggcagccagctccctcccggtctcgcttaccctcgcggtcagcatgaaagccttcagtcccgtgagtcccttgggaaaaac

SEQ ID NO: 596370 - DNA, 404 bp, Homo sapiens
  misc_feature (404)..(404): n is a, c, g, or t
tctcatgagatctgatggttttataaagggctcctgcgcacgctctcttgcctgccaccatgtaagatgtgtctttgctcctcctttgtcttctgccatggttgtgaggcctctccagccatgtggagctgtgagtccattaaacctctctctctttttttttaaataaattacccattcttgagtatttctttatagcagtgtgaaaatggactaatataataggttggtaccagtagagtggggtactgctattaagatacctgaggccaggcatggtggcccatgcatgtaatcctagcactttgggaggccgagggaggcagatgatcatcacctaggtcaggaatttgagaccagcctggccaacatggcgaaatcccgtctctactaaaaaaaaaaan

SEQ ID NO: 596371 - DNA, 366 bp, Homo sapiens
taaagtagtaatatgggctatataacacaagtaaagtggtgtgggaaagttcctccattcattggattcctttaaaagcgaataccaacggttgtgcaatttatccatgaccacatacaatgatccaatgaactagataaggtacaatctctcaggtaactgtcaaatttggaggtaggattaaaaaaatacttcaggggttctactctgaccacgtactttactgatctgttgcccttggcattgggggtcatgggaagaaggagggagaaaatgtcgatgggagaaggatacaggggatgagaggagtacccattagaagttttgagcccatggggtaggcacttaacctccccaaatcacgga

SEQ ID NO: 596372 - DNA, 247 bp, Homo sapiens
acagaaatggaacgaacacatctaaaagcaaatgcttagcaagtaagttcagtaataatgtgaaggtagtatactatacagcactgtgatggacaagcaagttgttaggcacatccaccaaaaacaattacttactcctatcatcgctaggcacaagactgtgatgccatacacctagcatttaaacacaaacaacgagtttagaagccacccagaaacaccagtatggcccattttactactacag

SEQ ID NO: 596373 - DNA, 287 bp, Homo sapiens
  misc_feature (119)..(119): n is a, c, g, or t
  misc_feature (148)..(149): n is a, c, g, or t
  misc_feature (160)..(160): n is a, c, g, or t
  misc_feature (171)..(171): n is a, c, g, or t
  misc_feature (203)..(203): n is a, c, g, or t
  misc_feature (213)..(213): n is a, c, g, or t
  misc_feature (269)..(270): n is a, c, g, or t
  misc_feature (276)..(276): n is a, c, g, or t
caagggccaaaccctcctggttcccttcaaagtctttttggcctgatgatgactcttgagtgataccctgtgatgcaaacatgccccaaatgggtttttcctttctttaaaactagggnctttcaagattaaaaaaaagattgtcccnnctaatttgacncctaacttcanaagcttccctgtctacatgtgaacttttccanaaaaactgtnccatggacatttttcctctggggaattaacatttaaattttggtaactattaaaanncagatntggttaattta

SEQ ID NO: 596374 - DNA, 96 bp, Homo sapiens
ccaatctgaagtgggagcggccagtccttgcccacaacgatgtggagccctgtgaaagtcggattcgaataaagggccacgtgtgcacccagaaaa

SEQ ID NO: 596375 - DNA, 248 bp, Homo sapiens
tcataataaacgcagtgaggcaaatggtgacttatgctgggctagtagggggtgggcacgaaaggcctttgtgagacgccatttgagctgcagtgtacatacatgagtcaatttcatccctcacaccaaccctgtaatgtaagtactattatacctattttacaagggaagcacttggggctgcgagactttaaaaagctagcctaacatttcttagctagtatgcggcaaagaagacctttagactc

SEQ ID NO: 596376 - DNA, 246 bp, Homo sapiens
cggacgtacgcctgacatcatagatgacccgtctcttattaagaaacacaaaagttacacatattacgctcgtctgtggtgtccattgcccgctaatctcagctactcgggaggctaaggcacgagaatcacttgaactggggaggcggaggctgcagtgggctgaaattgcgccattgcaccccagcctgggcaacaagggcaaaacttccattctcaaaaaaaaaaacgtgtttccctttggtt

SEQ ID NO: 596377 - DNA, 749 bp, Homo sapiens
cgcggtggctcatgcctgtaatcccagcactttggtagtaccaggtggatcacaaggtcaggagatcaagactatcctggctaacacggtgaaaccccgtctctactaaaaaatacaaaaaaaaaattagcggggcacgggggcggacattggtagtcccagttactcgggaggctgaggcaggagagtggtgtgaacctgggaggcggagctggcagtgagctgagatcatgccactggcactccagcctgggcgacagagcgagactctgtctcagaaaaaaaaggaaatctcatgaaagcaggggagccaaagccttccttcctacatcctcaagtttaaaagcatgacggaggctgggcgcaggggctcactccgggtaatcccagaactctgggaggccaaggcaggaggatcattggagctcagaagcgggagatcagctggaaagcagagcggagaacccacctcggtgtgaaaagtaacaacacaactcaaatcaaataaaataaagcactatggaccctccaaaagtagtcactactcgggaaatgcaagcgattgccaaatcgaacagcttccgaggaccggggtgcaaaagctaaaagccggtggccccgaaagccatgagtggagaggggctactcaaccacgtcaggaatccaggaaaacggaagaaccaataagtaaccggcaagcctcgaggagtcaaaggaaaggatccctagggaagaggcgtccgagaaaa

SEQ ID NO: 596378 - DNA, 307 bp, Homo sapiens
atcgagctcggtacttcataggttcgcagagtggggatttggcagggtcataggacaatagtggagggaaggtcagcagataaacaagtgaacaaaggtctctggttttcctaggccagaggaccctgcggccttggccttccgcagtgttcgtgtccctgggtacttaagattagggagtggtgatgactcctaacgagcatgctgccttcaagcatctgtttaacaaagcacatcttgcaccgcccttaatccatttaaccctgagtggacacagcacatgtttcagagacctgcgaacctatga

SEQ ID NO: 596379 - DNA, 235 bp, Homo sapiens
tccttgtatccaagcagtcggaaaaaaaaaagaaaaagaaaaagagaaacattgacgaattagagagctagttagtgggctatagcacaagacgcattgggagtaaataataaggacctgaagtaggttgtggccaatagggattagaaacgaaccactatacactacagggtaagacattacagccaggacctgggattggctggcatcagtcaagtggggcacgacgcccaag

SEQ ID NO: 596380 - DNA, 824 bp, Homo sapiens
  misc_feature (22)..(22): n is a, c, g, or t
  misc_feature (92)..(92): n is a, c, g, or t
  misc_feature (118)..(118): n is a, c, g, or t
  misc_feature (146)..(146): n is a, c, g, or t
  misc_feature (149)..(149): n is a, c, g, or t
  misc_feature (167)..(167): n is a, c, g, or t
  misc_feature (254)..(254): n is a, c, g, or t
  misc_feature (291)..(291): n is a, c, g, or t
  misc_feature (297)..(297): n is a, c, g, or t
  misc_feature (365)..(365): n is a, c, g, or t
  misc_feature (385)..(385): n is a, c, g, or t
  misc_feature (420)..(420): n is a, c, g, or t
  misc_feature (476)..(476): n is a, c, g, or t
  misc_feature (480)..(480): n is a, c, g, or t
  misc_feature (503)..(503): n is a, c, g, or t
  misc_feature (514)..(514): n is a, c, g, or t
  misc_feature (526)..(526): n is a, c, g, or t
  misc_feature (547)..(547): n is a, c, g, or t
  misc_feature (560)..(560): n is a, c, g, or t
  misc_feature (564)..(564): n is a, c, g, or t
  misc_feature (589)..(589): n is a, c, g, or t
  misc_feature (637)..(637): n is a, c, g, or t
  misc_feature (642)..(642): n is a, c, g, or t
  misc_feature (702)..(702): n is a, c, g, or t
  misc_feature (730)..(730): n is a, c, g, or t
  misc_feature (741)..(741): n is a, c, g, or t
  misc_feature (763)..(763): n is a, c, g, or t
  misc_feature (787)..(787): n is a, c, g, or t
gagaagggcctccctagcaggngtgcactgcaggcctcagccctgtactggttagagtaatggagcaacaaccgctttcctaagcagaagtnaggcaagccactcccgcacagattgngaaaagggttaaaatttctccccccgcncgncgagaggccaagggtgtnccccaacagcctgcctacccagcaggtcacagaccatccccactctggctggcctggaagggtttgaccagagcggatcaagcagtnaccagggccagggcggctggcaggggcggcctccgtntccatnctgtctcctaagcagcctgggagaagtgggcctaagcttcggtgaggacgagagtttgttttggaatngggcctaaaaggggagagtncagagacagggccaggaaaagaaggtgagggtgtnacgtcatttagagaccagctgcacccagggctcacctcctggaggcacctagagtnagcngggggctaagtcagccgacagtntggctgcacancccaggcctgtnccagcagaaggcatgaaccancagcaaatgagtntctnttccaagaaacgaaaaggtcttgtncagagccggggccttgggagtgtcctgatgtttcaaccactgcgcccngcctncctgtttcgacgcccagggttccaactccaaggtggaatggccaacgtgtggtctcagtntggtggccgtctggggtgggtctcggcngccgcctagtnacctgggaggcagaagtttctntgccttgagggacaaacttcagcnagcggctgaatatcccgggaatccggaccggtacagc

SEQ ID NO: 596381 - DNA, 110 bp, Homo sapiens
ggcacaccccgctacggtcggtcctgtaacctctgcccgctggttttaagccattctcctgcctcagcttctgagtaggtgggattacaggcacccgcaacatgcccggc

SEQ ID NO: 596382 - DNA, 1105 bp, Homo sapiens
actgaataagaacatgtgagttacacctatactggtgtataatggaggctgtgggattgacgaaaagtgtcacattagtgttggaatgtaggtgattgtacagctttataagacctttagcaccaggaaataaaatatgtgtgtgtacacacacagtattttaagaaacgattgtgaattcatccaaaccttaagattaggaaactgattggctgtaagctgatagcctcaacgtaatgtgtcccccgaccccataacatgtctttaactgatgccaacgtatccaacatcctagtgatcagcatgtctcaacacttatattctactgaacgggcttactcacactaatactgcttatgtattctaactaccatgctatccctagcgccgtcccatgacccatgcacaatggcgtgacacgcatacagccactgcacttatctggatcagacttcccaacacataccccaacatgataagggcacggctacaacgcctatgcgaaaacacttccgctcattaacactagggccgagtatttctacaccaagacctctagctcaacacactaccaacgcatggcccacacatttactgcgcactgctcccacctacttactcacatccgttctataaacacacgacttggcaagaaacttgctaaaacacaactaactctattccacacaattctaaacacacatttaagccatccatctatacgcccgaacaccaactattcaacacacaactttacttcactccatgccccctccaactaatagcactactccactctacccactgaaaccaacatatatatacacccatctaccaaggcgcctataccacttgacttccaccaaatggatatcaataaaagcacatacaatcttgaaacgtcttctccccatcgcaaacacaaccccccaagctataccgcccactcgggtccaacacttctcctcacccctccactcaccccataagagcaccatcacttctaaacgcacattatattgccctacacaccgtagggctcttaacatctcacctattagcaaccatacttctcccacgtacacccacaataaaaccctattgc

SEQ ID NO: 596383 - DNA, 226 bp, Homo sapiens
  misc_feature (19)..(19): n is a, c, g, or t
acattgtctaacacttccntttattatttatttatttttaaaatttatttgtttatttttgaggcagaatctcgctctgtcgcccaggctgcagtgcagtggcatgacctcggctcactgcaacctccacctcctgggtacaagcgattctcctgcttcagcctcccaagtggctggggaggaggtcagaaggaagaaggaaatagatcggtgggtgaatggaggt

SEQ ID NO: 596384 - DNA, 181 bp, Homo sapiens
  misc_feature (111)..(112): n is a, c, g, or t
  misc_feature (156)..(156): n is a, c, g, or t
ggtcgcctctagacggatccccacctacgtccaccggttgggctaccaaacacgttgacgccgtagactgccgtcggacactggtgaacgggacgacctcgacacgtaccnntctgacggcttgtacggacgggtaacaactacgacgaccccagntaaacacttgtaactacacgcacgt

SEQ ID NO: 596385 - DNA, 450 bp, Homo sapiens
agatggacccttccagaagcgtgggcagctgatggtggtgtccttctgggagaagagcagagatacacgtgccatgttcagcacgaggggctgccgtgagcccctcagcctgacatggaagccgtcttcccagcccaccatccccatcgtgggcatcgttgctggcctgtcttgtaaagctgtcctagctgtcctaggagctatggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgcctgcgaacctatgagggtaccg

SEQ ID NO: 596386 - DNA, 231 bp, Homo sapiens
tccactttttgcattagttatggtaaatataacttagctttgttattatattgtagcaaagccacccccttatcacagaattcacatcattttaaaaatgcttacaaaattctatttgctaaattttaacctgctttacttgtattcattctaaatattttcactaagactcttagttttcgctttcggttaaatactcaaacacatttgattttttcatatttcactatc

SEQ ID NO: 596387 - DNA, 215 bp, Homo sapiens
cgacatgtggtagttcgcacctctttggctgtctgtcagtcaatgctactgtgaattctggtgtgtggggcttcttggctgttttgtatatcttcttgggcaacatgttgatccccgtcctttgtccgtgtttgaattgttttcatagttctttcctcttaaaacctgtgttatgattacattgattgagagtacgttgtaggaatggatttcta

SEQ ID NO: 596388 - DNA, 93 bp, Homo sapiens
ggtaacatgggggaggtgcagggtcgctgtgtgcttgctggtcgactgccatctcctggaactcgcctaggttgcccgatgcgctggcctaca

SEQ ID NO: 596389 - DNA, 237 bp, Homo sapiens
  misc_feature (174)..(174): n is a, c, g, or t
cccaagctactcgggaggctaaggaagaagaattgcttgaacctgggaggtagaggttgcagtgagccgagatcatgtcactgcactccagcctgatgacagagcaagactctgtctgaaaaaaaaaaagaaagaagtaacttacctcctgtaatattgtgatttttggccagncacggtggctcatggctgtaatcccaaaatgctgggatgacaggcgtacgttgctgcccagac

SEQ ID NO: 596390 - DNA, 138 bp, Homo sapiens
ccgttgtcagtatgcgttgcagtgggctgagatcgcgccactgtgctctagcctgggcaactttagtgcgaccccatcttggaaaacaaaaaaaaaaattttatacctcaaatttggacggacccttgacacgggctt

SEQ ID NO: 596391 - DNA, 106 bp, Homo sapiens
ggggaaaaaagggggggatttttttttttacccgggtttggggttgtttcccggccaaaggccagttttttttttccccccttttaaattaaccctttttttccca

SEQ ID NO: 596392 - DNA, 868 bp, Homo sapiens
agactctgtctcaaaaaaaaaaaaaaaaaaaaaagggatttttacctagttagcagcatggttctgggtagtgggggttgtgacctcattcaccccagggttgaaattcaatcaattccagtgggatgcgggaagttgcctcggggttctcgccgaaattctcccgggcagctttgcttgaaggcccaggggcaactcattatttggtggctcttccacctgtgggtctccagaggacggcgcacgctgttggattggtagtccacgcaggggcttggtttccaggggttcccactcttggcccagaattaaagggggaaaagcgcaagggtgtcaggctcagggcgattgcaagggcagacagggactacgctgaggtcacctggtctctggatttctttaaaaatctcccaaggaaggaaggagggaggcaaaattggaggaataaattacaatgttttatggtctggtgcccagggtttggaggggaaacagggcatggtggtggcttcgccgtggtggggaactgtgtttgaacggggcaaacactttttttctaaaggggggaggaaactttaaaaatacacccggaataaaggtgggatctaaacaatttccattttctaggaatttgtgtctccttaagaggagattaaggcagaaagacaacggtcgctaagattgattgtacccggggaatatttttacattacgcaaaccattgtgagaaacagattccaagattgttccaaaataagggggaagaagatataccatggttggcatattaaaactttatgtagggaggaaagattaggggagttgggacaaatagcatggatatactggaagatggaacagacggaat

SEQ ID NO: 596393 - DNA, 258 bp, Homo sapiens
gtttccccgatgctctcctctctagttcactatgcaaggctgtgatcatcctggggccaatgaaggaccgagtcaagtgatgacctggatctccgtaatttccaacataagatttcggatctctgtggtgccacgatacagagtccagggaaggcccaggaggacgtgacggcttgtgtgccctggagaattgtctgctctacatgttttattggaacaaggtctagggatcacgattcgtagggcctatattggagg

SEQ ID NO: 596394 - DNA, 92 bp, Homo sapiens
agacggctccaaggatctttcggcagctgctgttcttagggagagcagagaccatgtctgaacatagaagaggttgtggagcgtcaccaggg

SEQ ID NO: 596395 - DNA, 500 bp, Homo sapiens
gcagacagagtatgacattaattcctgcagtgaacaactctatagacccttcaccctaatgtgtccatttaaatggagccctatttgctatgcacacactttttcaaagaatctattagagaatgtgaatacccagttataagccacaaaaaagaaagcaacaaaatataatgaaatccccattacatccctttgccctataatactttcccttgactttgctataagcattcctctggcattcccactcctgacccacaagattattaaatgtttattgtctcaactaactatgccaacaggttcgtaatatcgatacagagaaagtggaagactctgtgaaagttatttacattaaacatgcaagtgtaaaaaaggattgttgagccacaggagtgagctaagaaggcagttgtgaattctgtgcattcaagatgaaacaatgttatttgtgtgtgttagctgcctggctgagtcaataaagaagattccaatttgga

SEQ ID NO: 596396 - DNA, 844 bp, Homo sapiens
atcacgttgtttgcaaatcactttcatgacaatacatctatttcaggtgtatcacacctgaaaaaaacatgagtactgtgaatttgtggattttcaggctcaatgcagaaaaacaccccccaaaacaaaaaatcacaacaatgaaaacaccatttccagagctgtgctgttattcgtgtgacgaatagtgaatgtatgatcataaaatagaataagctgtctttagatgaagtttgggcacagtttatggagtaggtaacagttaatcattgtttattaggtacataatccttaattgaaaacataaccatatagcagcagctttcatcttgtgtcacaaaaataactggtgtatcctctaaatttgatttgtctaataccttaaaggaaggcagaatagcatggacaagaacttgagttcttgagccagactcgatctgctccttgctaggtgattaaccttagattggtttcttggccatttgctggcccagagatttttgaaaaagttaccaactgctcagcttcatcatttgtaaaatgaggttaaaaaaaattctgcggcctggcgtggtgcctcacgcctgtaatcccagcactttgggaggccgaagtgggtggatcatgaggtcaagagatcgagaccatcctggccaaccaacatggtgaaagcctgtctctactaaaaatacaaaaattagctgggcgtcgtagcagtgcgcctgtaggtcccagctactctggaggctgaggccaggagaatcgcttgaacccgggaagttgaaggttgtagtgagccaagatggggcactgcacttcagcatggcaacagagttgagacttc

SEQ ID NO: 596397 - DNA, 691 bp, Homo sapiens
  misc_feature (242)..(242): n is a, c, g, or t
  misc_feature (260)..(260): n is a, c, g, or t
  misc_feature (289)..(289): n is a, c, g, or t
  misc_feature (291)..(291): n is a, c, g, or t
  misc_feature (307)..(307): n is a, c, g, or t
  misc_feature (356)..(356): n is a, c, g, or t
ggctccttagctgagcaggcgagagcatcatggataccgacttatatgatgagttgggaattatatggaccagagcttgattctgatgaagatgatgatgaattgggtagagagaccaaagatcttgatgagatggatgatgatgacgacgacgatgacgtaggagatcatgacgatgaccaccctgggatggaggtggtgctgctgaggacaagaagtactacccaagcagccgaggaggngtatggtcctgaggtggngaccatagttcaagaggaagacactcagncntctcacagaacccatnattaagccagagaaaagcaagaaatatcactctgatggagacagacatnacctgatacggtgtatgagactggcataccttgcgccggcatccgaacgcgcataacacacagaagaccacaacagaagactgctgaccccatacgccagacaccatcctccagccaatggcaacgaacacatgaacccccgcaaggaataggccgacacaccaaacagactcacccccgggaaaacacaggaaaggcggcccacagacccccacgcaacccaggagcacaccacccgccaccacccccgtcgcagcagcaagccacagcaagcagagcgcggtcaaggcacaccacaaagccaccaacccggccgaacagccggaccccgccca

SEQ ID NO: 596398 - DNA, 318 bp, Homo sapiens
agccggtccagtgctactccacaaacaggctgtagtgcagggcacactaagtatccatttcattccattccattccattccactccatttcactccactccactccactctattccattccactccactccactacactacactacactccattcaactccttgtgtttccattgcactccattccattccactcctttcaagtaaattgcactcaactcctttccactccatttcactccactccattccattccactcaactgcactgcacttcactacactccattccattccaccacattccactggctataca

SEQ ID NO: 596399 - DNA, 158 bp, Homo sapiens
ggggggcccccccgggggggccccccccccccggtttccccttggggtttttttggggcttttttaaaaaaaaccccctttgggggaaaggggaaagggccaaaaaaattttttttttttccttggcccccgggggggggggggggtttttttgggga

SEQ ID NO: 596400 - DNA, 145 bp, Homo sapiens
gtaaagcgtttggtcctcacttcgaagcaccaattatgcttgctaactcagcgcgtaaccgttctgcgtctatccgtattccttacgtttctaaccctaaaggtaaacgtatcgaagctcgtttcccagacccaatgatgaaccc

SEQ ID NO: 596401 - DNA, 215 bp, Homo sapiens
  misc_feature (77)..(78): n is a, c, g, or t
atgtgttttgtgtatttacctgtagacattggggggttttgtcatgttgaccatttttcattgtagagatggggggnnttgtcatgttgcctgaacttggcttaagggatccacccaccttaagcttccaaaggtcttgggttacaaggattagccccttcggccccggcaattttttccctttacacttctctgtgggcacacaactccctttt

SEQ ID NO: 596402 - DNA, 144 bp, Homo sapiens
tacatcctgcagcgcatgtcactcccgcagcccacgcacaggcacccagcgtgaccgggacaagtacttcattcgagcatgagtatctgaggatcagcactgccagtggcagcatgggcgtccgtcagcggcctggggcatcct

SEQ ID NO: 596403 - DNA, 396 bp, Homo sapiens
  misc_feature (59)..(59): n is a, c, g, or t
  misc_feature (87)..(88): n is a, c, g, or t
  misc_feature (143)..(143): n is a, c, g, or t
  misc_feature (187)..(187): n is a, c, g, or t
  misc_feature (204)..(204): n is a, c, g, or t
aaaaaaaaaaaaaaaaaaaaaaaaaaaaaaaaaaaaaaaaaaaaaaaaaaaaaaaaaanaaaaaaaaaaaaaaaaaaaaaaaaaaannaaaaaaaaaaaaaaaaaaaaaaaaaaaaaaaaaaaaaaaaaaaaaaaaaaaaaanaaaaaaaaaaaaaaaaaaaaaaaaaaaaaaaaaaaaaaaaaaanaaaaaaaaaaaaaaaanaaaaaaaaaaaaaaaaaaaaaaaaaaaaaacacaacaaagaaaaggacacaccccaacaggaaatcccacgcaccacacagagcgcgacgctcacaacctccccgcaccacgccctctatatcactcactcccccgctccccgtcctcccccctcaccgggggagcaccgcatgagggcggcagcaaaaaga

SEQ ID NO: 596404 - DNA, 358 bp, Homo sapiens
tacacagctccttatcccctggcagcactttaaaaaaaaaattaggttcagggggtacatgtgcaggtaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccat

SEQ ID NO: 596405 - DNA, 406 bp, Homo sapiens
aagggtaccgtgaagaagatcactcccaccaggcccactccaacacgggaatcacatttcaacatgagatttggagaggacagacatccaaaccgtatcaggtagtgttgaggttgttgaggtaagtgtatacaaagctcttagcacagagtgaagctcagtgaacaaatggctcttcttatgaagagcagccctcagcggaggcatggcacctccttcaagagaaccaaacttggaaaccttgaattaggaagtgattactcactttacagggaatgactacggtaatgatatatttgctttctgttacctaaacttagcagcttacatatttatcatctaatggtttctttagctcagaaatgtgggcatagctttatgggtcctctacttagggtctctcaag

SEQ ID NO: 596406 - DNA, 244 bp, Homo sapiens
  misc_feature (16)..(16): n is a, c, g, or t
  misc_feature (25)..(25): n is a, c, g, or t
  misc_feature (30)..(31): n is a, c, g, or t
  misc_feature (64)..(64): n is a, c, g, or t
ccccaaacacaggtgnaggggcggncgggnntggaaaagatgtgcgaatttactaccaccctgnattcagcgtgcgttcctgggccttgtatgcactagagtgccctcatgcttggcattaggaatgggttggaactgcaggcatttaggctgtccttctacaaccacagaagagccatcactggcagagagatcctttggcggagttaagcagagatcttctcagaagagcttttgaatacat

SEQ ID NO: 596407 - DNA, 492 bp, Homo sapiens
  misc_feature (427)..(427): n is a, c, g, or t
agtactggatataggcatgaacactgcgtatggccatatatgggattttaacaggtaggtgatgggatcagacttgtagtcactttgttggctacagtgtgaagaaggagttgaaggagagaccgagaatagggagaccagacaggaggggtggtggtaattgtctaaacgtacattgatgagaacctaaattggaaacagatgtgagatctgttaggtcctggtggggatagcacatagcacattatttttgacaatttgcttgtctgtcattggactataggcaatttgagagcagggactgcttgtcttgttcaccattctgtcttctaccaggataccttgaacatcttcagtgctcaatagttgctgaatgaataaatgagtctgagtaactccccggggatacaggggagaacggtgaacncctgtaaccctagagcattaccaaccgggactgcatgtatgagtgggcaaaactggccacatggg

SEQ ID NO: 596408 - DNA, 274 bp, Homo sapiens
gttggggctcattcaggattccagcatccttcaccacggggcaggagtcggccacagagaggggtggatggccttccctcacatttccaggaacggagtatctaccaagatcaggaacaaaggatcttagagttccgggaagagctgggggaagggaaggccaccacagcacatgatctgtctgggaaactggggactccgaagaaagaaatcaatcgagtttaatactcccgggcaaagaagggcaagctacagaaagagggtaccgagctcg

SEQ ID NO: 596409 - DNA, 294 bp, Homo sapiens
  misc_feature (20)..(20): n is a, c, g, or t
  misc_feature (49)..(49): n is a, c, g, or t
  misc_feature (108)..(108): n is a, c, g, or t
  misc_feature (141)..(141): n is a, c, g, or t
  misc_feature (206)..(206): n is a, c, g, or t
  misc_feature (252)..(252): n is a, c, g, or t
ccagagagtaaaagtgtttnaagaaggagcaattctatcgattttgatnttgggaaatcaacacggcataattatgtcaccggagcctgaacaactccggtgacttcngcgctaaacggggacgtttatgcgcacatacantccaaactctcttctcccttcacagatgcagaaatgcacctgcaattctttgcatctagcgtttnacctctgcggaggggaagcgtgaacctctcacaagacggcatcaanttacatcgcggcaacttcaccgctatcggtcggcagatccag

SEQ ID NO: 596410 - DNA, 777 bp, Homo sapiens
ctgccgtatggtaacagatgtagccacgtgacactttctggtcagctttcacttcccagagggggtccttcctgagccacagctgctgcctgtgcagcccttgaactcgggcccataccctctcacttcctgggcccgaaatatccacaggggagtaaagccaggaacctggtgctcactctcatctgtaggtcagggtgcacacaggaagggccatgccccaaggaaagtgcttgctaggctaaccctggggccctggcgtgtctttcgatttcgacacgcgcctgaggccatggcacatctctagctctcgtcgttcttgacgaggctagagggtgcggtttcgttgtgcacactgcgggtagacgctagtggagaccaagtagtcgttcccctggtacatacagacatgccctgggctagtgcagtgtcgcgcattcctttgggaggacgagaacgggatcagtgttgctgacagtctggtctagtagccccataaagagctcatggagcaccggcgtagtggcagcgtgggctatccgtgcacagtctggagtataagagggaagcgatgttaacgccccccgtacacccgaggagctcttgcagacacgacgacagcagcaggcaggagcgtcaatggtgcaaaggggagggactggatgaggagttggtgaaaacacacgctggcctggacgcgagaacaagtttgaccctggggatctacatgcagatgaagctggggcaggcgcccatgcctggaacccacagtgggag

SEQ ID NO: 596411 - DNA, 105 bp, Homo sapiens
gtgcaatgattaaactagtatagaaaataaggaaagattatagtctgaataaagtaagatagaaagcagtttaaataatcgacaaaaaaatcttctaatgcatta

SEQ ID NO: 596412 - DNA, 421 bp, Homo sapiens
cagaatacggcttaccaacattggactcggacccaccgggaatcagtgtcgacgagagtaccgtcgacatcccacaagacagcggcaaagaaacggtcggcggtcgcagtgtgcgtctcacgtggcattagaatagtttgcctccgggtgatggacgacggaggcgtcggtggactggccaggatgaagcaggaactcctctgacagttgtacaccgaatccacgtcggatcgagtagttacaccaccttgacgcgatcttacgaggttcggacaggttggcggtaaccgaaactgtaccggcagccacgagaagtatggtgatcgatggcgccagtgccaagggattcaccgtcaaggcggaaccggtttccgaccccatgagcatggccccagtaagcgtcgtggactccggaaatgac

SEQ ID NO: 596413 - DNA, 509 bp, Homo sapiens
ttttttttttgtctttttttgtgggggtttccaaacttttattcttttattaaaaaaaaaaaagggccagatacccttttgttaaagggtttaacaaaaggggtgaaacccttcattttggccgccaattggggcccatctcccttaatcactgttgggggtaatcaaagcaaatatttttaaaaatccaaacctccttcagggttaaacccgccatctaagttttatttttccaaaaattaaaattaatggggaaccttaacacaaaaaggggctttaggtttttctcaaccctgggggaacatgtaaagaaataatgcttactggtcaggaaaatacttttaaagggtcactacagacttcctagactggggggccattaaatgggctgcccctttaagtcttccaaatttcatatgcaaagattttaccagttttttgaaaatggacagtttgttctacatgtataaatggcagttggcactgggggggggttggggaccttgctg

SEQ ID NO: 596414 - DNA, 446 bp, Homo sapiens
  misc_feature (7)..(7): n is a, c, g, or t
  misc_feature (443)..(443): n is a, c, g, or t
ctcgtgnggggctggatcgtgttgctgccctgttaaacatgatgccctttgaaactctccgcctttgaaactttcctaccccctcccttcaatcttatccctaacccaaatgagaataatgacatattgaaaacagcctctagcttcaggctgggcacggtggctcacagctataatctcagcactttgggaggctgaggtgggagaattgcctgagccccaggagttcaagaccagcttgtgcaatatagggagactccggctctacaaaaaagagtttttcaaaattagccaggcgaagtggcacacatctgtggtcccagctgctcaggaagctgaggtgggaggatcacttgagcccaattcaaagctgcagtgagctgtaattgcatcactgcactccaacctgggcaacagagtaagaccttgtcttaaaaaatcantaa

SEQ ID NO: 596415 - DNA, 159 bp, Homo sapiens
agttgcactggggtaaacgtatagctcccagtaattctgttactgatgttgctagggccaacagttatccctaccaaatcgcttgacagcaacctgcaagatattattcttgcagatagtgatattaggggtcagagaagcaagatcgcctggtactca

SEQ ID NO: 596416 - DNA, 212 bp, Homo sapiens
ccagcatgtacatacattattccatagctacttaagtaaatcgtgtcgggtgcagtggttcacacctgtaattccagcactttgggaggccgaggcgggcggatcacgaggtcaggagttagagaccagcctggccaacatggtgaaaccccatctctaccaaaaatacaaaacttagccaggcatggtggtgtgcgcctgtagtcccagct

SEQ ID NO: 596417 - DNA, 273 bp, Homo sapiens
tttgccaaagcgacggaacctgtcaggacgcggccatcgggggctacaaggactagccctccatctggtccgccggccccgggaaaacgttagtcaacatcacgccacctcaggtgggtgtcctgcttgccaaagaccgcccaagttcttacgtgaatgggctgacacttgggggccagaaatgatcggtgatccgggactcactgctgcaggatggggaattaagcatggatctttgtaccaagagcaccgatggggccggcaccttcaatg

SEQ ID NO: 596418 - DNA, 207 bp, Homo sapiens
ctagaggatcccgaggcttcaacggaactttaattaataatacatcaatactgggtcatcaattgcaattaatctaccacatcaatgcaagatattaataggggaaactgaggggggaggaaggtgagagggtttatgggagctctctgtattttcccttcagttttttctataaacctaaaattgctctaaaaaatatcctattta

SEQ ID NO: 596419 - DNA, 165 bp, Homo sapiens
  misc_feature (49)..(49): n is a, c, g, or t
  misc_feature (125)..(125): n is a, c, g, or t
  misc_feature (129)..(129): n is a, c, g, or t
  misc_feature (160)..(160): n is a, c, g, or t
gatccatgatgataattaagagaagagaaaaaaagatattatttttgtnaggcaaaccattgtagtttttaacaatgtgtatcctgtgtgccctcacaccgttttccttattctacgtttttttncctntttttaaaaatattatgtactatatttttangtctc

SEQ ID NO: 596420 - DNA, 198 bp, Homo sapiens
agctaccatagcaggaagtaatcctgtaaaaaaatgaagcaaggcaggtaagacagattctaagtcccatgcagctcaaaacgacaattacattgtcatttgcgttgtgaatacttctaggttctatatgggctgtgatcttggtactaactgctattatggagaatgtgttggcatcgcagcaaaaggaggctaaga

SEQ ID NO: 596421 - DNA, 589 bp, Homo sapiens
  misc_feature (168)..(168): n is a, c, g, or t
  misc_feature (188)..(189): n is a, c, g, or t
  misc_feature (331)..(331): n is a, c, g, or t
  misc_feature (377)..(377): n is a, c, g, or t
  misc_feature (469)..(469): n is a, c, g, or t
  misc_feature (483)..(483): n is a, c, g, or t
cttgaaggtcaagagtggtcccagcgatggtgggccctgcagaatgaagggaccctcaccccaggaaaccctgcagagcagggtccccactggggaggggccctccggatcggaggctctcactgtagggggcctcagccactctcctggcccatctgtttaattcangcagataaaatccaattagnncccctgattagctgcgtcttcagatttgctggcacataaaaccttgacctaaaagctcatttcctgcagatgtttcagatcgatgtacggactctgcgctttctcttaatgcattcatgaatttgtcagaacccggcccccnaatccatgatttaattaagctccgttccgtcagccagggctcaccnagatcctcatttgctttcttcctctcaaagcccattaataagagaaaaataggacagaaagctccacagaggcgggaagaagggctcccttncctggcccactggngcctggccctacacaccgggaatcggggcagaggcagaacctgagcgtgggggtctttgagggctccccggtcagctgtgcctgagccaggcacacctccagtgat

SEQ ID NO: 596422 - DNA, 588 bp, Homo sapiens
agcgggggggggggccagcgaagccgagtaaaaccgccgcccgggagaagactgaaggagcagttgccgccgttggtggggcccgagcagttttcgctgctgctacggatgttgccatgaggcgaggctagggaggacctcacttccccggggtgtaataatgttaactgaggccagatctatccatatggaggatggggaagcctgggcaatggtcctttttctgataaccttgtggaccctttgtaactattttagttggacatttaatatcctcggcgtttgtgaggtggagggttacacgatgagttacgtcatccttgtttgggaaaaacaaacttcagagaagtaccttagaacacgtggtgaacacgtcaatttcttcctccaagcatcaaccgggggtccctaagtgcttagaaagaaatgaaacggggaagaccaggcaatattaaagatgtgatagacagattgacgggtgccaaatataaatgtgatgaaaccgtctcaagaaaaggttatccagttattcacattgcagggattactgtccagatatgggaatttatacactaagacgatgatggc

SEQ ID NO: 596423 - DNA, 295 bp, Homo sapiens
cccttttcccgggggggggggggggccccccaggattttttgggggaagggccccaaaatccccccctggggggccttttgggggggccccctttttccccccccccttttttttttttccaaaaaaaccggggggggggggtttttttccccccccccccccccgggggggggggggggggggtttttttgccccgggaaacctttttttaaaaacccccccccccccccccccctttttttacccggggggatttttttttaattaaaaggggcccccctcccctttgggcca

SEQ ID NO: 596424 - DNA, 896 bp, Homo sapiens
cgtcctgctctccggcgtggcttctctaattccattgttttttttagattctctcgggcctagccgtccttggaacccgatattcgggctgggcggttccgcggctgggccctagggggcttaacagtagcaacagaagcggcggggcgggggcgcagcagcagcagcagcaatctcttcccgaacacgagcaccacaggcgcccgaaggccggaacaggcgttagagaaaatggcagaccgatattgatatgaagcaagtgctgaggctccttacaagaaggatgagaacaagttgagcagtgccaaccggccattgaagaacgtagcaaaaagaggaaaaaaagcaagagcagaagtcgtagtcattgaacgaaagagaacgcaaaagtagggaaccggaagcgaagttagacgcccgagacaggaaaacagagcaaaagcggtgaaagaaagcgaagttagaagcaaagagaggcgaggaccccgttcaagaagtcgagactcgaagatttagaggccgtacagaaagtccttactccggaccaaatatttagcaggtgccactccgaggaaacgtatggggtggcctcataagcattccaattaagccagacgatgttccccgagagcaagaaggtccattcagaaaagacacaggagccgttgtgaagaagaaacactattggataatttaaccttcctggaggaaagagacttgcacaggccagttcttcttgtatggcagctgggggaagaaatttcgacgccagcggtgtggaaggagttttctcctacaggaggcaaaggttcgccgatgtggggtgatttccggaggaacattcaggacgttcccaaggggtgctatttggggcgccatagcggcggtcacaaagg

SEQ ID NO: 596425 - DNA, 214 bp, Homo sapiens
ggggaaaaggtttttggcccccccaaatgggctcttcgctttcccgggggtcctgggcttctccctggtggacttggggtgggcaatttttcccctggggccggaattatggggcccctttttctatttttggggccctcttaccaaattggcggtttcttggccccatcaagttttgctgggtacatacccccttttttttgtgtttggtcca

SEQ ID NO: 596426 - DNA, 220 bp, Homo sapiens
  misc_feature (1)..(1): n is a, c, g, or t
nccagtcagtaaatatgcttgtataattacggtgttcatgcatgcatagcagtgcatgatgccgtatggaaaaagcatgtctttagctcaagaagagtaagggagacaaatgtagcaagcagaaagcaaacacagacttgggcaagatttagccagactggaagtctaacacttaaataagcattctcttggccacgtaagaaactgcagttgttgtggg

SEQ ID NO: 596427 - DNA, 495 bp, Homo sapiens
acctggggtagtcattcaaatagaaatatttctcatttgcttctcaggcatgtacacttttctcttactgcctttccgggtcagttggttaggatctccaggactctccactggttgtgatcagagctctggctccaagagctgtatcatgagctccgtgacttcaacagtgggaaccggggtgcctggacggtctgcgtccattgccgtcagaaggtggtgctggttctggggaagaaggtttggctgtgcttggttctgtgctcgttttcccttcaaaggggcttggcttggcagccgtaggtgacagtactttttttttcctttcttaatttttgatgcctggaacaggggctgaattaagagcatccagaaagcccaggccctccataggctgtggcgggatgatcttcactttgatctctttggtggcataaggtgttgtgttgagtggcttgtatatcttctctgcagggggagtggcatctcctggat

SEQ ID NO: 596428 - DNA, 969 bp, Homo sapiens
  misc_feature (323)..(323): n is a, c, g, or t
  misc_feature (326)..(326): n is a, c, g, or t
  misc_feature (362)..(362): n is a, c, g, or t
  misc_feature (386)..(386): n is a, c, g, or t
  misc_feature (419)..(419): n is a, c, g, or t
agattaaggtgatactatctgatggcttggaatgaaaaccaaactccctgccacaacatgatgatctttctctgcaacttcatattttgcctcttgttcctcatttgttaccactgagtcacaatggtctttttagtttctcaaacacaccaagatctttcttgcctcatgtgacctagaatgttttctccctttcttcatatctcagttgaaaggtctcctctcctcatcatcatactatctaaagtagattccctcccttgttaacctctagcgcagccattagttccttcataacacttaccctaacttgcaagtatttngtntgtgatataatttttatctgacttccccactaaaangtaagctccatgagggcaaaaatngtgtgtttgtatactgatgcatctctagcactnggtatagcaggcattcaataaatatcattaaataagtttcaaaaaaaaaaaaaaggaaaagaaaaaaaaaaaaaaaaaaagaaaaacaaaaaaaaaaaagaaaaaaaaaaaggaggggggggggcgggagacgccacgggaggggcaccaggcaccgccccaagaggcaaaaagaggagtccataggggagtcaaaaaaaagggaagccggcacgccagcggtaaaaacaaaaacaccgcgggacgagaggagaacacaaccggaccggacgtgctcccacttgggtggcagaaccaccccaatcatggcgggggggcgacaagagatcagaggggacccacaccacccacacacgagaggagaaatagaacccgacgagcaagaaaaaaaaacaacagcacagactgtgatactgtcggcacacccaagcgcatatgacagtccggcgggaaaaaaaaagactcgaccacccaactatcgttagtagagagacacacacctcacggcggcgggtcaaaaccaaaccacccgacacaaacacacgtaacg

SEQ ID NO: 596429 - DNA, 182 bp, Homo sapiens
ccccgggttgtaaacccctttcacattttcccttgggttgtcaaacaaacacggcccctttttttgaaattttttgttttttgggccccttaaaggggccgaaattttttccttgggggggtccggtttttagggttttgttttccggtttttccccttggataaaacccctcctttttcca

SEQ ID NO: 596430 - DNA, 307 bp, Homo sapiens
gctcccaaaggccccacctcctgataccatcacagtggtggttaggccttcaacatatgaattttggggagcataactttcctctataacaccatcagactcagattaaagtgcctcatcatgggccttcaaggctctgcttgttcctggccttgcctgagcctctaacccaggtgcttctcttgcccccccgggggacatttggcaatgtctggggcctttttgggtagtcacagcttgggatggagcaaaggaagggtgttactggcatcttagcgtacaggccagggatgctgcttaacatcct

SEQ ID NO: 596431 - DNA, 742 bp, Homo sapiens
gagaatcacgggcttcatcagtgaactgcactaatgaggactatatctgctatacactgctgaatactctgaaaatccatcctggcggcgctaggtgaacagctcatctacaccagaggtgcctacatagaaagcgcctcagactcctacgcaacttatgaaggctgtagggtgccaaagactcatgatgtcctgctgctgcttgatgagctgtgtgctggggaagccacatgctctgcggcgttcagaggctcatgcgcagccaacaagtaccacacatgaggtgcccttgctcctataatacctcttctgtgccctctattgacaaagcttataccctctctacatacatctctagcctctggtgcgctcaacattagtgagtgcagagctgcgatatatactgcatgtgctgcagagtgcacactgtacctgcactggagagaaccatacctgtgaagtgccacaaatagcacctgtatcattcagggggcctgtaagaaatgtcagtgcactcacatatggacagcttgagaagagtactctgtcatggacactacgcgtggagctacggacactcagacatgatgtagtcgttgctcacaccccccaataacatgtctactattatgctctattatgtctctgttcaacatgtgagcatatggtgctaccacagacacaagatgcatcttatatgatagagacaggtatattcccactacctgtggatagagtttcc

SEQ ID NO: 596432 - DNA, 164 bp, Homo sapiens
cccgctacgtgacacccgctacggccatccacacactgtagccacggtccatccacacactgtagccacgtgccatccacacactgtaaccacggtccatccacacactgtaaccacggtccatccacacactgtaaccacggcccatccccgtagcgggggtg

SEQ ID NO: 596433 - DNA, 291 bp, Homo sapiens
taatgcaccccagtaacccaagaaggaccatggggtccctataatcaaatccttggagtttttgtttttgttttgagagagggtctcgagtggatgtgtctatactgaacatgtatagacttttttccttgtcattattccctaaacaatatagctccatagcatttacactgtatgaggtattataagcaacatataatttaaagtatacaggaggaagtacatgggatatgtgaaatactacagcattttatatcaggaacttcaggatctgccgatattgatattcat

SEQ ID NO: 596434 - DNA, 174 bp, Homo sapiens
ttttcttgttttcccttttaaaagtttttttccttaatgtgaaagtaatttgccccagttataatgcatttttgtttttaacaaatcccccccttaaacggagctataagggggcccaatttgagacccattaaattccttttagttataataaatttaatatttgtaaatgta

SEQ ID NO: 596435 - DNA, 480 bp, Homo sapiens
gtatcaggtgtgtgtggttgggctgagtgtccttgtaacattgatacctaagttggccttggttgggaacatagccatgcagtgcccctcgtgggtggggctgccagtctgtcattgacctcattgtgtcagcaccttccccccaatggaggctgaccctgccctgccagctgagacttgggagacggagttgggctctgatcccagtggcttccaggaaatggctctggctttggagcagaagcgggttctaggacttagttgccctcactcggtgcctgggttccttgtgtgtgtggaaagggtagggctgcaccttgtgaaagagggttcagggagctctgaggacctggctcgtgctagattgctcagtcagtagtgtgtaaaagcagcagccggaagtgactgctttcagtgtgtagtggtgagtgctagttgggcacccttgggcttggtttcccagaaaatgtgtaaggcagg

SEQ ID NO: 596436 - DNA, 603 bp, Homo sapiens
ccaattttttttttgtttgtagaaatgaggtcttgccatgttgcccaggctggtctcaaactcctggtctcaagcgatcctcctgcctcagcctcccgaagtgctgggataaaaggtgtgaaccaccatagccctagccagtattatcttttcgctttcattttccaggttgaagtagtacttatggggctacaatttgcttacgctgaactaaacctagtacgtgttaagcgcgctggatgaacatgtgctaaagcttgtcaaggggataataattggtcataagggaagaatggtatgggtccaacagcgtaaagatatacacctattggccaacgaagggaactttgtgaacgctaggggccaaacaaattcatagggggcaaaaccacaccgaacaaaaccattacagggcccatgttgcaaaagcgttcccttttcattttaccgacgaaggtcactcaccacggactacaactccttaacgatgtacgacgtacagttcccctccaagtgtgtcgcccacttttgggcccatatagactttcgggttttgtacccgattttgacttcatctcctcgaccatttctccctttaatggg

SEQ ID NO: 596437 - DNA, 683 bp, Homo sapiens
tacaatagatctgtgctaaaagggggggaagaagggtacttacgaaacccatattaatggggcagcatcctctgaggcaattggttaccaataagacgctattgcattccaggagcacggtgagcataaaatgaggagcgtcagtacgcgatgagtttaataaatacatccaagagctagtttgggccgtggggagctacatgactggccaggaaactcctttgaccagatgaacaggggcttggacgtccataacgggggtctatataccagatgaaagttctcgctactgttccagacatttacatcattggatgagctcttgaggtctcaggaaaaggaggctttctttttgtgttaatggagccgatactccctatcacgggttaagtagagagaccgtgcataaagaacaggagcaggactcctagtttttgtaaacaggtgtcacccacaggggggaggaaggctttaacagacagccgcggagggaaagctgaactggggctattaagccgttttaacaagcccagttggggcactaagcccatttttgccttgagaaaggaaagcgtggctcttggggcgacagggggcacttgcgcggtaaaggccgggcctcttgagaaacaaatggtaaccgtctgctttaggggggcaccttgtgtagattttggggtgtg

SEQ ID NO: 596438 - DNA, 219 bp, Homo sapiens
gttcatctacataaagagatagtagcatacatctatcaatgttagctattgacaagacaatttaacatttcatcacattattgcatgtaacctccatataaacttagatgcggacagtattaatccagaattgacctttcgacttaaagcagagggactttgtatagaaggtatgggggctgtggggaaggagagtcccctgaaggtctgacacgtctg

SEQ ID NO: 596439 - DNA, 327 bp, Homo sapiens
  misc_feature (44)..(44): n is a, c, g, or t
  misc_feature (46)..(46): n is a, c, g, or t
  misc_feature (52)..(54): n is a, c, g, or t
  misc_feature (74)..(74): n is a, c, g, or t
  misc_feature (76)..(76): n is a, c, g, or t
  misc_feature (79)..(79): n is a, c, g, or t
  misc_feature (83)..(83): n is a, c, g, or t
  misc_feature (85)..(87): n is a, c, g, or t
  misc_feature (116)..(116): n is a, c, g, or t
  misc_feature (149)..(149): n is a, c, g, or t
  misc_feature (161)..(161): n is a, c, g, or t
  misc_feature (176)..(176): n is a, c, g, or t
  misc_feature (183)..(183): n is a, c, g, or t
  misc_feature (192)..(192): n is a, c, g, or t
  misc_feature (198)..(198): n is a, c, g, or t
  misc_feature (202)..(202): n is a, c, g, or t
  misc_feature (217)..(217): n is a, c, g, or t
  misc_feature (240)..(240): n is a, c, g, or t
  misc_feature (312)..(312): n is a, c, g, or t
  misc_feature (317)..(317): n is a, c, g, or t
aaagaataccaaaagctgaagtctagaaccgaagacacatatanangatttnnnaatggaaccagccaccttgnanaantatntnnnaagaacatgatataaactttagaaaatanaacttttaatacttaagagataacatgatgcanacgttgcttgtnggcctgactttccangactaanaccctctgngaatcnatgnggctcggtgacatgncgtaacctgctactggggtgtgntctcagacacaaaatcacactggatgttggtctacagaggcaggattctctcattgctggatgactctgganattangcctttgcaa

SEQ ID NO: 596440 - DNA, 413 bp, Homo sapiens
  misc_feature (28)..(28): n is a, c, g, or t
  misc_feature (49)..(49): n is a, c, g, or t
  misc_feature (64)..(64): n is a, c, g, or t
  misc_feature (68)..(68): n is a, c, g, or t
  misc_feature (111)..(111): n is a, c, g, or t
  misc_feature (120)..(120): n is a, c, g, or t
  misc_feature (137)..(137): n is a, c, g, or t
  misc_feature (201)..(201): n is a, c, g, or t
  misc_feature (228)..(228): n is a, c, g, or t
  misc_feature (270)..(270): n is a, c, g, or t
  misc_feature (274)..(274): n is a, c, g, or t
  misc_feature (294)..(294): n is a, c, g, or t
  misc_feature (325)..(325): n is a, c, g, or t
  misc_feature (327)..(327): n is a, c, g, or t
  misc_feature (346)..(347): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (408)..(408): n is a, c, g, or t
agcgcggattgcacgggttgccacctcnagcgcagacccctgtgcttgngcagactctgacggncatngtgggtgcctggcttgaccacattcttacccatgggattcggntcaacctgnaaggagcgctgcagctnaaacaagactttggagtggtcacaggagttgctggaagaggagcagtggagcctgtcccctgancttcggcagaccctggtcatgctcagnatctttcagcagctggatggggccctgctgtgtctgttgcancagnccctggccaagtctcaagtncacaggagggccccctgttgctgtgcttgtnangaggtccagaccacgttgnncagcagntggctnaatagnctggagagcttggagcccccgcttcagactggcatattcagnccagc

SEQ ID NO: 596441 - DNA, 745 bp, Homo sapiens
gcctgtaatcccagcactggaaggccaaggcattaggattgcatgagtccaggagttcgagaccagcctaggcatgataagaccttatgctaaaaaaaaaaaaaaggaaataaagatagaaaattgccatctgcaaatgaaaaagccttcagccgacaccagactgccagtgcctttgatatgggactttcagttccccagaatctgtgaaaaattaagttctatgtcgtttaagacacctagcctggggtatttggttagtcgcacatcagaaactgactgagacaggcagtaaggaggagaacagaggttccagcctggttcaggtccaggcagttctgccattgcccctaactcctcagtgccagtcatgggccaggcccctgggggactgggaatgagtaaacacatgcacctattggttaaggttcacggcggggtccagaaggggacggcaagacccatctgcgcactcatgacccggacagaggccataaataccgagcacctcatggcccaggcctggaggattcccacataccctaccaggccaataacagagggaccctggagttggtggtacgcaagatagcagttcagtgcttgcacacatactagttgagaacggcaaatcaggcctaattgaaacagtcaactgtctggcagagccagggtcctttctgcatgataccagttcggatgtttgtccctttctaatcttatatgggaaatttgatcccagtgg

SEQ ID NO: 596442 - DNA, 214 bp, Homo sapiens
gtcaacacgactaattcaccgcccaacaatgactaatcaaactaacctcaaaacaaatgatagccatacacaacactaaggacggacctgatctcttatactagtatccttaatcattctatttgccactatatagatccccagcttcatgtatctcatctatagcagcctatttaacagcgaatcccacggtgcgttgtccctcatgagtata

SEQ ID NO: 596443 - DNA, 142 bp, Homo sapiens
actagagcccatatatccatgctgcacttaataggggctatagtctcaagaggatctgtgcattctctcccatcaccctacctctcacctgaacttttggaaagataatctggccttctggatgatgtttcgcagagcaaaa

SEQ ID NO: 596444 - DNA, 160 bp, Homo sapiens
aataagataaatgcaagcgattttttaaagtttaaacctgactatttttatttttgaatttacagatcaaatgattctgatgatattgttcccgaaactgatgaagaaagtatttgtgtaattagtgaaagtgaagataatcatgatagaattgaagaag

SEQ ID NO: 596445 - DNA, 216 bp, Homo sapiens
ttctacctgccagtggacactatgatataggccaggtgagtgcacactgggacactatgatgaggcaggtgaggggacactggggcactattatgaggctaaggttagcgcacaactgggacactatgatgagggtaggtgagcacacactgggacactaataaatgaggctcggtgtgtgcacacggggacacctaatgattgaggctaagtgag

SEQ ID NO: 596446 - DNA, 128 bp, Homo sapiens
gccgcacatcatctcgtacatgaccacgcccagcccccaccagtccactgcacggccgtagtcattgtcttcaagcacctcgggggccaggtactcaggtgtgccgcaaaaaggtcttgggggggggg

SEQ ID NO: 596447 - DNA, 139 bp, Homo sapiens
  misc_feature (25)..(25): n is a, c, g, or t
  misc_feature (31)..(31): n is a, c, g, or t
  misc_feature (42)..(42): n is a, c, g, or t
  misc_feature (57)..(58): n is a, c, g, or t
  misc_feature (62)..(62): n is a, c, g, or t
  misc_feature (74)..(74): n is a, c, g, or t
  misc_feature (76)..(76): n is a, c, g, or t
  misc_feature (78)..(78): n is a, c, g, or t
  misc_feature (85)..(85): n is a, c, g, or t
  misc_feature (121)..(121): n is a, c, g, or t
tttccagcagcggtcagcatttccntctttngttttccaggngcctctttgacaggnncttnctcctcctcttntntntccgccncaaccaaccttcatcaaccaccaccttcaaccaacntcggcggcggcggcaacc

SEQ ID NO: 596448 - DNA, 116 bp, Homo sapiens
taagctgttaagggttaaattagaccggtttcaaagatatatttgagaatcatgtagtatctcttgacgatagtctagagatcttagagctacgttggggcctaaggactgagaat

SEQ ID NO: 596449 - DNA, 192 bp, Homo sapiens
cctgctgaaagcatcccagtaactgaacagtgtggtcgagcattccaagtccgtgacggtgcaggcgcggtacgacagatgccgtgactgggcacacatgcacctgcaccacggctccatatagacgctgacctggctctcgagaaacagcaggagatccttccatggtaaaccagctccagaatacccatg

SEQ ID NO: 596450 - DNA, 389 bp, Homo sapiens
ccctgaatcacattcatcctcttctctcctctgtactcatcctgtaatagtcccactaatgataggatattacctgctgcctacctggagatacagtaggatcttttgagtggaggtgggtagagagagcaaggagggcaggacacttaacaggcactgagcaagcaggttcccagctagccttaagtgatgttaggagtcgtattaccctcttctattgaattgccttcggatttcctatctccctattaccctgaccccacccatgatcccgctacaatattgtgcttctgaatagaggggcttcacctctgttgctgaggaatggtaaatgtgctatacctcagcacaatcccgcgaaaagtgtgaacacccaccatgtcgtaaca

SEQ ID NO: 596451 - DNA, 100 bp, Homo sapiens
ctcccttatgactaagttttcctcataatgggttaccccacattactgcttacgacgacatctctttagtcagaaaccagtagcttggtccagtcctagc

SEQ ID NO: 596452 - DNA, 586 bp, Homo sapiens
attctagaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcacagagtgagattccgtctcaaaaaaaaaaaagaaaggaaaaaacaatggctttatacctcttccttgtttccaaccgccattgaaaaattcctgaacactccaaaattcggttgaaattaattccaaaaaccaaaatttcttacggtactacaaactgaatttgacttcttaatagtaaatagatataccttaaaaaagacctcagggtatataatctgttctaaaacaagctaccaatctcaagtggcaggctcagcttaacccaactaagttgttcttcctaggtggaagaacccactttagggcctaatttccactggctggtggtagccctcacggggcctaacactgcgtggcca

SEQ ID NO: 596453 - DNA, 251 bp, Homo sapiens
  misc_feature (66)..(66): n is a, c, g, or t
  misc_feature (69)..(69): n is a, c, g, or t
  misc_feature (76)..(76): n is a, c, g, or t
  misc_feature (103)..(103): n is a, c, g, or t
  misc_feature (111)..(111): n is a, c, g, or t
  misc_feature (115)..(115): n is a, c, g, or t
  misc_feature (122)..(123): n is a, c, g, or t
  misc_feature (137)..(137): n is a, c, g, or t
  misc_feature (139)..(139): n is a, c, g, or t
  misc_feature (167)..(168): n is a, c, g, or t
  misc_feature (171)..(171): n is a, c, g, or t
  misc_feature (179)..(179): n is a, c, g, or t
  misc_feature (184)..(184): n is a, c, g, or t
  misc_feature (221)..(222): n is a, c, g, or t
  misc_feature (230)..(230): n is a, c, g, or t
gagagagagagagagagagagagagagagagagagagagagagagagagagagagagagagagagngcnggcgcgngccaaaatggaagtttaatccctttgntgcacttncgcnccggaanncaagaatcgcaaancngcatttcaatgcaccttcccacattcgnnggnagattatntcttncccctctttccaaagagctgagacaaaagtacaacgnngcgttccntgcccatccgaacggatgatg

SEQ ID NO: 596454 - DNA, 206 bp, Homo sapiens
agatcgacaggcgtccagctataacgatattgaggaggtcagcacggtgctcacgtgtcgacggaactgtacagggaggcgatgcaccgcagctggtgaatacacgtcgacacaggctccaggtaagcgagtatgggaggtcagcacggagctcacgtgtcgacggaacttgtacaggaaggcatgcaccgcagtggtgaatacac

SEQ ID NO: 596455 - DNA, 107 bp, Homo sapiens
ctcatacactcgtgctttctacttctccagccaaagatgatcggttccatgttgaacttccagtctgtcctgcatcagcggagccctgtggctttttccagatgagt

SEQ ID NO: 596456 - DNA, 245 bp, Homo sapiens
ggctatcggaccatgggctatgtatcgatggccaagtgcggctcggagcgcgtctggtgcggagtgccaaagctgcttgggctgaggcggcaccggaccgatgtctcggtgagcagcctgtccgctcgggtggattgatggtcttagtataccacctgtccctctgggccctcttccctcctatgcctccgctggctatatttcttccatctccgtctatctcctctctatccatactcttcccg

SEQ ID NO: 596457 - DNA, 361 bp, Homo sapiens
ctggagtgatatttggctgtgcaggctagcatgagggataggaagtagctagccacaatgaagttcattttgagaaaagtcagctaacgttgtaagctacctaggtataactagctaccgttagctactagctagttcaatttctctcacgtgtagaaagccataaaaacattttttaaaacagcatgttactgacctaaaaggttatctgtgaacccagtatctagcttatccagggtcagtgataggactacatagagcaaccatgtactgtctatctccctcaaaactcaactctacaacctggaagccagttccactgcttttttctttgttccccgtcgacgcggccgcgaattta

SEQ ID NO: 596458 - DNA, 259 bp, Homo sapiens
gtcagatttgaaagaagataaacctaggaaaagtttgtttaatgttgcaggaaacaagaagaattctattataatgtggtttagccctcgaagtaagaaagtcagatttgttgtgagtaaagcttcagtgcaaatccagcctgcaataatatatgttgcaagtgctcagcatgacttcatatgtatttgtttctccatgtcctcctgcagatgtttctgagagggctaaaatggcttctgctagattttgaaaaaaaaa

SEQ ID NO: 596459 - DNA, 194 bp, Homo sapiens
cgactctagagcatccactaacatcgtgtctctggagagcagcagccatggccctacgctaccctatgtgccgtgggcctcaacaaggtgccacaaagtgaccaagaactgtgagcaagcccagtgcacagcctgacgccgcggtgcgtctgaccaacacacaccaatgttctgtgcgtggacacgacatgttc

SEQ ID NO: 596460 - DNA, 237 bp, Homo sapiens
gtacggtgtgcaagtgcttcttccccagacactgtctgagagcacattcgactccttcttttcctccttcaccagaagactgtgtcccgcgtgaacctctccttcttcctcgcagtgtcctcctcgactgcttcctcatcagaaaatgcgacactccgcttccgactccgggtagccggggagagtttgatgggtgactctgtcttcttcaccactggagtcttgatgactttggga

SEQ ID NO: 596461 - DNA, 1121 bp, Homo sapiens
  misc_feature (316)..(316): n is a, c, g, or t
ggggcggtagcttctcggggcttgagcccatggggctgctctgggccttgtagccctgagaatacctttggtgcggtctggtgaagcgcgagccgttgcgaacgcgcctttgcccggtggcagcgtgtgcaggtgcctgggagtggccgagcgagccccgagccccggtgcggcgtgtcctgtggccgagacagcggccgacggagtcgctgacgttcgctcgccgcgctcgggcgtgctgtgcggcgcagctctggtgccgcggtggagtccgggatgcagagtgccactgctcgttccatgctcagtcctcagnacactctcggtgccctttcactggagtattgtaggtccattggttcggcatacctcgtgagggtggccttgctgggaggtatcgaggtctaggtcatgacttgagtcgtggggaagggagtatttcgctagttgagtgggcctcgtgcgacttactttcactagagctacttgaaggatctcccccgaatgatccatggacgtacgctcgcactcctggtaggtactttgggatagtaaggcctgtgtacacactaggcttggcttgcagcatcagttccacgtagcggtggagggcgcttccagtgaactgttggcgctgcttttggcaattgttccccacggggcgggctgagggctcttgctgcttttgccaattggagcactcgtgttccctgaaccgggggcattcatcgcgcttgccataggtgcttgtgaccaatcagacccggaggtagtcgtggttgcgtgcaaacttggttttgagcgggggcatacactttcaccttgtttaccacaggggggcgagaagaatgcgcttagtccgctcccttgttgggaggcggtctagaccattgaaaaatcggcctagtctacaggggttgaacgcaatagggaattgggatatgttgctggatcaatttgttgaaattgtcgcgtggacatcgagccccgttttggcaactgggagccatgattccaggacaaaagggcttcacattcctgtgtggccaaaagggggccacaggaacaacgtcaaccctttcacttgttacccttcggataagaggttccgggattgagcc

SEQ ID NO: 596462 - DNA, 157 bp, Homo sapiens
ctgactcgccacactccgggaagcatatgaaatgatcgcgcaggctctgagccctaggattcatctttcttttcaccgtaggtggccgacgggcatgtattagcaaactcatcactagacaacgtagtacgtgtcgtgtagtacgatgtctagtgat

SEQ ID NO: 596463 - DNA, 164 bp, Homo sapiens
cagaggaccggaagcagcaagggagaaggactaggaaaggaagagaggagaagaccacacggaccgggggagcggcgcgggagggggggaacgagagaccaataggcagacacgtaggtgaacgagagagcgaagcgtggcgagccgagctagaccgagagagg

SEQ ID NO: 596464 - DNA, 121 bp, Homo sapiens
ttaggtgactctattgaggatccccttagaccgtcgtgacgagaggattacgatttaccctactgatgatgtgttgttgccatggtaatcctgctcagtacgagaggaacctgcagttcag

SEQ ID NO: 596465 - DNA, 523 bp, Homo sapiens
ttccaatggaaagagggtaaagagcatcccaggggcggagatagcatggaggagaggaaggcagtgtgtattatggggttctgtgtagccacacagtaatggtctgagagacggataaaccatgaacctggaaaggggaacgcggagcaaactcaccaaagatatgtcaggttggtgggaagctggatcgcagggggtgacgaatgcaaggttaagcagttgggacttgtggaatgtggggaagggacttgatgaaagccaggttttaaacggaaacttcggacaggcagagagaccaaaagcagaaaggaggccagtaaggagatcgctgcagtggtcctgtcacaaatggaagtcctgaaacagggtgctaaccatgggaacagaactgaggacgccgagaagagatccacgggggcctactttctctacctctggactaatccgggagtcattctgcaactttcccaacaccttctccctggataaccttaagggactcggggcctcaggtctaactcca

SEQ ID NO: 596466 - DNA, 424 bp, Homo sapiens
  misc_feature (17)..(17): n is a, c, g, or t
  misc_feature (42)..(42): n is a, c, g, or t
  misc_feature (113)..(113): n is a, c, g, or t
  misc_feature (118)..(118): n is a, c, g, or t
  misc_feature (195)..(195): n is a, c, g, or t
  misc_feature (199)..(199): n is a, c, g, or t
  misc_feature (281)..(281): n is a, c, g, or t
  misc_feature (300)..(300): n is a, c, g, or t
  misc_feature (313)..(313): n is a, c, g, or t
ccgctcgtgcggagcgncgagccgcgccccctctttgcaacncctgtgcagtgtcactcctaaccgagacctctttagagttgcagctcgcttccaatgacccgtttagaggncaggntcttttttcccgggaaggagcccttgatcgaagcagatggctatggtggcagacaagcccattttccggaagaaggntagnccacaagaagattttgctaaggctggaatgtgttgagctaactgcagatccaggggatgctggcccttaagagatgcaagcnttttgaactggggaggagntaagaagagaaangggccagtgatcccagttctaaactttgggatatttttcttcattttgaagagaaatggtgaagccatagaaaagttacccgagggaaataatacagtgatattcttacac

SEQ ID NO: 596467 - DNA, 297 bp, Homo sapiens
gttgcattatagctacagcagaggtctgcgctccgttgctgcgtcactctctatcattctcctcagtctcaatactcattcaatcgcaccctctggcgcttgtattagcttactgtggtgtagcagctaaccagcgcaggaaggaacagaaggaatggctggggtgagccctgcaggagaggtcgcagcacatgtgatgaagagggtagagcaggagcttggtcggtggaaggagagctcacttcctcctccaacacagcatggggacagcacagggaaacaggatcacccagggca

SEQ ID NO: 596468 - DNA, 1033 bp, Homo sapiens
tgttaattaaaaatcagaagtctttgatgtatgcgctgctgtaatcaaactctgctcattgcgaatctattttggttcgttctttggtattattcgtgggcacatacttggtttgatgactttcacttgggggttctttctgctgccttcagggttactgatggtatctccatgctctggctgtaacttgtatggtaaccagtcaaaactgcttatatttctggttagggcgaagccatttaggaagaagcatttcaccagaacaagtaaaagttaattgcagcaatgatgtcagttgatggcccctagtttaataaaaggataggcaagatatcataggaaatcttacatggtttgtaggaaatcagatgtttgcaacgtaggaagttacatgggatagggaaggtataaatcaagatagtaacgggttttgtttgatatgtcatttgtcttaccatgctccccactattaaatacgtttctgtcagaagctaaattatggattgcacctagctttatgagtggcagaagttcttaacaaccagtattgagaaataacgaagggatgtcgttacaaatggtattcctgtcactcttaaagctgcagaatgatattattgaccaagaagtggtgcataaatcccaagtttgcaaagaaacatacaatgtagagtgccgtggagggtcaactgggcataacaacgtcctgtgcgggaatccaccaaaaaaaggaggcagtaaaagtcgtaactgcaggaaggcatattacaacgcaagtggggagccataacgtattagaccaatagacacactcgacaaacttcacagcacgacacctggccaacatcaaacgacgggcgaccccagcctacatattgaaccgaagacaacaacaacacacacgaccaatcaacataattcttcttccttctcactcctcaatactacaaacaacaaaacaagaaaaacaacaccagagaacaggagtcgagagacaaaggcaagaacgaacgagaagaaacaacagacacaa

SEQ ID NO: 596469 - DNA, 886 bp, Homo sapiens
gaggggaaacgggcccccagacgaggtgacaaacaccaggcaggcagtaaacacccggggaatcagaagacatggcagacgaagagaaatcaatggggacaaattgcagggtccgacaacatggcccgagacaaggtatccttaaagaaaaaagaaaaacgccaaaaaaaaaatacaaaaaaaatatatgatctgcatttatagaagcgcaacttgaggacagggagttgacccatgatcaatgctgcattaaaaagaacaagaaaaacagaggcatgaatacaaatcaggacactagagaactgaaagagagagacatggaaattagcagaggacggttaaacatcaatgagcacagagttagaatccagcaaactgggagtgaagggcgacaaaaaactggacagattgacaggagccagcttcttgaaaaccccgcactgaagagcagagttcctacaggacagatgatgattcaaagcctcaaacagctaaacccttaaggtccggaaatgtgccagagaggagaaaaaaaggctatagaggacccgaaaggcaggtcaaagtcaataaatctaaaggggacgtagaccgaaaaatcaggctataatggaaagtaggagatgaagctccgaaggatcaaggaagcaactaacaggggaccaaactatgcccaatgacgaaccggattaagggcccaaagaggaaagggactaaagacaggaggggggaccaagaacaggaaggaagaaccgaaaggccacaggatcaatagtaaaggacccaaatcaaaacaatgggacgtaaaaagaggtcaaccgaaggaagaggaagagagggaggggcaaggaaaagcaccgaaaggggacgggcccaaggggggaac

SEQ ID NO: 596470 - DNA, 130 bp, Homo sapiens
gctgagacgaactagaggatccccctctgatcaaaaatagctgtcattatgcagtgtgtatattcaatatagataagactatgtacacatccacttttattcaactattgagtttattaacaacaagtgg

SEQ ID NO: 596471 - DNA, 1374 bp, Homo sapiens
  misc_feature (221)..(221): n is a, c, g, or t
  misc_feature (240)..(240): n is a, c, g, or t
gggacaccgggtgtagagggcggtcgcggagggcagtggctggcagaatgtttggctaccaggatattctatgcctagttggcaacgcgacgcaatttccacctcatgctgtgtagtacttgagctcgattgacaaagttgtttggttgaatgatgcgaacgacatgtttctgctccctagctttatatcgtgatctggctgttgaccaccactcattgcncggtaagagtggacccaantgatctagaggcgaccatgttctttgctcgaggccgagacatcggcacgttgtacgagggacgatatgtggacgaatgtgaccttcgcttgagaagaccagactcgtctacacattgggattggatggaagacgtcctggaggttctgtacttctgtcatttaaaccgtttacaaggggaaggacgcttgttctggcttgagagcacatgtatacgcaagtggtgagccgatcggaaagacctgaacgtctgtagataggcacccgcggttctgaatgtgggaccgttggtggctcgaactgttctatcttttccaaattccggggccatattcaaacctcggtggggccttcccggcatgctgcacctcccaacttggttgaggcccaagggaaaaacggcccaaggtgggtcaacctttcggttgtgccttcaacccttgagtgggccaccacctcacctgtttccggcgccatggctcaaaaaaagagacgcgcttctcttgctatgggaacccgcatcaccaaaagcgaaaaacgacttggcgcggggatgttgtcgggcccccaaaattcgtgcctccacgcggataacgccctaaaccactcgaaaatgtggcgaacgactttagcgcgcgctgggggggaattacacccattttctgcggaatacctggcgggcggtttgaaaaattttccggccgccgcccaaaattttcccgcgcgcaacgtggatgctgtggcccactttttttacaacgtgctctacccttttcccccctctcataacacagtgcgttcggtcgggcggcgggacaacccccttttaaaacagggggtaaacgtgcgcgcatctcggggcaccaaatcagcacgcggacaaaacgcatatgtcggtgccggatgcacagtggcaaacaaaagttttcttggtaaacctgtgacatcaagtgtaccaacatttctgcgcgccctttgtggcgtcgtaccacccccttggttgtgaacacggcgcccccactatgtagggcccaacattgcgccccccacttgttggcccagcggctccccacattatgggaggggtcactcaacctactgaggtggtgctctcctaatcacacccacgcgtgga

SEQ ID NO: 596472 - DNA, 274 bp, Homo sapiens
gattcagagtagcaactggtgtctggtgagggctactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacattaagggttaggctttccgcctatgaattccgagggggaaaccagcattcagtccaggtccatctgacccatctt

SEQ ID NO: 596473 - DNA, 237 bp, Homo sapiens
agggtcccggctgggagacgcccagttgagaacaataatgaacaattatgtatgaacaatggttagaaacagctaatcacaaacaacctgcgggcgaatgacctcatgccacacgtagcacccttcagcaggaccctataaaactttcctccagcccttgcgtctttgcaggtagccccttctctgctgagctgcccactgcaacatattttcacaatttctctaataaatctgccc

SEQ ID NO: 596474 - DNA, 1125 bp, Homo sapiens
  misc_feature (291)..(291): n is a, c, g, or t
  misc_feature (793)..(793): n is a, c, g, or t
agcgggtgctaccatccttcaatccttcagcgtaccagccatccagacagggcttgagctgcagaaagctgagaccagacctctgggcctggccctccccaggggcctcctttccaatagctctacgtgcttgctcgtcgatcacgcattactattgcaggcgtgcgacagctcccgtgactggcgatggcgtgcgacccactattcaagggcaggataggatttatggttgacccgtaccgacgtgcacccgtaacactcgctagcggtctgtctacgtgccgtcgttgntgagcattaccagcgcatcgaagaggttgcagtacccctgcgtgaacaagcaactcatgacgttattgcggccaaatgccaccgccaaatgactcgtggtcggggaacaccagcgtgtgagagtatgtaggagaacgccctagcctctgtcgctctgggagtgagaccagggtggtcccagaggacgaagccaggcaggtaccgtgcactgtacgtatgagctagtttgcactgggcgcccgaagcgcccatgataggagagtagttccctcatcctaatccacacccacgtagctgtcccccaccttctccgggaggaactcgccattttccggcgtgagaaagtaacggttctgtcttgtgccatctacctgtactgaatggctacgcacgcgtgagtaccccgtatgcatacaataatgcttaccatcccgcctattgtgcgcctgcttcctgggggcgccatatgccgtatagggcatcaggtacatctgtccgtgangctctcctttcaaggctccttgttcatttcaccgaattctccctatagacctcgtttggcgcatgatccaaatgcctgaagggtttatccatgaaaggccaacacagggggcaccagctgctttcgaacctcttaattccttgggtccgaagctccccctagtttattccgtaaagcgcgaagacctttgttgcttgggacccgggaaggccccccaaatgtcgagccccccaaggaaagcaattagttggaggggcacccccccttttgggcgtcccaagcccccaacgaggtaagggcgggccccccggttcaggaacttgcttgcccca

SEQ ID NO: 596475 - DNA, 624 bp, Homo sapiens
tggggggccttcttgttttaacaaaaaaaacccctcaaaaaactgcgaaaaccccccccctggggggggagcacgggttaatttacgaggttatggaaaaaatttccccaaacccccatcgtggggggggcgtcctataaaacccggagactgggggggaaagaggcgccccgagggggtccccacccaaagaagcagcaaacattgcgccaacttcgtgaacatgtgttcgatccagctgcttgttctggccaaggaccacgagaacgatcgttacgtcgggcgcataagaatgtgtgtgccgccacagagctgttcctaccgtgaggcaaacatgtggcacccctttttcctccgacagacaagttattgtgatggccgccgcctctttcttcatcacttctcgcgtgcgggcacctctctcgagaagaaccgtcatttaacaacacgcagctaatccgcatcaaggtgtctgccgcccgtgaaaaacatctgtgcggttggcaacaaacaggcagtcggggtgatgcatcacccaagcggtcaaaacaatttctctcctttgttcccccagtgtagaggggtcaccgtggggaactcttcagcacaggttctgcttaagcc

SEQ ID NO: 596476 - DNA, 95 bp, Homo sapiens
acatcgagctcggtccgtttggttcattttgtacacgtttggaaaataatctgcaaacgagctgtgctgcaaagacttcatagttcccaagaatt

SEQ ID NO: 596477 - DNA, 89 bp, Homo sapiens
gcacgaggggcgtgatagacctggatgtcttccatagcgttttcttctgcatacagattcaggatctgtttgtataagggagctgtggg

SEQ ID NO: 596478 - DNA, 407 bp, Homo sapiens
tggggggggggggggcgtggggggggggttttccccctttggggcgggccggggtgtttaacaccccggggtttttccacccccgcggcggggggggttttctaagcccccctccccattgggcgccctttctttttgggggcccgggggggggcccccccccccccctctttgtggggggggggcgcccccccccttaaaaaggggggtttttttttgtgggccccccccccgcgggttgttggtgggggaggggaggtttttcccccctggttttttttttttgcccccccccccccgtggggggggggggttcccccccccccggggttttttttttattttttgtccccccagggggggggggggggttttttttcccccaaaactttgggtttcccccccca

SEQ ID NO: 596479 - DNA, 938 bp, Homo sapiens
acccgagcaaggcacactctccagcaccagcaggccggcggcaagcagcgcaagcacaacaaccaaatggccaccatcagcgccgccgcggcgaccaccgtcgtcgcccgtgccgccatcgccaggccgtcaggccctaggtctgccccagctgaggacgaggagcgagagggtgaggtgcagctactccaaggacgccaaggaggcgacccctgccgccgccgtccgcggggctggcgcgtccctactcgccgcggcgggcgcggtgaccgcgtccgcggggccggcgctggcgctggtcgacgagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggcctctcgctctaagctacacatagtttcctcgtcgtctcatgtaatccgctcgcgagcatcgccatgatcggtgtaatgtaattccagagatggatatttgtatctaagcgttccattctgagaaaacaaaaagaacagaaccaatacaaagaaaaaaagacaacaaagaaaaaaaagggggggggccaaaaaaaaatacccccgggaggggcccatataagggctcaccccgaatttgtgacacaagggggcccccaagaggagagagccattaaaaacacagaagagagaggcacacaaaaacacgaggacgcagcgaaacagacgcagagtgagaaatactgggagaagagacaaaaaggcggggagagaaaatttgttgaaaaaacacagagagatttagacacggggataaatataaaataagagatagaaggtaaaccagaaatatgtgggagaaattttagagatatttgaaaattttcgc

SEQ ID NO: 596480 - DNA, 193 bp, Homo sapiens
catctgttgttgagatggggtttcacccatgtcggccaggctggtctcgaactcttgagctcgtgatccacctgccttggcatccccaacattgctccacaggcttgacgccaccgatagcccggccctacatttttaaatattgttgtagaaacaaggtcttgctatgtagtccaggctggtctcaagcgcc

SEQ ID NO: 596481 - DNA, 879 bp, Homo sapiens
  misc_feature (279)..(279): n is a, c, g, or t
tgcaccgtgtcatttgattctgtaaagaaatacaatgactccctctgtgttctgttttctcccccttccacagcacacacacatacataaatgaattttctaatttgacaggctgtggaggttcatttaagtgaaatatcatgctggattatgtctttagattttaatgatttctgcatgcaaccctaaggtgttaagcattacttcctttccagtaagagtgataaatggtttaacaataacaggggaatgacctcccagattttcaggggtctatgntgaatgaataaggtatctaatggtctctacctaaaaatgcgcgcgcgcaaaaacaacacacagggcacacacacacgtacatgcacacacacacacatgtatgtccacacacagtctgtgaatgtgagggtgtctgggcagttcagtgcagttacagaccccttatcagattcacgaggcaacagaagtgtaatgttatcttcataaccaagggttgagaacaagggcgtggggatttattaagcaccactctcaggtgttcgtgcgaatcttacataaaatttaaatttcgggggtaggtgcttatattatttgtgttatagtgcttaacctattttacataatgattcttatggcgtagaactcacgttgctttttagtcacggaggaacggtgggattccatatagtataaggacttcttatcaatttttgtgctttttgaaaatctggcgaattacatgggtggccaggttaaaaatgtcttggtaattgggaagtttggtagaaagatgttggaacccgttggacttgggatttgggaaagggatagggggccaaatttttgcagggggggaaaataatacggagggggttttaa

SEQ ID NO: 596482 - DNA, 894 bp, Homo sapiens
attttaagtgtgaacactcccctatgtaaatatgctgagcaagtaaattgtatggagaatggtatttcaaaagtgtttggagactctttcacctgtcctataaaatttgaattgtgtatgtgatctacatagaaagaatattacagagtaggttgaactctttatagccgaatacagcctttaatatgcttgtatagcatccactggcagcaagtacatagtagtgcctcagacttgaggggttgcatgtgagcctgggggagttactagccttggaatgcatgaacggttcctattagacatcagtgggaactccagtactctgtatgtatccactaaaaggggaacttgagagccacagggtattcttaattcctgatcattaacaaaacgtacactactggctgaactttaactccacaatatttcacggtcacagtgacacagtggctggctttaaatggtagcactattcgcacatgaccttctccaagatggttatccacactggcaaagcgtagtagtacttccccagcacactggggattcctctcattcgcccacataccacaggtacacgaactttagaggactaaaatattgggactgtccaaacaacacgaagtattccgttacattcttcacagaccacgttcattcccacggtggcacgtggtccacggacaacccacttttgtcatctttggaacctccttagagagagccaaaccttccctagagtgtaacgtttaactagggaacttactggaaagaataacccctgggtgcaaaactggtttttaacacactctcaattgggggaatgggtcaatcaacttgtacctcacttatggagaactttcacagattcaaaaatgccttctattttagtac

SEQ ID NO: 596483 - DNA, 229 bp, Homo sapiens
  misc_feature (158)..(158): n is a, c, g, or t
cgagcacggcgcgggccaccagccgcccgtacgagaggaccgagaacatcgccgccgccgcccccccgaggaggcggggggccgggggagcaggaggacgcggaggcccggagccggctctctcctcagccgcatgccgccgcgctggggcgctcctntcacgcgcgcagtggccgccgccgcccctgcccgacgcgcggggctctcgttccgctcagccgcgcgcacc

SEQ ID NO: 596484 - DNA, 193 bp, Homo sapiens
  misc_feature (88)..(88): n is a, c, g, or t
  misc_feature (92)..(92): n is a, c, g, or t
  misc_feature (106)..(106): n is a, c, g, or t
  misc_feature (157)..(157): n is a, c, g, or t
  misc_feature (186)..(186): n is a, c, g, or t
caaagtgctgggattacaggcatgagatgagccactgtgcctggccatgagaaatgtttcatgatgtgagaaaatacaggagtttttngtcntgattccaccagtngtgaaggactgtcctgcagatgatggactctcagactgttggcaagagtancaagatgctgcagcacattgactatagantgagatg

SEQ ID NO: 596485 - DNA, 133 bp, Homo sapiens
  misc_feature (60)..(60): n is a, c, g, or t
agttagacctaacataaccattcttaataactatttatattattctaactactaccgtcntttcctactactcaactttaaactccagcatcacgcatccctatctactattctcgcacctcgaaacaagcta

SEQ ID NO: 596486 - DNA, 670 bp, Homo sapiens
  misc_feature (36)..(37): n is a, c, g, or t
  misc_feature (224)..(225): n is a, c, g, or t
  misc_feature (277)..(277): n is a, c, g, or t
  misc_feature (296)..(296): n is a, c, g, or t
  misc_feature (301)..(302): n is a, c, g, or t
  misc_feature (316)..(316): n is a, c, g, or t
  misc_feature (356)..(357): n is a, c, g, or t
  misc_feature (423)..(423): n is a, c, g, or t
  misc_feature (425)..(425): n is a, c, g, or t
  misc_feature (439)..(440): n is a, c, g, or t
  misc_feature (479)..(479): n is a, c, g, or t
  misc_feature (481)..(481): n is a, c, g, or t
  misc_feature (603)..(603): n is a, c, g, or t
taaagaccccaggcgccatgtcatgaaccggctggnngatgtcctgtcagaacccatgcggcagcaatggcctgccgccgcctcttcggcccagtggacagcgagcagctgagccgcgactgtgatgcgctaatggcgggctgcatccatggatggccctgtgagctgatggaacttctgactttgtcacctgagacaccactggatgggtgacttctgcctgnngagctgtgtgctggggccttgtgcctgcccaagctctaccttcccactgggngcccctggctgatggcctnggatnnagtttgggatgganggcatggctgtgccttggcacctcacctgctctgctgcannggtgacagcagatggaagaccatgtggaccttgtcacttgtcttgtacccttgtgcctcgctcagngngagcaggctgaagnngtccccaggtggacctggagactctcagggtcgaaaacngntggcagaccagcatgacagatttctaccactccaaacgccggctgatcttctccaagaggaagccctaatccgcccacaggaagcctgcagtcctggaagcgcgagggcctcaaaggcccgntctacatcttctgccttagtctcagttttgtgtgtcttaattattatttgttggtttaatttaaaca

SEQ ID NO: 596487 - DNA, 149 bp, Homo sapiens
aggatccttcgggagagagactgctgagattgatttgtcggtggcacattgtcatagtgacatctgcatcactggggcttgctgctgctgtttactacttggggcagaatagaaaggcaaggcaagcctgtgacacgaggagcgggtgc

SEQ ID NO: 596488 - DNA, 937 bp, Homo sapiens
gcgtaggatccattcgctagggagcacggacacaggtgatcctatggctctgtgcatcactggttatctcatacacctgctagggaagtaacattagtgcagtacttgcgtcggacacgaagaatacaggggaggatggtgaagaagacattctcgagattaaattggagataatcgccgatcttagtctgtctatgtagtggggataggatcgtgatagaggcaagtaagcaggatcgatgatgctgtaagaaaccaggaaggatggaagaaggaagaaaaagaaaacagcaagagaaagagtcggaagaaaactgaaattgaagcatgttggttctgatgaggcaagcaacgaaaagaaggtggtgacaagcaagaagaagaggaagattaaggaaaagtacatcgatcaagaagagctcaacaaaacaaagcccatctgaaccagaaatcccgagatattactaatgaggagtaccggagaattctataagagcttgaccaatgactggaagatcacttggcagtgaagcatttttcagttgaaggacagttggaatccaagagcccttctatttgtcccacgagtgctccttttgatctgttgaaaacagaaagaaaaagaaccaatatcaaatgtatgtacggcaggagtttcatcaatggatactggtgaggagtaatccctgaatatctgaattcattagagggtggtaactcgaggtctccttaaaatatccgtgagaagttgcaaagcacaatttgaagtacacggagattgccaaaatgtagactttatgatggggaaaagaagaacagatttgggttaaaaagtggagcgaacctaaaggaagtaagaggagaaaaccggagaggtttggagcgcaggagcacatttttgagcgcggaaggtggaaaatatagatcaggaataaaa

SEQ ID NO: 596489 - DNA, 200 bp, Homo sapiens
agtattgaggtttatattcatcttctctagatgttctgacatccttctgttcttctggttcgtcttgatcgtagttcttcttatttgctctttagcttttgttcattagcttgtgctctggttcgggtggaacgagttcttcctattgtagttctcaggttgttgaagatcagtgaatgtgactcccagtgtggagagag

SEQ ID NO: 596490 - DNA, 723 bp, Homo sapiens
  misc_feature (462)..(462): n is a, c, g, or t
  misc_feature (538)..(538): n is a, c, g, or t
  misc_feature (544)..(544): n is a, c, g, or t
  misc_feature (589)..(589): n is a, c, g, or t
aaaacattactgtgtctaaaagtagcggaggcctcgtgcggtgttttttaatcggccgagggttgtggtcagactgtcaggatggcaggcagaaggctagtggactagcagtgtatactccagtgcaatggacctttttcctctgggagaccagcctggaaggcaggggctggaaaagctgagcctgtaggtcactgctccaacagcctgggtttggggtcattgggtcagtggccaggcctccctcttgccttgtgttttggtatcaggtggctctgggctttctgggcagcatgtcggcctgatttgatgcccacgtgcatgtggtaacaccttccttgccccccttggctttgtttggttttcttccaagtgtccttggagtgtggcccctggtgtaatgaactcggacggacagtccccttgttccctatttaactaccagcactacctaattatttngcaacttgtttcccttgtttcacctgcactggcctcaacattctatttcttgtttaattaatgagcaaataaatcntgatcnccactaatactccactggcaactgctggccagtgaactgggaagncctgcagaaggcttaactcttttcagggcagaatgttcacgaattggagatttgggagaaggtagagggaaggggagtggataacacaggagattcctggggaggtcagggatctttgctggggaagtcattct

SEQ ID NO: 596491 - DNA, 846 bp, Homo sapiens
  misc_feature (41)..(41): n is a, c, g, or t
  misc_feature (367)..(367): n is a, c, g, or t
  misc_feature (446)..(446): n is a, c, g, or t
  misc_feature (536)..(536): n is a, c, g, or t
  misc_feature (546)..(546): n is a, c, g, or t
  misc_feature (692)..(692): n is a, c, g, or t
agctggcaccggtgcccgagacccgagctatgtcagcaaangctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaaacaagtgagaaatcgcccagcgggagggtggccaangtatgtgtcccacggcagccacaggaaaggggaacgatcaggtccggtttgagctacatgctgctactcacttggaccnccaccagatacaaggtcatttgctccctggaggatgcctgaattctacaaccgtgttcaagggccgcaatgaccttgatggagtacgcanaagcaacacngggaattcccaatacccgggtacactcccaagaacccgtggagcatggatgagaacctcatgcacatcagctacgaggctggaatcctggaagaaccccaagaaccaagcgcctccaggtctctacacgaagacccaggacccagncaaagcccctaacacccctgacattctcgagatcgagttcaaagaaaggggtccctgtgagggtgaccaatgtcacggatggcaccaacgcacagacctccttggagctacttcatgtacctgaacgaagtcgcgggcagcatgggttgggcga

SEQ ID NO: 596492 - DNA, 152 bp, Homo sapiens
  misc_feature (67)..(67): n is a, c, g, or t
  misc_feature (106)..(106): n is a, c, g, or t
  misc_feature (122)..(122): n is a, c, g, or t
  misc_feature (126)..(126): n is a, c, g, or t
tcatggtaagctaaacataatcgatctgcttccattgcgagacgcatcctcatcgccctcgaagagnggggatctcatcaggaactgcagcattggattcctctgntgccacttcatcttcntcantacctagagcagtaaggtctacctgg

SEQ ID NO: 596493 - DNA, 852 bp, Homo sapiens
  misc_feature (373)..(373): n is a, c, g, or t
  misc_feature (452)..(452): n is a, c, g, or t
  misc_feature (542)..(542): n is a, c, g, or t
  misc_feature (552)..(552): n is a, c, g, or t
  misc_feature (698)..(698): n is a, c, g, or t
tggtcagcatgcgttcccggtatacaacgctagttacagtagagggtccgtgactgctgaaacaccctggggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaaacaagtgagaaatcgcccagcgggagggtggccaangtatgtgtcccacggcagccacaggaaaggggaacgatcaggtccggtttgagctacatgctgctactcacttggaccnccaccagatacaaggtcatttgctccctggaggatgcctgaattctacaaccgtgttcaagggccgcaatgaccttgatggagtacgcanaagcaacacngggaattcccaatacccgggtacactcccaagaacccgtggagcatggatgagaacctcatgcacatcagctacgaggctggaatcctggaagaaccccaagaaccaagcgcctccaggtctctacacgaagacccaggacccagncaaagcccctaacacccctgacattctcgagatcgagttcaaagaaaggggtccctgtgagggtgaccaatgtcacggatggcaccaacgcacagacctccttggagctacttcatgtacctgaacgaagtcgcgggcagcatgggttgggcga

SEQ ID NO: 596494 - DNA, 964 bp, Homo sapiens
gtagaaccttcttcaaacaaggaccactgagtataattgcctaagagacgatttttacgttgcatgtcaattacaagaatgcactggagatagaaaaatcagtaaagcatgagccccactttcaaagcgcccacagttgagaggggacagctgagacatgaggggcaccccagaagcatagtgtacacgtggcctccacagtgacgagcaaacccagctcccagaggaaggggcacggggagccttctgagggaaaccaggtctggagggcaccatcccagcatcccgagaagcggctgtcccacagagggtccttccacccacccgccaagctttcctgggtctgtgcacgctgtctctgccagaggacctcagtgagcaactgaagacaagtggagagaataaaacctgtgggaaaatgcagagggagtcacagcggacagtcctgcatcctaacagagcatttggtggcacggacggtggcaactttgtgtttcaaacctaagtgaattgtctcagtgttggctcctgcaggcttctctaaggcatagcaccagatgttgtcctgcaggggttcaaagttagcccacagggaggttgctgattctggcccacgtctcacctgccctggtcttccagtgccagctttggggctgcagactcagcacacgccatagccagtgtcctgctgggacaccactgcagaaggcgggattctccctattggtggagcaccaggcacagctgcgaaggcgcttaggaggctgaatgcaagtctgacagatcttccgggaagaccagggtatctgcctccttaagttaaggccaactaactctagggatggaaaaggtttctccaagaggtgttgggacggatagaggaatatactcacactggagaacgaggttaaacaccacgccaagaaaaaaaatagggcgtctccaccaagaagggaagcaaagc

SEQ ID NO: 596495 - DNA, 1059 bp, Homo sapiens
  misc_feature (364)..(364): n is a, c, g, or t
  misc_feature (366)..(366): n is a, c, g, or t
  misc_feature (368)..(369): n is a, c, g, or t
  misc_feature (372)..(372): n is a, c, g, or t
  misc_feature (641)..(641): n is a, c, g, or t
  misc_feature (785)..(785): n is a, c, g, or t
  misc_feature (840)..(840): n is a, c, g, or t
  misc_feature (848)..(848): n is a, c, g, or t
  misc_feature (854)..(854): n is a, c, g, or t
  misc_feature (859)..(859): n is a, c, g, or t
  misc_feature (866)..(866): n is a, c, g, or t
  misc_feature (888)..(888): n is a, c, g, or t
  misc_feature (900)..(900): n is a, c, g, or t
  misc_feature (942)..(942): n is a, c, g, or t
  misc_feature (948)..(948): n is a, c, g, or t
  misc_feature (961)..(961): n is a, c, g, or t
  misc_feature (985)..(985): n is a, c, g, or t
  misc_feature (1056)..(1056): n is a, c, g, or t
attggagtgatatagctgcttgtctctgtcatgcttcagcttaattgccacggttagtggccaaatccaggccagctgagttccactccagctgcagtatctgctgacaacttctgtgtacttaccagcaggacaccagattggcacagtcagtcccttgttccaaaaattggaaaatgaccagattgaaagtttaaggcagcgctttggagggggccaggcaaaaacgtccccgaagccctcaggccgattggcacagtcagtcccttgttccaaaaattggaaaatgaccagattgaaagtttaaggcagcgctttggagggggccaggcaaaaacgtccccgaagccagcagttgtagagncngnnacnacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatncaagctgagacctttccttttgtctactccaagccttccccctgcgtatgtgggattgagggtcacatcattggcactagtgagagggtagtcagtagccacttcttggggaaaggtggggtagtgtggcccaagtggggggantggatgctcccaattgttcatgcttggtggcagattcaccattcgggtcaatcangaagctcnggcgangtcgnctctacnttccctgggtcagggcggctcngatttcctggcntgaagccggttcattctctttcagctagctggtgccactttncctttncattctcctgttnctttctcccttcatggcgctgctnttccagcccgggctgggggaatgaccactctgttttccgtttcctgggttctcccttgggtctttccttcntca

SEQ ID NO: 596496 - DNA, 316 bp, Homo sapiens
cactgtgtagctttctccactacactgtgaagttgttcaaaggcaagaggcagtcatctattggtccacattacttagaatagacttggttttagtttttccttttgctttagttaagtgaaaagacatattataagaccacgtataaaagcttcttttttcccctttctttactctccttcccagaagtttttattttaatttattgagatataattaacataccataacatttgccttcttaaactgtgccattcagtggcttttggcatattcacaggttgtgccaccatctctactttctaattccagaaca

SEQ ID NO: 596497 - DNA, 882 bp, Homo sapiens
tacctttttatttgggaacgggaatacagagcatgccaattcggctccctataaagtctgggtgaatttcaggaggggactggatccttaagaggtaattgtaagtccttagcatatggggggtaagctgaagggagcccttctttttgggaaggccaaaaggtccttacctctaaattgcggccaggaaaagtacctggtgtccggcaggtggcccggcactgatcctgcatgctatgagttcctgtggggtccaagggcccacgctgagacaagcaaaaatagagttcttgagtacatagccaatgccaatggaggggatcccacttcttacccatccctgtatgaagatgctttgagagaggagggagagggagtctgagcatgagatgcaacctgggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagagaaataaaaggagaaggtcattaaaaaaaaaa

SEQ ID NO: 596498 - DNA, 150 bp, Homo sapiens
ctggccagtggtggacaacgtggcgtcccccaaaactcagtcctggcacctcaactgtgacaatcagcaaatgccccacccaggcccacatcgttggatgatagggagagctctggcagtatgtcccaagtcctgggaggggtacacgag

SEQ ID NO: 596499 - DNA, 1732 bp, Homo sapiens
  misc_feature (964)..(964): n is a, c, g, or t
  misc_feature (1129)..(1129): n is a, c, g, or t
  misc_feature (1134)..(1134): n is a, c, g, or t
  misc_feature (1214)..(1214): n is a, c, g, or t
  misc_feature (1401)..(1401): n is a, c, g, or t
ccttgggcttgacgtgtgtgaggttggcttcgcgtaccgctcggtttgtgttcgtcgcccgccacacactgatgtcgtcgtggtgcgctgccccgccaaaagttattgtgtgttaggatatttccttcgcgcgatgagtgtgagagtatttcgtgtccgggtggcgggcggtttttcgtcgatccgtggggagcgctgccgtgtggcgccgccccagacacggtggtgggggcacaaatggtctctggtgtgttgccccaccaacgcttgcccaagacgtttttttttgtgggggaggcgcttctttgtgggggccgctgttgggccgttgccatatatggccacacaaggtcctctcaaatcgtacctcgttgttgggcgcgtactcgctggtggcccgcgccacattgttctaggggggacggccctctcctgttggtaagctcgtttttttgccgttttgtataaggggcgcccgctcttgagagggtgtgccgcccccccccccccgccccccggtgtttatctccttgttagacgcgctgcccccgagtagttggtaaccccgcgccggtgttagccccccgggttgtccacgctcgtattatagcggctgtgttgcttttgtggttgtattttggtgttgttttatgtgggagggccacaacatgatggaaggggagccttcctcgcgggtgtttgcgttgtgtcgtttgtggtgggtgtgctatgtatggcggccgccaccatgtgtccttttttccttggggaagagaagggcccccacccccatagcgcaccgttggagtataggatgtttacactcggctgcgcccctcgggtgtgttgtgttgcacaccgagaataattgtagagaggtgtttgtgacccaccgtcggagagaagttgtttttcgtatcaccccaccgaagtacccgcacctcgtcgtagaaaagggaagagntgtttcctcttcgtgagaaaggcgcccccctcctcgcccggttgtaagtctctaatcgcgccgctctggagaagggagcttcgtactattttgttgtctctcaaatattggggtgatatatataacccccggccccctcccccctcttgagacagaggggaaaanaaagnggggaggaaaatgccccacaagtattgtaaatatgttgttgtctcgccccgtttttaggagccactaataagggagaaanattttttataaaagcgagagaaaccaccgcgctgctttatagagagacacaccgctgtgattctctctcacgcgcgctatagagatagtgtgtgggtgtgtcacacacccacacagatggggtctctctctccacttcttcacagtggttgtgtcactatgggtggagatattgggggagtggtggngagtgtctcttgtctctgttagagggtgtagagaaagagaagctctcctctctaccccacgccacacaccccagtgtagaacacccccaagagattggaacaacaacactcggatagcacacagcgaccacactccagccataggaagatggccataatttggatagtccacctttggttctttttgtccccagaaggcgttatacaccagtgacatccacatccgggaagcctttcccagcgttcccagccccttgaatagtgaagtgtccattggccatgtctggccgtagtctttcattcactcctccattaaccaccttgaatacca

SEQ ID NO: 596500 - DNA, 1313 bp, Homo sapiens
  misc_feature (826)..(826): n is a, c, g, or t
ggctcctttctgcccgctggacgccgccgaacgaagcatcgttcaagtctctcttcaccctgacgtcatgtctaagtcagcacgtctcctcatagaatgagcccgtaacagcatgaggcaagctgcttcatgtgggagggtctgagcttttgaaacaactggatgagagcctaggggtagccattattggagcactaggggaacgctcacggacttgtgtggtcaatgagagatccaatacacctaagcgctctcatggggcttatgggtcttcgtccaccattatcgccactgtgcgagcgagggtggcatgccagcgtcattgatattgctagaggctcacacgaagggtgcgcatcggaacgagtctgtggaaccgacgagcagagctgtctaccagcagcaagcattctcaatgggcaccaaggggtgcccgagcgttaacgtggtgcagacaagactagtatcgctctgcgtggccatcccacacgcacggcacacgtgcaacgcacacgagtccaccttaatacgagccatttacttctgtgaatcagctaatgcggacatggtctgcacgtgtgcatttggaccattcactggactaggaagcgggagggcaagttgctcacagacacactaggggggtgcttttggcacgtattgttcacagccatttttgcagcggacccaatggacattctccgttggcgcattacagggatctggtccagtttccaagaaatataccgccattagcttaggttggacattgggcccacatatgcgttggtctgcacacgttcaaggagacacaggtggcactggntaacaaacaggaccaaagggcaagaaatctgcggcctacaagcatggccatttacaattccccaagaccccacacacgcaagggggccgcaaacagctggggttcgcttgcggaccaacgccttacacggggcccgggcatagggggcaaagggagagaacgaggactagtgaggtccaccaaggatgggaggcagacatggcacgaacgcgtgaccaggaaccagtgtgacaagtggaaaacactttgcaagaagggagaacaaggaggagagggcacgtaaggtgaggaggggcaaggccggggcccgccgaccccccggcgcacaccattcggcactcgccacggcggatcggtccagcgcgctataatcaactgggaacccgacaggaacggaatggcaccgaccacacagtcccggaccatcggtggaccggcgaaagccgtcgacaacctcgaacgcatcatgccggccacatgtcacgac

SEQ ID NO: 596501 - DNA, 284 bp, Homo sapiens
actagtgtgatgaaagaataaaataatattaagaaaatagtgaacacttacctcagagaagtatataatatgtaacaattaagtatataagaaagagatctgtgcattcatctctcagatgggctgctataaatgattctttacttagcgtaatgaatagaagtagattctgattgatgaacatatacagacacacaccatataaagatgtatcagatcaatgacagaaccgaaaataccaatgtggtcccataagataataatggcggtaagaaattctatct

SEQ ID NO: 596502 - DNA, 168 bp, Homo sapiens
gcggcacaatcacttgaggacaggagttagagatcagcctgggcaacgtggcgaaagcccgtctctactaaaaacacaaaaagattagccaggcatggatggtatgcatctaggtcccagagtactcggagagtgccgaggtgatagagatcacctgacgcctggggg

SEQ ID NO: 596503 - DNA, 198 bp, Homo sapiens
cgcttgccactatgcccagctaatttttgtctttttagtagaaacagggtttcaccatgttggccaggctggtctcaaactgccgacctcaagtgatctgcctaccttggcctcccaaaatgttgggattacaggcgtgagccactgcacccaagcctcctttctcttttgcctattaaacctctgctcttaacctta

SEQ ID NO: 596504 - DNA, 482 bp, Homo sapiens
gtcagggatagacccctgatgtttttctgattcgcgtggcttaacctggaaataactttgtgtcggtgtctgcttctacggttggtgtttcagggtgtgccattgcctaattgtttgctatctatggacactaaaatttgaacatttattaagcttagccttattaggcatgaacatactctgggtatctataataatctcactttttcatggtatctatgaaattgagcaaggcacacatctcgtggcctttgtggctgtagaggtgcttcaagacctttagtacatcttctgtcgattccataatggtcagataatcaactccggattctttcatgatatcagacagacgcagtttggggtgtgaaagaggtttggataagtggatatgcttggaatgttgtcttagctgtattatttgtctgaatatggtgacagttagaatgatcagttcgtgaggggtactatccattgttcttcaa

SEQ ID NO: 596505 - DNA, 270 bp, Homo sapiens
cggttggtcggggtggagtaaagtgacagaatgccgagttcactgcggcctggagctgccaggctcaagtgatgctcgccacctcagcctcgcgagtacagggacgactcacatgtgccaccacctcgagctaattgttctctagttgttgtggagacatggtctcgctacgttgcccaggctggtcctgaactctggggctcaagtgatcctcccgcctcaatgtcccaaagtgctgggattataggcgtgacagccatcccgtcgacg

SEQ ID NO: 596506 - DNA, 102 bp, Homo sapiens
ttggtagacagaccctgtttgagtcccagctttcagttcttacgggtatattcctagaagtggaattgctggaccatatataattctatatttaattccctg

SEQ ID NO: 596507 - DNA, 257 bp, Homo sapiens
tccacgaagcagaagtcggcagttctgaccctgcagactatgtgcagctttgagtctcagcatagaacatacatctcacagccccaggttgggttcgcagagtggtgatgagaccggcctcatgtcgggaacattccgacaaacagaggtctcggacagcagagaaatcgctggtggcagcagtgctgacatgggcaccactcaaacgtgcctaagtggactggactcaagcaaccactgaagagggacggcagcag

SEQ ID NO: 596508 - DNA, 1077 bp, Homo sapiens
agcggaagtaggtagcgggtgcggtgctgggaggggcaggcggtgctccggcgtgcgagtggccttgtgccatgctggacgcgtttctgcggctccgtgtcgtcactaatggcggctggccattttctgctgggctggaggctggccctggctgggccctggtgagatgctagggacctgtggcgtgcgagccgggtgagcctcggcacaccctgctaacttgcactcttttaccctggccgtctcgtctagcacgagtgtgatgcacttattgtcttgcgcgaacgtcccctgatgggcatgcctcccgcggcactgcacgcccagcacacgggacaattgtgacagcaatacacacgtgaacttaagtttcccagcgaagacaaaggcctgtaacccgaaagcccttcacatttaccgcatggctcacgcattaattcacttcgattcttggcgcacccacacaacgcccttggcgcaagcgtttccaaacaattgtctctttaaccgggacaaacggggcttagccaagaaaaaagtgggcccaactagcaattattccattgaatcttccctgggaggcaattctaccacaaccattggggccttaacaggcaagacacacattgaacaatgaaacacagagggccaagacagcctttttcgtcctacccactgggcaatcgccttccacatggggaattacaaggaacccgggaaagcggcaccaacgttgggtgtttgatcgcaatacatatatgtcccacaaccttcccgccgtcgaaacgaaacccttttgccgatctacagttggcgaaatagcgccgggtgacccatttggcttgggagcctaaacccaacggtacctggtgcattggagcctggtgactttcagtgcgaacgaggctcattggaatccctggcccactttgaaacgttcactgggtggtacaatagttcttccacgattaagtttgcaccattccgcattataagagaaagaggtcaacctcaaactacataaaccttatttttaattacaacccagattcaaaattccgaaccgttacggcgcaa

SEQ ID NO: 596509 - DNA, 212 bp, Homo sapiens
cggctcgatctatgctaggtgatatattgctgcactgagtgtgtgcagattgttattcaatggttcatcaatgatgctaaacatgtttcgttgataacctgtccatctctagtttcaaccgtcttaatcagaagtgtcctttttgagtgggtatcaaccagagggagtgaatccagattagtttccctcaggttcagggaggaaaagtttgg

SEQ ID NO: 596510 - DNA, 317 bp, Homo sapiens
ccttttgggtttttaaaacccccccagggctttttttttttcgccccccctttttaggggccccccaaaagaaaaggttttaattaatgggggggggcaaaggggccccccccccccctttttttaaaaagggaaaaccttgggttaagggtttaggggcgccctttcccctttttttggaggggggggggggggggggttccccctttttacccaccggtaaaaggggggggggggggggggaaaaataggggggggggttctggtttaaaaaagggggggggggggaaaaaaaaaaaccgggcttctttttttta

SEQ ID NO: 596511 - DNA, 546 bp, Homo sapiens
  misc_feature (289)..(289): n is a, c, g, or t
ggtgcagccggtgcctcagacacaacaagtaaaacccaagtcctgaaaacactgggcccacattagaagtgggataactatgatttaagggaagatgctttggatgataatgttagtagtactctcagtacatgattctccgttgggcaagctagccctgtgcagcaaaaagaatattcttccgcctttgatgagttcaacaacaggatttaaccttcagttcttaaaatctgtctttgcaggtctatctaaggtctcctgccaggttgaatcagagtgggacttcagnttgggcactgatgaagcaatctgatgttactcaagaagaagagcagagatggacagtcactttgaaacctgctctgttcctttacctgagtctacgttgatagtgatccatgtggctgcaggcatcaatggatacctagcttgctagtcgttagccgacgattgggcatgaactcgtacagcatcttcatcgatcatgtatggttcgatcggtagagcaaaggggcgctcggtgatttcccgatggcatagcactca

SEQ ID NO: 596512 - DNA, 922 bp, Homo sapiens
gagacactgaccttcagcgcctcggtccagcgccatggcgcctccaggaagttcttcgttgggggaaactggaagatgaacgggcggaagcaagagtctgggggagctcatcggcactctgaacgcggccaaggtgccggccgacaccgaggtgttggtgctccccttatgcttatatgatttcgcccgaagaagttagatccaaagatgtgctgtggttgcgcaggaaagtgttacaaagtgactaatggggctttaactggggagatcagccctggcatgatcaaaagattgcggagccaacgtggttggtcctgggccactccagagagacgggggcgtgttcttgggggaagcagatgagcttgattgggccacgacaagggtggcccatatggcccctgacagcaggggcactcgagagataacctcgccgtgcatggggggacgagcaccgcctacattcaaggcggaacgctggcaatcaccgtgaaaacgggttggttcggccgcaggacaaggggtcatcgcagatacacgtgaaggacgtggaagccaagggtccgcctgccaatatggacgccttgtggtggccatgggtaccgtgcaagatgtgatacatcccaaagaggtctcgggatagttcaagagaagctccgagagtgttgaaagtacagcgcctcagatgcggggatcaagaggccccggattattatggaggctctgtgactgggcaccctgcatgaagtggcacgcacatgtgggatgctcttggggggggctccccaagccgaattgggattatatccaaagagccatacatttccaccttgcaccgggtaggccgaacgaatgcccagaatagggggaagcctcgggcaccacgattttggtattcccggggggcgccctatgggagagg

SEQ ID NO: 596513 - DNA, 111 bp, Homo sapiens
atttaggacataagctcctaatattacttaaatcagttgattttaaatttataccagtgtaatcaacatattaacctcttatatcttatttttgtagaaaagccactcccg

SEQ ID NO: 596514 - DNA, 178 bp, Homo sapiens
agcacctggtggtagtcaagaatgccccatctgctatctggcctggtacagtggctctccgcgagattctgccgctaccagaagtccaccgagctgctgatcagaaagctgccttttcatgcgtctggtgctgtgagatcgcgcatggacttcaatgacctgacttgcgaccagtgcg

SEQ ID NO: 596515 - DNA, 652 bp, Homo sapiens
ccgagccgtgcgtaacaggcgcgggcgctcccatcttgagttagagccaggccgtgccggggctctccagccccggggttcggcctcgactctcctggctgtccagatccgcggtgccccggcgggtgatagcccaatacagccatgtaagaaaaaggtgctgctgataggggaagagacgggtctggggaagaccagacatgtagagtctgagtaatacttctgccacattacacttgcgtcgacgacacccgcgcgacctgtggtggccaccacttgtagcgtgtgagacactctccacagtctcgcattccatagaggagaccctggatgcgtgcaacctcgtgtgagacatgtgtgcaggatcacggagcacactatcactggagaacattactatctacacagagcacacgcagacaactatcattccgctaacagtgtgacagttttgagtttacagtgatttgacagtgtgagaagaccgcggaacatgtgggaaacgggagcacatgtcactttatatatcccgatctgtgatactgggagagcgcactacctcacaagaacatcttcactggacagccaaaaatcttctgaccatgggtgtcacaacacatgggatcctgaggatcacagagagaatcacacg

SEQ ID NO: 596516 - DNA, 318 bp, Homo sapiens
aaaccgctaataaatccagataacgctcaacgtgcgcccttgcctgctcatcgccttgatcataaagcgcaataatttcgggagcctgcaacggttgatgataatagtgttgatacagccacgcaaaaccgcgaccagacagataattttcaatgcagccatgctgaccacagccgcagcggcgtaacgggaaatccaaccccatcatggttaacgcatcaaccggcagacgcatatggccaaactcgccggtaatgtagcttttaccggtaatcggtttgccgttgaaaatcagcccgccgccaacaccggtgccga

SEQ ID NO: 596517 - DNA, 341 bp, Homo sapiens
gggggggaaccccttgtttttgggccccctggggggggttaaattaatggttttgttgggcccctaggttccccctttaagggggtttcccccgccaattcttgggggggttttaaaaggggttggggggcccccccttcccaatttttttatttgtatttgggggccccataaaattttaagggggggggggggttggggtcccctttttttgggggtcccaaaccgggtttttttttttttggaggaaaagccccctggtggggtttggggggggggggggtttgggttttcccccccccccccccccccttaaataaggtttttttttttttccccca

SEQ ID NO: 596518 - DNA, 524 bp, Homo sapiens
  misc_feature (14)..(14): n is a, c, g, or t
  misc_feature (185)..(185): n is a, c, g, or t
  misc_feature (288)..(288): n is a, c, g, or t
  misc_feature (325)..(325): n is a, c, g, or t
  misc_feature (329)..(329): n is a, c, g, or t
  misc_feature (347)..(347): n is a, c, g, or t
  misc_feature (358)..(358): n is a, c, g, or t
  misc_feature (373)..(373): n is a, c, g, or t
  misc_feature (377)..(377): n is a, c, g, or t
  misc_feature (442)..(442): n is a, c, g, or t
  misc_feature (470)..(470): n is a, c, g, or t
cagaatctgacctnacctttgcaaagttacagatgcaccccaacattgagatgtgtttttaatgttaaaatattgatttctacgttatgcagatgcccccgtgaatgcttacctgtgagataaccacaaccaggaagaacaaatctgggcattgagcaagctatgagggtccccgggagcacacnaaccctgcaggcccccgctggctcctccaggcacgtcccgacctgtgggccccagagaggggacatttccctcctgggagagaaggagatcagggcaactcgnagagggctgcgagcatttcctccgggagaggagatanggcnacctgcaccactgcgtanagcctggaagnaagtgagaaaccagncgancggcctgccctcttccgggacacttaatgaccacgtgtttgacatcatgttaacctaagccctanagatgattcggatttgcaaatacatttngtatcgattcgccataccctacccagaatggcaattacttcatgcctgacctgg

SEQ ID NO: 596519 - DNA, 143 bp, Homo sapiens
cttcttgctaccaccctatttctctgctgcctttgacagcaaaactcttggaaagggttgcctatacatgttttccccccactcgtctctgtcttctcttgaactcatagccatcaggttttagtttccaccacttccctgca

SEQ ID NO: 596520 - DNA, 233 bp, Homo sapiens
ggatttctagtatcttaatataatacagttccaatcagtgtgtctggttcagttcagttcctacactgccaaaccggggggcagggactgattcagtttctctaccttctctatgtcagtgatgaccagggtgtaaaggtatctgatgcatagaactttaaacatcacgttgtccatattttttatgatcgtggcagatttggcaccctctgtggtgttctctcacacgtata

SEQ ID NO: 596521 - DNA, 471 bp, Homo sapiens
tctacagagcaagttcagggacattcagggctacacagggggaggaagcagaagaagaaagagaaagaaaggagacagacagacagacagagagacagatggacagacagatgaaagggagagggagagggagatgtgtcaagataatcctgagtcaacctggacacttaatccctttggacctctatctggagagcatcctatcagacttcactagaagatgacagctggaccttcctgttagatttcctcctgttagatttcaaaggctcttgtggatagatgctactcactctatttgcatgatccttcagtcccaggcaaattattacatctcttccaggctccgtatggaatgcctgtgtgttggatgcttgctgtgtttttggcctggatagcacgaagcattttacacatctgacagctggtagcagaaaggccctccatcacttcaggaagctcaaaaattta

SEQ ID NO: 596522 - DNA, 668 bp, Homo sapiens
tgaggaagatactctaagatcttagaacaggaaggatcgtatgattcagtgcagagagcctcaaaggaattgtgtggacgagaaggtcggtcacctattgaattgggaatgattcttcgtgaagttaccggtagataatggtcccaggatgctctatatgtgagggcagagaagaacgtagcgcctggattggcgaggagtgggttggacgactagactgaggctggacatgcgaagcggtggacggaccttgggaaggcagggatgatccatttcgatgttcctgtaagctgcgacatggatacgtaacacttcatatcaaccctctgggaaatcatgcgaagtggcaccttgagtagctactacgttgaggcgactgcgcaactccgtgccttggcttggttccctgctgcttgacgactaacatgagacgtccctgacgtctgtgagcacgggaggtttcctacttgtttgcatgctgacaagcctagttggtgtagcattggttgcgatgcgctgaagagccctggacacttagtagagtgaatggcgagtttgttgacatccattgccttcccatcgcccttatgtggcatccctctttggggcttcctagggatctatagtgaagcttcaggcgcttgggtatttacctttgggcccaattc

SEQ ID NO: 596523 - DNA, 180 bp, Homo sapiens
gacggattgctttccaagggagttgtatcatttatttaagtactaatctctaatcactgtgtacagctctaatgcttggatgatgagtttttttaaattactggctaattggataggtaagtatatgggatctaattaatttgcctttctttggtgctaggtgaattatatagttttaat

SEQ ID NO: 596524 - DNA, 345 bp, Homo sapiens
acgtctctacagttaatatgacgaggatagattggtatatgatttaagaatggtgggctacgtttttgtcagtgtgacgaagaacgcaggtccgtgatgtctatagtgggtgcctgtggttaaactctgggactcagaagtgaaagggggctattcctagttttattgctatagccattatgattattaatgatgagtattgattggtagtattggttatggttcattgtccggagagtatattgttgaagaggaaagctattagaaggattatggatgcggttgcttgtgtgaggaaatacttgatggcagcttctgtggaacgagggtttatttttttggtta

SEQ ID NO: 596525 - DNA, 328 bp, Homo sapiens
  misc_feature (39)..(39): n is a, c, g, or t
  misc_feature (300)..(300): n is a, c, g, or t
ctgtaatcccagcacttcgggaggctgtattcgtctgtnctcacactgctaataaagacatactcaagactgggtaatttatcaaggaaagaggtttaattgactcacacttctacgtggctgggaaggcctcacaatcatagctgaaggcaaaggaggagcaaagtcacatcttacatggtggcagccaagagagcttgtgcaagggaactctcatttataaaaccatcagctcttttgagacctactaccacaaaaacagtatgggggaaccacccctgtgattcagtttatcttcanctgggccccacccttggacaatttggcg

SEQ ID NO: 596526 - DNA, 111 bp, Homo sapiens
tgtcaccttgcccactgggtgcctatgctgacccaggataggcagactgcccctccaaactccacagtatgggagcctggagggctaggccacggccttctcatgcctcca

SEQ ID NO: 596527 - DNA, 392 bp, Homo sapiens
tcactgacaaatgtgtcaagctctcgaatggatagtggtatgcacagcgctgtgtctttgctcataatgttggtcatagcagtcagggtacgtcatgcgaatgggtgtaaagtcgcactcatctatctgtactctacaaggtgctcattcaactcgcagtcagttttacatcattctcctcggataagccgcaatactgtggccatatgctccaacttcttcgcagagcaatcagatcagtgatatggcgccatgctgatctcaattgtggtctaaaaagtctgggccaggttcagcgtcagcgagtctcaggcaccagcatgcgttctcgaagactgcagcggacacacgcgctcccagacagcgaggtcttcagcatagtagggcctcag

SEQ ID NO: 596528 - DNA, 329 bp, Homo sapiens
ctgctgccacttacgcgcataagttaagtcaagagatctgctcggccgaacactacgagccacatcttaaaactcaggggaccaggcggagcttcatattcatatagaggagcctgtcctgaaatccataaaccggggacaaccttaccacctatagctcagcctatataccgccatcttcagcaaaccctgattacggctacatagaaagcgcacggacccacgtaaagacgttagctcaaggactaacccatgggcggtcaagaaaggggctacattttctaccccagaaaactacgatcgcctttatgaaacttaaggtacgaagg

SEQ ID NO: 596529 - DNA, 1603 bp, Homo sapiens
ctttttaaacgggccgtaaatctgtgacaaatttttgggtcaatttgttcccatttaaaaagtactgattttaaaaactaataacttaaaactgccacacgcaaaaaaaaaaaccaaagtgttccacaaaacattctcctttccttcgtgaaggtttaacaatgtgcattgtgttattcatttaaccagctcttttactacataaactttaaagtggccaattgtgaaacaaacagtttctgaaaccgttctttccaccacgtgatttaaaaggtggggtgtggcaggatatttagggagatataaatattctcacttataacccttctcttagaccttttctgtggagcaagacttgtgggtagcaccttgtgcacagctctcccacgcagcctattcttgtgttccaccagtgcgtttttgaaataaccaccccaccgcgcacaagtgtgttctgtgttcttcatttattcaccagaaaacagggcaaaaggacaccccacaaaagggtgtgagaatacgttcttagagaaaaagctctctctcaaacaacaacatgttgggcttttgcccagagagaacccattatttcataaccaatatggacagaattttacaccaaaaactttcagagacaaatattatagaggccatctcttctacagcacttttttatcccccagagaaacgcggcaaaatacaaaactctttatattcctatatcagaatcttcagaacaaaaacattgttctattgtcaaactgttgtgtgtaccccccgcttggtgtgcggacacaactccccaaatataacagggggggggccaatatatgcggaggggcggctataatttctggggcccatgagaatgtgggctccccacgggataatactaatccacctgttgataaacacaagtatagaacaacccccaagagtagtgggatcaccccaaatatggagggagggaggcctcaaccatatatagtgggtgtggttgctccaacacccaagcaaacagtgtatttgaccccaagcgaagaaagaaacagcctatctccgtatgaaacgagaaaagccaccacagtctccttttgacacattttgtgaagaggcccccccactatttatgtgtcccccccagaggaaaaagagaggcgattactactgttccacaaaaggactttcacagagggggtcgatcaattttgcgcgacgaggaaatgttgaaaacattctcgctggatgtgactaacactcggtttgtaacatcgtgggtgccacacaaaagtggtgttgacctccaccaaaattcagccaggggtgtttactgagagaaaacacaccccagtggtttctactccaactactgtgggcgaacaagaggtgaaaacaggcgttcccacaacattagctccctcagtttctggtgtgtgactcccacttctgtgtaagaaggacaaagggccaacaaaggagggattgtactacgtttgggccagcaaatttatggtagcgttaagtgtagagagtcagagacgcaagaagccgcctataacgagcaggtagatgttccactagggtagaagtaccacctatcagg

SEQ ID NO: 596530 - DNA, 334 bp, Homo sapiens
gtgtgttcccgttgtctaaatagtacattcttttttttgtaattggtaactatttgtggggcgaggggctcacgccggtaatcctagcacttggggaggccgagggggcagatggcttgagctcaggagttggacaccagccggggcaacagggtgaaacccggtctcggtgaaaacatagaaaaaatataatgagcggggggtggtggcacatgcctgtagtcccagctacttggggggctgaggcaagaggatcacttgaaaccaggaagtcgaggctgcagtgagcagagatggcgccactgcactccagcctagtagacaaagggaaaca

SEQ ID NO: 596531 - DNA, 393 bp, Homo sapiens
tattacacatcatctgctccagtaggtccttctgcttgcagggtccacgtcatccttgctgatggggtctgacaggaagcacaggcccaaagcaagcctgaccttctgccagaaggagagcgctgacgatggccctcttgaaggtgacgggaattgggtcggtcacccaggtggaacttttgcaaaaaggcaccttgcttggccttccttgaaagggctccctgaactcgccaccttgggccttgcccaagttgctcggtagatgtgtgcaaacccctttcagcagcaggatgttgcatcagccccggacatttgtgcccgttctgcctcagggcctgttgcagctttctcaaggctgagctccttgggcctcccgcagcagggtgttctcgt

SEQ ID NO: 596532 - DNA, 1219 bp, Homo sapiens
tctttcggaagaagggctctctgtagtctcgcttctcccgggcccggctgtcccgcctcctctccttgctgtcctcctttcaccgtcttccaagattgagctgggccacagagttcgctcttcagtgttcccgtgatagtcgtgtcacgtggcgagtctcccagcgtgtccttccccttttgaaattcaagggatgaatcggacaagttcagagaaaccacgcgatctcgctgaatcgtcagaaagaggctaaattggggtgtcttcattctccagaaaacgtgattttggttacaatattcgtcaaaagcagaatcttccctataaacctttttctttttggagtttttccttatatcttcttttaaaaactcttcctccttctcttgtggaaattttggtccctctttttaaattcatttctccttccaaaaaaaaaaaacaacaaacaaaaaaaccacaaaaaaacaacaaaaaaaaaaagagagaggggggcgcgccacaaaaagaaataacccccagaggggggcgccccaattagagcccatcccccacattttttccacacagggggcccccaatagaggagggccatcaaatataacacacaagaaaagagcagatttaataacacacgacgccaactggaaacacggcgcaaaaagaggagacacctcggagaagagagaccctaaaaacgggggggggggaaacaattgtggggcacacaccctcacccgagaataagttatacaaccccctcatcaaggggagaacacattaccattacccacaggtagtttatcgtgggtggtgaaacacacatcgcgcgcattactatcgccggcgacgacaactttccgcccagaggactgtttatattgaaaactttaccgggggtgtctcctaatacacatacatatgacgcatcacaccagcgacaaacaagcgagtgcacaggtgcgcaacacagcaagccccaagaccacgcagtgagaagcgctaacccgcaagacgaggaggaaagggcgaaccacgccacaaacagcggtccaccaaccaaaagaagacggccacgcccgacaatcgcagcacgtcagcaccaagagacacagaagacgacaatcaaaacctagaatgcagaaaacagccacgcacagacgaaccgaacgcaactaaaagtcacgccggcagcacaaaccaacacgacgccacacta

SEQ ID NO: 596533 - DNA, 483 bp, Homo sapiens
gcttgaactcctgatgccaggtgatccacccacctcggcctcccaaagtactggaattacaggcatgagggacccctcccaggcccccccctttttttttaatcctaaaaagcttcctaagggttggccagagcaattaactccagtgaatacctcttctaaagacttaccaaaagggtcatttgtgcctatttaactgtttttaccaaactgccctgtctcttttctgctgccaactaagcagtttcctagggacaaaaaaatatcccatatttttttttttttttgcttacaaaacaagacccacctgtattttctttcttcaaaaaggccctggggaagaataggacagcttattaataagttcctccagacaacagttaacccctttgttaaaactttttattgaggaaaaaggggccttcatgacctgctttttcccttcacctgaattttagctgccgttcttttttttttgtcctt

SEQ ID NO: 596534 - DNA, 359 bp, Homo sapiens
gcagagcacagcattgtcaggaccagactcgtgtcaggccaggtgcagccttctcagtcaaacgccgaccaaggctcactaccatgagaattgcagcgatttgcttttgcctactaggcatcacctgtgccataccagttaaacaggctgattctggaagttctgaggactcatcttatgagcagactctcctagccccacagaatgctgtgtcctctgaagaaaccaatgactttaaacacgagacccttccacgtaagaccaacggccatgaccacatggatgatatggatgatgaagatgatgatgaccatgtggacagtcaggactacattgactcgaacgactctgatgatgtc

SEQ ID NO: 596535 - DNA, 426 bp, Homo sapiens
agcttagccgcttactggtgaggtaggactggatggagggtgaatgcgagaggaggaacaggaggaggacgctggaggaagaggatccggcatctcagggcgggatgactggttcgctctcatgagctgtcctgaaaagcgatatgagtttgaagcagaagatcgagaaggagccagaggaagcaggccaagacacaccctccactctccccatgcttgctgtcccacagataccctcttacaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcagcgagagcaggatgagaagacaagtg

SEQ ID NO: 596536 - DNA, 144 bp, Homo sapiens
gtatatgggttatagttttaattattaggaggatgatggttgtctttggatatactacaggatggtattgaggagtatctgcagcatgggggtcagggttgagggtcttggtgagtgtatcagtggggttagcgatggaggtag

SEQ ID NO: 596537 - DNA, 384 bp, Homo sapiens
cctttgttgggatccgaaggaactgtactccccctgccctccccgacccgcccagtttagccgatgacctgcacatcgctcccctgtggtccaaaaaaggaggcctttcgatgtttgaaaaaaaggcccccccctgtagagtcccgaaagcccaggagtgaagggggttcctggagtctttagggtgcttcttccaaagtctgttttcttgcttccaaatgtggtcaacttttggaaccctcgctgtagctttattgtttagccccaagcaaaatttttttcctcctgccccgcatgtgtatggtgggcctctgtacccttgaaatgtgcaatgtgcccaattgttgactcccaaaaaaaaaggtttggggttgtaaaaaaaaa

SEQ ID NO: 596538 - DNA, 108 bp, Homo sapiens
cacgagggggggacccatccgagaccctgcagggggagctaactctcaagtcggccatgatcgagatcagggcatccagagcctgatctgcaggcagctgggcaacgc

SEQ ID NO: 596539 - DNA, 318 bp, Homo sapiens
gaatgactctgatgcccttaccttttcaaactaaactaagctttgtcaccttcattgactttgattattttaagacttttattactaattttggaatcacgaacacacccccccctccattaatttacagctaggggttggccagcactggagaccctcctaaattaccatatacctttgaattcatggactggatggtttatatctactttctctgtcccatagagttatacccgtcggtgattgaactgagttcccccggatgtcgaaggaaaaatcactttatgtgattattgttcgtaacaaacatgggcacat

SEQ ID NO: 596540 - DNA, 517 bp, Homo sapiens
  misc_feature (10)..(10): n is a, c, g, or t
  misc_feature (99)..(99): n is a, c, g, or t
  misc_feature (140)..(140): n is a, c, g, or t
  misc_feature (146)..(146): n is a, c, g, or t
  misc_feature (152)..(152): n is a, c, g, or t
  misc_feature (189)..(189): n is a, c, g, or t
  misc_feature (211)..(211): n is a, c, g, or t
  misc_feature (251)..(251): n is a, c, g, or t
  misc_feature (315)..(315): n is a, c, g, or t
  misc_feature (369)..(369): n is a, c, g, or t
  misc_feature (376)..(376): n is a, c, g, or t
  misc_feature (420)..(420): n is a, c, g, or t
  misc_feature (422)..(422): n is a, c, g, or t
  misc_feature (509)..(509): n is a, c, g, or t
gcggcctgancttcaaggcagccagctccctcccggtctcgccttccctcgcggtcaacatgaaagccttcagtcccgtgaagtccgttagaaaaacancctgtcggaccacagcctgggcatctcccggagacaaaacncctgtngacganccgatgaacctgctatacaacatgaacgactgcaacnccaaactcaaagagctggtgcncaacatcccccaaaacaagaaagtgaacaagatagaaatnctacagcacgtcatcgactacatcttggacctgcagatcgccctggactcgcatcccacatatngtcaacctacatcacacagagacccgggcagaaccaaacgtccaagacaccgcngaccacnctcaacacagatatcagcatcctgtccttacaggcttctgaatncncttctgaataaaaacaaaagacagcaaaacactgtgtggctgaataaacagtgaatgtatgcatgtaccacccgtaggtaacagccnctcagatg

SEQ ID NO: 596541 - DNA, 159 bp, Homo sapiens
catggtcctgtcggtttaagggtactgtagagccgaactttgagttactgtgcaagatttttttttgcaatggtcctgtcggtttattcactgtatgtccttggtgcctggagcctactaaatgctcaataaataatgatcacaggaaaaaaaaaaaag

SEQ ID NO: 596542 - DNA, 805 bp, Homo sapiens
tgtagagattatattaaatacctctgatctaactaaatgtgaatgggtaatgtccgaaaattacctgtaaggtttcttcaagcaattccagcagtttatcaaaagctgagcatccaactgcaaatgaataaggaggataaagttggaatgatgtaaaggagtaaataaattaacaaatttagaagaacaatatataattttaatttttcaaaatggcttgatcctccggcaaatatggtatttgaaagtatcattaatgaaattggtataaagaataaattttcaatttttttgggaaaattccctttggagaaagtctatgggcgagattggtggctcggtacaggaacctatgagagagagctatcaacaggaagttgtgggcaaagaggaaaacaaaattaaaagtgtatcatgtgactctaaaatacaacttagaagcaaaacaagaatttcagtttttgatgaagaagaagaaactggagaaaacacacatcttcatttggccagtagaaaagtggatagtatatccacaactccagctaagggaggatctctgttaccaatgaggactgaactgtctaaatgaaggagaattttaaatgatgttattatagactttcattgaaatacttgggtgttgacaaactgaaaaaagcaggagctgacgaattgatatatacagtgtttttctataaagccttaatcgagagaggggagaatttgaaacaataatctgcaatcaggacaaaggggggagaataaaaatggcgggagggaattttcgaacgatcatttgggccta

SEQ ID NO: 596543 - DNA, 700 bp, Homo sapiens
  misc_feature (144)..(144): n is a, c, g, or t
agtatggggagtcaattcttccacgttagcggagaccccccttcttccgctcatatgttactctcgccccccggctcgcacaaaaataatcaattgtcgaaagcgtacttcactaggcgatcatacttacacggctgtgtctgncgcacgactcttcttttggcggcgaattctccacagataaggtgtttattcttaaggacgtagtgaaatattgacattcaatttgcagtagttgaagtctctcggtagaacacgctatcatcgttagggtgtgtgatgaaaacgactggggcccctttatagcccttctggatataattacctctcttcggcttggaactcatactactaccactgcaataaactttcttcccactttcacccccccgtgacaaaaaattggttttttcaatccaacaatttgtaaaaataatttggcatttatacaccaacttctctggaaaccaccgtggccccgcgataatagtatcccctctctctctgcacagtggagccctctctggtgcacaacatgctgtgcgatgcccccccccccctcttgggaggcctgtggcacggcgggtgtgtgtctctagggccacgcgggcattcggtgcacctctcttggtccaccacgggggcagtcatcgtcccttgtttttgtctaaaaagatataaatcaatagataagagaaaa

SEQ ID NO: 596544 - DNA, 109 bp, Homo sapiens
agtgggtcctgcacgttgtggggcagctcggggcaggcggttagctggcggtgcaggcctcgtgcgcgggtcagcacgtcctccacgctcagcttcatagtcagcgtgg

SEQ ID NO: 596545 - DNA, 1753 bp, Homo sapiens
  misc_feature (844)..(844): n is a, c, g, or t
  misc_feature (929)..(929): n is a, c, g, or t
  misc_feature (1752)..(1752): n is a, c, g, or t
gctgagagctcagtgagcatcctgcatgggaggtggatggtggagagagcaaccacgggggcatacggtgtgcccctcgcgccgggaaggggggggcgaaaccctaagcccctacgcccgccttcatgcatccgcacctgatcgttaccctggcaccaagagaacaccgtcgtcgcgcctacaaaacgtccgagactggacggtagtacgcacaggtgcacgggcgttctcacatgtgaggtcaggcgcgggcgatgaaccaggaatcggggctacgcggcgcctacgtgaaaggtagtcgaccaaggcaagcgtatcccaagcgcagggggagatgcgatgagcgacgcagaacaattttcacatcccgttacacgcaattgagagcacgtgaggaagccgtcttgagcggccgtacacttgaactgattttgacgtggttgtgcgctagtggttcattttgagctaatctctatggaatccgcagcactggaaattgattgcgactttgtatggggacagaacaccatgtgtagcctcgagatacttaacgtggtttcatttaccatcgcaaaattccatcgagtgcaaagggtatgtagggagaaacaagtgcctttgcaggaaacataatgaggtgaaagacgtgccagaaaactgatggtgaaggttcgggaacgtggactctattactgtgatcgaatatttcaatgcatacaccacaagaacctgttgcattgaagcatggagtaggaggctggggtactgacactgacaagaggaagcatgctgctattgtcaacactatatcgagacattacaacagcaatgtgagaattgtgangctcagcgtaagcgggagcaattggccacccaataatcctcgcgtctcacgggggatcaaaaacaatttgaactccccaacgganttattaaggtgggatcgaaccattgcggactttttgaaacactatcccatggaaccgcgttcgaattgggaaaagcgttggcgctggagattattcgacgcacttcttgacaagcttataattttggagggccttagaccccaaaacaggaatttagttaccaaagttttgccccgcccaattgatgagttagggggcaagacaaaggcggcccgaggaaagtttgggggacaccttgggggcagggcgcaccttatttaagtggctatattgggaacttggggcagtcacgcggggggaccaaggtccccaggtcgacataagatcggataaagcttcaatgggctgtcgtacagcgggaaacttttgcacacgtacagtgaatccgcgcaaggaaaaatgtaccccagcttgcggttggggaagacgtgagaacgtgtggcccgacgatgcggtggtctgggcgagggggttcccccataaaagaacatatttacaatgtattgacactttccccaagaaattgttggcgtgtaaagtggaagttgcactctagacacggtacggggcgtcccatatgggtaatggattacactccgagttaagggagttagtgaactcaccgtcaaatgtttgtgtggaaaaaccgctgttattaggtatgccccaaaggtaagtatagcctatcaacaaagtagtgatgcacgggccgaaaattagtaagtcggtacagcactaatatagcagaaaatacgacagtgtatctcaccaacaggtatatgagagtgatagtatactaggtataccgttgagtggtgcttgnt

SEQ ID NO: 596546 - DNA, 218 bp, Homo sapiens
atgataggcggaccacttgatgtcaccgctcatagctaattttgtatttttagtagacacaaggtttcactgtgtggccaggctggtctcaaactcctgacctcaggcgatccacccacttcaccctcccaaagtgctgggattacaggcgtgagccactgtgcccggaatgttttgggttttttttagagataggatctcactctgtcacccaggct

SEQ ID NO: 596547 - DNA, 313 bp, Homo sapiens
caaaaaaaaaaaaaaaaaaaaaaagcccggcatggtggtgggctactttggaggcccttgaggatcccttgagcccaggagattgaggctccagtgacccatgattgtgcccctgcccctttagtttgggggacagagcaagcccctgtttaaaaaaaaaaaaggccaggcccggtggctcatgcctgtaatcccagctacgcagggggccaaggcaggaaaatcccttgaacctgggaggtgggggttccagtgagctgaaattgtgtcattgccccccagcctgggcaccaaaagcaaaactttgttccca

SEQ ID NO: 596548 - DNA, 337 bp, Homo sapiens
gtacctaggatttatagtaggactacttgctattgtgagtcctccccgactctgggcttgtgctactactgtacccagacgtcacgtctttcccctacccttctctcctttccgtcatcctaagtgcctggctagatgaaggagttttacaggagcttttgacactatataaccgccctttttgtatgcacacacgggcggcttattatatgtaattgacagcgtgggagtgggtgagcatgagaggtaggggtgggacctggagatgaggagggtgggccatccttaccccacacttttattggttgtcgtataacgtctgtggtgttttttgttt

SEQ ID NO: 596549 - DNA, 250 bp, Homo sapiens
gagatgcgggtcacggcgccccgaaccgtcctcctgctgctcttgggggcaagtgcccttaaccagaacttgggccgcttccacttcatgagggaattctacaaccgcaatgtcccgccccggccgcgggagagcccctctcacatgcgcagtggctctacgtgagacgacacccagttgcgtagaggttgcgacagcaacggccgcgagtcccgaggacggagccccggcgcgccattgtatagagcag

SEQ ID NO: 596550 - DNA, 351 bp, Homo sapiens
ttttgagacaatctccctctgttgccaggctggagtgcagcagcgatctctcagctcactggaacctccgcctcccgggttcaagtgattcccttgactcagcctcccgagtagctgggactacaggcgcgccttcttgtattttagtggagatgatgtttcaccatgttggccaggatggtctcgatctcctgacctcgtgatccacctgccttggcctcccaaagtgcggggattacaggagtgagccactgcgcctggccctaattttctacctccatatggaacttagaactcagatgacctgacagaccacctaatatatgtctaacttttgtcgacgcggccgga

SEQ ID NO: 596551 - DNA, 923 bp, Homo sapiens
ttactcaggttttcctttcagattgtttatgtatagcttctttgtgtggcatttgtccaatttctatggtttagggaatcctttatttttgtatatgtccactcggttcatgtgacaaacccatttagcgtgttcaacaagggattttaaccaggattgtgctccttggtgttttagatgtattcttcccccaggacctgtgaccaccaccacgggctatgaggataattgatagaggttttgctttcctgtgtccaagtatggggatcactccacaaggactggcaccactggtgggggctgcctagtcgggaattaggaccacccatggattgtgaaaatggagccatgacaagaactaagccactgactgagatggagtgacctgtagacagataagagtataccttggtctcacctatcctgccctcacatcttccaccagcacctttctgcccaggcctatctggaagccacctcacccaggaccttggaagagtccagggaccgtgaggcaggagaagaaccagaaatggatgtaagcctggcccataatgtgacataagtatatcacctaatgctcaaccatttatcccttccatcactttattcacttgggttgtcagatagtctatgtatgtgtaaaaccatctgttttggctttatgtcccaaatctgttatagctttccaaatatatctggaactttttagattattcccacgccctattttgagtaaatatttgttaacttttagttctataagatgaggaagagtttatggccaagatttttggcactttgttttcaacagatggtgttatcttttgaattcctgattaatgactgttttttttctgcctaatagtaactggttaaaaaccaatgttcatatttattgatttaaaatgtggttgccttta

SEQ ID NO: 596552 - DNA, 233 bp, Homo sapiens
gaggatgatatttgtcggcgcagtcgatcataggcttcctgccctgcttgtgtaccacagagccagctccacctgcttgccgtccacctcaatgtccgcaatatagtcctcaaagacagtagggacgtcgacctccggaacactgatccttgctcgaagacgactgaggagtgcaggtcttacccacatggcaccataccccagacgatcaccagtcttctttcgtgattgca

SEQ ID NO: 596553 - DNA, 151 bp, Homo sapiens
actatgtagcaggtttcgggcgggccacgcgtgcggcacaggaacccaacccaagccgaccttgatctccaggagttcgtctcttaagtctgcggaagtgcagctgcctcagttcttagcgcaggttgacaactacaggcacaagcattga

SEQ ID NO: 596554 - DNA, 267 bp, Homo sapiens
ttggatgccaacatcagctcccaggcagccactgctcctcccatgcagcctcacctcaatagcccccaaatacctacatactagcgacatgctcaagatgcccggtttccttcacagcgtcaaccgtctgcaaagagaagccggaacagcaacatgccggggtattagtatactagctgcgggtacaatatgacagcctccatccgtgaatcctgtcaagcagcagatagatgaataaaaaggaacattcgggccaaaaaaaaaaaa

SEQ ID NO: 596555 - DNA, 666 bp, Homo sapiens
gaccatcaacttcgtgcctacggaggactcccatggcatagacaagtagtctagagagataccacagactccgtaggcagaagcttctccccatggactacgagtgaaaagagtagtagcttctctctgtcctcaacagaggtacacatggtccgcccaggatactctcatcgagtgtctctgcccacaagcgctgggattatggacacctccccatatccagagactgacagtgctaatcatgagccttcccatctgacatctgctgctgatgaatgtaataacagtaggtgacctccctcattcctctctgtgcacacacttgcttcgcctagctctaaagtctgccttgtatgtcttccccatgggacaatgcattgcctcatctaatattgtcagcagcccagccatctgggcggtcacaacaggtgacctcaaatatgggcgttctccttagactgcagaaaatggtcatcttgttagcttcctgtagttgatacgtcagtgccatgtgccatctataagctggcgtctgccttcaggaacttagagctcataaaattgtctacaggggagagcatcggaagcactctcaagtcagtgtggacgtcggaggtgtttcagacagccccggggctgcattcacaccagtactatacgtgtgag

SEQ ID NO: 596556 - DNA, 740 bp, Homo sapiens
  misc_feature (192)..(192): n is a, c, g, or t
cacccggggaaacctgggggccccgcactcgcggcccacccccaccccttgcgtgtttgccaccaggccccccaagagtaagaaatggggcccccgcgcccttggagggaccacccccgggacattaatggtggcccatctgggcgatccaagccaccaggcccaacgccaggggaatgataacctctggcnatagagcgccaccccgcccctggtgaccccatctttgctccccctgtgcccacacccctggcccccggctgaaagacttcggccccccttctgctgtcaccccatagatggggagaccctcaccccccgaagtgtatccccccgcagggcattcagggaccccagctgagatggttgactcaccaggggaatcccgcggcagcagcacggcccacgcttaaaggatgttggccccctagtcccctggggccccctgcgtctcacaataaggagcctgggatcccgatggaaaggtggagctccagggaaaatagtggggtcccttgccctcttctgtgtcacccccctcaaggcgtgacccccttagatggccccacggaatgcgccagcgtgctcaccaaaatggtgaccccaccgtgcggccatggaaatgggcgcccgaattaggggaccacctggactcaaaggggagggaagggcttatcccaccccccctcagggagcccttccccttatgttccccaataaagggtcctaaaaaacttaca

SEQ ID NO: 596557 - DNA, 205 bp, Homo sapiens
  misc_feature (71)..(71): n is a, c, g, or t
  misc_feature (111)..(111): n is a, c, g, or t
  misc_feature (155)..(156): n is a, c, g, or t
  misc_feature (171)..(171): n is a, c, g, or t
gttatgtctgacgggcacacacagcatatatacatctatggtctcacacgtaccctccaccacgctccatncatgctcatccttgatcacatgaaaagactggcgccaacntttccttttcatcaaagggggggaaatccacctccttaaaatanncctcttttcccttcncgatttatctccgtttgacctcaccgcagtgtgt

SEQ ID NO: 596558 - DNA, 400 bp, Homo sapiens
  misc_feature (1)..(1): n is a, c, g, or t
  misc_feature (245)..(245): n is a, c, g, or t
  misc_feature (249)..(249): n is a, c, g, or t
  misc_feature (258)..(258): n is a, c, g, or t
  misc_feature (312)..(312): n is a, c, g, or t
  misc_feature (396)..(397): n is a, c, g, or t
nctgaggggacgttcgtgaaggcctaatggctggacgcccacgaacatcccagtgtgggcctggacgggacatcatgccgggcaacacagctaaaatgggggtgaagaccatatttcttgcgcgtggcggtgacgggatggtcgctagagagtctgaagtgggttgtgtgctcggtcttgcggtctgtcgtcttctgtgtgcgggccttcgcgttggcaaaatacaaaaaggttcttgtatagcngggntccgcgtgnggctgtgtcttggtgttgcgctcgtctgcgtgcgtgttgcgcgttttttttctntcctcctctgtgctttccccgtcccccccgtgccgcgcacccgtgccgctgcgcccccccctccccgcccgcctcccgcgcgcnngca

SEQ ID NO: 596559 - DNA, 129 bp, Homo sapiens
agcgtgactgccagcgtctaaaagtcattaatgccgcgccaatgagccattctagtcagggcttcaccagtgtgactcagtaaacatttgatgagtacttcatatcagaaacagggcacaacggttaat

SEQ ID NO: 596560 - DNA, 139 bp, Homo sapiens
gcccccccttcccccttttttgtccccaacttgaaatgatgaaggcttttggtctccctgggagtgggtggaggcagccaggggttacctgtaccctgactttagaccagttgaataaaagggcccccctttaaaatga

SEQ ID NO: 596561 - DNA, 183 bp, Homo sapiens
agcttagatgcagttatccactaagattaggttatattttaactgtaccacagcagcattcatcatcataacgcttcactttggtatgttcttaacaatcattaattccctgaaattacaaactagttaccttaaccttgcttgagtgatccttcctaacttctcagtccaaacaaatactga

SEQ ID NO: 596562 - DNA, 133 bp, Homo sapiens
  misc_feature (33)..(33): n is a, c, g, or t
ctgcttctgaaactatatcagcagcctcagccnattaatttcaacaccaccattggtgcaaagccaactgcctcaacagcagcctcaaccaccacaaccacagcaggaactggtttcaagaagcaggaactgg

SEQ ID NO: 596563 - DNA, 223 bp, Homo sapiens
cttgggatcgagctgagatctgaggcgacaaagaggccggcggaagcaaggagcaagaagcttggaagatgagctggtgtcactgcaaaagaaactcaggggcaccaagatgaactggacaaatactttaaggctcttaaagaatgcccaggggaagctggagcttgcagagaaaaaggccacatgcttgagccgacgtagcttttttgaacagacgcatcca

SEQ ID NO: 596564 - DNA, 124 bp, Homo sapiens
  misc_feature (110)..(110): n is a, c, g, or t
atgaagcgtgagagttgatgatcatgcgtgagtataagctagtcgtctgtcaggaggtctgtgatgtacaattgttcaaggaatttttgtagaaaaatacgatcctacgnatagaagattctta

SEQ ID NO: 596565 - DNA, 853 bp, Homo sapiens
  misc_feature (173)..(173): n is a, c, g, or t
gacacacaagaatatatggtgaaacgacagctcacctctactcacttcaccacaagttgctaaccccgctaaagcccccttttccccttgtgaacttctccccaatcataacaattacccacttggggccattccactccaagagagttcatccccacacaaccaaagaacgngtttacaattgtgaattagactccccataaatcctgttccatcaactgcagataactcctggcccaagacccaactcgccgctccccacctttgaaagatcgccccccttttggcgggatttcccgcccaactgactacaaagcggactttttcaaaaagtgttaaccttttcggaagccatttgcacaggctcccccgcgatccaacccccgaacttttttccttgtcggaacccccttctgccaggtataatgtgccccgcacccccaccccaccagaaataaagtattgggataaacaaacagaatacaccagtgttcaaaaagcacctttccctcatgttaatagtacctttcgacaaacccatggggttgtgaggaaccccccacatgtattctacaaaccacacgaggaatcataaatgtttatccaaatatctaataccgttaaaaggtgggcattatccataaagaaaacccactctcttcagcaacccccgcacaatatgtataaaaagatatactttccccccggacaccactcactcgtagttaatacacgtctcacccacaagaaaaacgggtttttttttctttctgtctatacacaccaagctttgcataaatcttctactttcaacccagaaaaaaatttcccccacaaaaaaacccacataaca

SEQ ID NO: 596566 - DNA, 191 bp, Homo sapiens
accccaaataacaagtagtttccaaggaaaattcaggggctttttggttttttaacaaaaaaaaaagcccagccctttttgatccaaacggtcttttttttggatctgttatttaaagcccaggggatatttcaattaaaaaaaaaatttaaaaatgaaaagtccttggtccttccttatccctggcttta

SEQ ID NO: 596567 - DNA, 835 bp, Homo sapiens
  misc_feature (396)..(396): n is a, c, g, or t
  misc_feature (437)..(437): n is a, c, g, or t
ccagggattgtcccgtttcatgctgtgtgaatggacttataggagcacagccagaggcgcctgatgtgggaggctggggcgcattctcctagaatcaggtaaactgactgatgggcctcagtcttctaagtgaaggcagagacctgggttgagcagcagaataaaagatcttcttccaacgacatgcaacatcatgactcgattcagcccagccatcgtccagctgcgtcacagcatcagccaggctgacagcaagtgtgttccatgatcgaaagtagattggcctgacaacatcacgagtcaattaatttgtaattgaaaattctctcttatgttccaagtgtacgaagagtaagattatgctcagtattctcagaattagttttaccatgtctntaatgcaagtgtatttaatttggcttccattatttagactnaatataagcacgattaagcaatcttccacatgaggaaaccacacggaggttgggccagaattctttcccttccaacgaggggcggggcacaccagaattgtgccttgccgggggggagcagcaggggctttgacgttgcccacagcgacgttgtttgctgttaacccaatgtggggggcccccccatatttgtggaagagtccaggtcattaataactgcaaagctggcagccagagaccctggggtctaactagaccacacgggatggacacgcggcgaaaaaagttggtggaccatccaggagggcacacctagagtgaacacctgcacacttgacccttggtggacgggggcgactacaactatgatgttggcgagctgacccccctgttgaacc

SEQ ID NO: 596568 - DNA, 413 bp, Homo sapiens
cattcttcttcttttaattcttatcacttttgggataataacttgcccaagggctaaccagagaacaagcagcaggagcaaggctccatcccaggtctcctggctttaagaactgtgctcggccgggcgcggtggctcacgcctgtaatcccagcactttgggaggccgaggcaggcggatcacgaggtcaggagatcgagtccatcccggctaaaacggtgaaaccccgtctctaataaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagagggagactccgtctcaaaaaaaaaaaa

SEQ ID NO: 596569 - DNA, 212 bp, Homo sapiens
caatgtcatgtggtactgatggaattgaatgatgagaatgtgcacgaacttctatacccagttctatgctaactgcgatgtgtaaggacttctgtgcccagttctatgctaactgctataagaactacaaaataaatcaaagacttggcattttccatggaatgtagagtatagaacgtgaggggggtaaatccctaataaatttaactagg

SEQ ID NO: 596570 - DNA, 1896 bp, Homo sapiens
  misc_feature (1233)..(1233): n is a, c, g, or t
tgtctgctggtgctgcggggttcgggtcgctgaggagggtgctgtcagtgtgcttctttttcgtggtgtctgagcgctgtggtagtgagtgcgtctagcggggagcttcacgctgtggtgcggcgctgtgttcgttcgtgagtgccgtgctcgctcgtaattagttagttgtcagtccgtgggcttggtctgctggagcgtgtggccttttgtggcgtcgtgcctgtggtgagcgcttgtgtatcgcagttttggtgcagttctgtcgcctgagctgcgttctgtagcgagtgggggtctgttgtggttggtggtcgtgcgttggttgtgcgtggtgtgtgttggtgggggcgcggcgtgttcggggtgtgattatgcacgggcgttgcgaccccgggtgtgttgtatgatgtccgtcagtgttggccccctgttgagtggtggttgtgtctctaggtggcgcgagcgagatgtcggcgtggagtgttttttatgggggtgtgtaccgcagctcttgtaagttggtaggtatctcttcgtcgtagagagaggtgatgtctgccgccgcctcggagggtggtgttgggggctcccccgtcagttgtgggtggaggcgctcgtgagggacgtgtgtgggtgtggtgaggagagaccgcggttggcgcgggggacctcctccgagggtgtgtgttgatcgctgtgatgtgtgctgcccggcggggttgtccccgttcagtagtgagcggtggtttgctcgcgcagaggtcgcccccctcggaggggtgttgtgtgggccggcgagatgattgtttcgcgcgtggcctcctcctgcagggtgggttggttgggggccaacaggggcgacgtccgcgggggtgatgtggtggttgcctgcactgcgctgagtgtttttgtgtgggggggagggttgtctgtctgatgaggggtccagcccccgagggggagtgaaggtgggagagtctttggaggatttctcctcccctgcatgaagaagtagtttgttgtaaagtaggaagcttgttgtgcactacaagcttggtggaaagggcctccaccacagatgatttggttgtgcgtgtactcaaccacgtggtacgacttacattgtctttgttaaagaacgtgttgtggtgtggccagcagcacatcctggatgtggatgtcgccgctgcgtgttttgtttcatctacagtagaaatggagtaaataatnattttgttgcgcatcgggtttatggaggccccgccgtgataaaggaggagcgtctgtgtacacgacttggtgagagaagagaaatgtgaggtgagaaacaggaagttgtgtggtgtctctttgtggtggtgtggtactaaagatgatatgaggtggtgccgcgacgtctgtgcgacgcgacgacaacagataacatggaggcaggtatgtggttcgtgaaagatatatattgttgggtgagtatagctctctccaccgcccgtctttgtgtgagacacacgcaggctatatagatggatatctgggtgtagatctctctctctcgtgatagatatcttgtctcgtcacactctgtttcacagagatatcgctttctctcagagggttttagatccaatattctggtaataatataatttgctcggacgttataagaagatgtgtacgaccacatttagagctttgttaagagtggttgtgccaccatccacacccttaaagaagaacacccattcttatggaagagttataggttggaaacacatactgttagggatccctcggactgggatttcccgtgaggtttacccaagtccactgggtgaactgttttgtgccctggcttggtaatggtgttcagtcttataaaagtgtacgttataa

SEQ ID NO: 596571 - DNA, 223 bp, Homo sapiens
gaaggattaccatgaacttattttaaatccatactgtaccagaatgcctatgtctgtgtttcttaggaatgttgaagctatttgtgaaaactggtctgtacacatatataaatagacacacacttacatgtatgtattttgatagatatcacatggactaaattttgtcaatttcatgtaatttacccttggcaataaaaatgattcattaaatataaaaatc

SEQ ID NO: 596572 - DNA, 887 bp, Homo sapiens
ccacagtagctgtaactgccaccggatgccgaaggcgcccaagcagcagccgcggagcccgagtggatcgggacggagagagcacgagcccatcagacaaagtggtgaccgacccgggaagacggacccgacgatcaaaaaaacgtttttggaagagctggcagtagaagataaaacaggctggggaagaagagaaacgtgctcaaggcgacggagcagccagcagcagcaacagcaacacgcagccgcaaaaaaaaaaggcgagatacccgaaagggccggcggaacacggatgtggcaatgatgattgggacacagagacaagagcctcctggagcggtctctcaaggacgactctcaggcgccaacccaaggggatgaggagcgattgagggttaccagggccacaaaaacccccgcgcgaggggaacgaacaacccaaggcgggagggaacacgggtcattagcggcaaggccaccggattcccaggcactacaggaggtggaggacacgacgtgaagagacggacacaggaaaacaatcttgcctttcctaaacggacctgggccacaacgccccgggacgaacgactccggggagcacaatacggcgccggtaatcactgggaggggcacaccagacggccctggcacctcccagggggcaccaacaagggggacaaggggaacggcagcaaggctccaacaacaagggggcacaggggataacagcccccgcaaaacaatacaactaccggatgggcccactgggcaccacagcacaacaacaatacactcagacgcacacacaaccaccaatcactagcgggacccacgccagcagcacccagcgaaagggtcatcacaacaaccaatcaggacaagga

SEQ ID NO: 596573 - DNA, 951 bp, Homo sapiens
  misc_feature (50)..(50): n is a, c, g, or t
  misc_feature (86)..(92): n is a, c, g, or t
  misc_feature (95)..(95): n is a, c, g, or t
  misc_feature (134)..(134): n is a, c, g, or t
  misc_feature (165)..(165): n is a, c, g, or t
  misc_feature (184)..(184): n is a, c, g, or t
  misc_feature (193)..(193): n is a, c, g, or t
  misc_feature (203)..(203): n is a, c, g, or t
  misc_feature (231)..(231): n is a, c, g, or t
  misc_feature (235)..(235): n is a, c, g, or t
  misc_feature (237)..(237): n is a, c, g, or t
  misc_feature (250)..(250): n is a, c, g, or t
  misc_feature (252)..(252): n is a, c, g, or t
  misc_feature (264)..(264): n is a, c, g, or t
  misc_feature (272)..(272): n is a, c, g, or t
  misc_feature (292)..(292): n is a, c, g, or t
  misc_feature (318)..(318): n is a, c, g, or t
  misc_feature (336)..(336): n is a, c, g, or t
  misc_feature (354)..(355): n is a, c, g, or t
  misc_feature (372)..(372): n is a, c, g, or t
  misc_feature (376)..(376): n is a, c, g, or t
  misc_feature (386)..(386): n is a, c, g, or t
  misc_feature (389)..(389): n is a, c, g, or t
  misc_feature (395)..(395): n is a, c, g, or t
  misc_feature (404)..(404): n is a, c, g, or t
  misc_feature (408)..(408): n is a, c, g, or t
  misc_feature (410)..(410): n is a, c, g, or t
  misc_feature (413)..(413): n is a, c, g, or t
  misc_feature (475)..(475): n is a, c, g, or t
  misc_feature (477)..(477): n is a, c, g, or t
  misc_feature (490)..(490): n is a, c, g, or t
  misc_feature (501)..(501): n is a, c, g, or t
  misc_feature (534)..(534): n is a, c, g, or t
  misc_feature (594)..(594): n is a, c, g, or t
  misc_feature (682)..(682): n is a, c, g, or t
  misc_feature (686)..(686): n is a, c, g, or t
  misc_feature (751)..(751): n is a, c, g, or t
  misc_feature (784)..(784): n is a, c, g, or t
  misc_feature (835)..(835): n is a, c, g, or t
  misc_feature (850)..(850): n is a, c, g, or t
  misc_feature (871)..(871): n is a, c, g, or t
  misc_feature (879)..(879): n is a, c, g, or t
  misc_feature (891)..(891): n is a, c, g, or t
  misc_feature (906)..(906): n is a, c, g, or t
ttagtaagcacttctctaacccagaatagacactgggtatcctccaagantcccatagctttcatttcatcttccaccctcttcannnnnnnggngggaggggagagggggggtgtcaggaagtatccaaaaanaccctcctagacccctgaaaaaattcacgtngccagcaataaaccaacancacctcaanagggcatcanaaggccctctaggatcaaggatattgcnaaangnattcctgtttatngnttcacgatgganccaaggcngctctcgcagactcctaggnctggtccttcactatggctgagagcngggcagggtccaggaganagtcgccaagggctaagnnagaagagattgcctttnaganaccctttggngtntgggangcacctggntttntnggnggaggagcctgggtttcttggggggggggggctgtggaagcgccaatcagttcttcttcgtntngggagtgtgatanttgctcttgcnggagtgccacaataggggggggatgcggagggngggaagggtcatgaccccaaaggctgcccagtccagaaaaggaggggagaatcgcctgtnaaactcccgctgagccaggattcctccctgtccaggtgcactggtagagccaattacaacgggcccatcctcctgggccaggtaagtnattnttgccgaggtgaagttgaaataaccagccttgagagggcgcaggaccacagtgtgggagacattnctagcaggggcaatccggtcccatttgacatanagcattccagacacaatgccaaagtcttctggagggaaggaatcatcaganagttccacgtctaangcagcccttgagccaacattntagatgtngtactgcaaggncaggtctcgtccctncacggcgtatcttttcagcagttatttggaagccaaaagcctggc

SEQ ID NO: 596574 - DNA, 762 bp, Homo sapiens
  misc_feature (749)..(749): n is a, c, g, or t
aatgggaaggcaacagacagacccaagtggcagcagtcttacttgaaggctaatcccaagaagttgctgccctgggacactcagcgggaaagagagcaggctctgtgtgtcgccatctgctttaggtttcccattggttaatgaagcccatgcatcttggaaccctgatagttgtactctttagaaaggaaaatgactaattcttttagagcagtgttatgaaagacgtgtctgttgttaatttttaatggaagtgctttggcattaaaagcccagcaggctattaggtttacattacaataacaataattcactgtcccttagtttccttttattctgaatcctcttttggggatgccttttaattgccttctcattggcttttgttcatctttcctgttgcttttgctcccatattgtccttctctagttctatcaggcaatagatcatcttgttggttttcagagaaatcccaacctgaggttaaattcaaatgccgaatttggttgttggttcttattttaatttggaggaagccagcagagatgcttgtttggttatatatggttattaatttttacttataatatagcggttcctcaattggtatatccaggtgttacaccgcatggtattacatacaaaaccaaaaacatgagcaaattctttttaagggtcttaagaaaaggtttatttgccaaccacggcaatactgaaaggtaatagattctttaaaggaaaaaacctntatatatgcccac

SEQ ID NO: 596575 - DNA, 199 bp, Homo sapiens
gcctgggcgatgtagcagactgtctcaaaaaaaaacaaagtaggagtaattgccaggcacagtggcttacacttgtatttctagcactttagcgagaccaaggtgagtggatcacttgagcccaggacctcgagcttgcaatgagccttgatcacaccactgcactccagcctgagtgacatagcaagaccctgttcat

SEQ ID NO: 596576 - DNA, 149 bp, Homo sapiens
tcttagagtattcccggcgcatgggcggctcttagaggtggctccttctgtggtctctttcgctggggctcctagtggttttatcgtgtgagcacaccatatatttacagctagaatagacatacacacaccagcatatttcacctccg

SEQ ID NO: 596577 - DNA, 513 bp, Homo sapiens
catacacatataactatgaagagaggttgaaaaacagaacattattcatgagtataggttgctattggatgagtttcgaaaggcattacaagaaaaagatcgcaagaaataagtggtttatttgtagcaaaaaaggaacaggaggaatttagaggcttttttaaggtgggaaagccaattgattctgaactccaaaataagagacataaaagatgagattgagaaaatggctttgagcgctgaagactcagtgagacttttcagttgaagtgatttactcagccatattttagaaagtcaaattaaaggtacctttccatgaaggtctatccagctgccatcatgataccctatcaaattgagagaagacgtttgaggatgagccagcagagataaaactaggtctagaaaaatactttaagtgtggttactgtcatatgaaagtgacttgaagcaaataaatcagaagcccactaaaattttgagggacttctgttgccaattagacaatgt

SEQ ID NO: 596578 - DNA, 271 bp, Homo sapiens
  misc_feature (34)..(34): n is a, c, g, or t
  misc_feature (127)..(127): n is a, c, g, or t
  misc_feature (134)..(134): n is a, c, g, or t
gagtactgcaggcagccttttccaatcatggtgnccaggtcgcgtctcattggctagtgactgatgtctggtgtccccagccgatcagacacagtggcggttggataccgagggtgctcactcactngccagtncactcctaccagctgggccttcgttgcaccacaggaagactcctttttctcacatgtggcacgagaaccccttggtgaaacctggcgaagggcatcggggcgtggatggacaggtctggtggaagcccttggaggga

SEQ ID NO: 596579 - DNA, 378 bp, Homo sapiens
tctctagcaggatcccctgagttcgccggatgtggtgactcgtgcctgtaaacccagcacattgggaggccgaggaatggtggatcacttgcagcgtcaggagttcaagactagcctggccaacatggtgaaaccctgtttctactataaatacaaaaattagctgggtgtggtggtgcatgtctgtagtcctagctacttgggaggctgaggcaggagatcgcttgaacccaggaggtagaggttgcagtgagccaagatcacgccactgtactccagcctgggcaacagagggagactccatctcaaaaaacaaaacaaaacaaaatgatcttaatcatcatcatctatatcaccatcctcacaaccatcatcatc

SEQ ID NO: 596580 - DNA, 381 bp, Homo sapiens
tgccccaagtgcatggatgtgtcccccccaagtctttaagaccccatcacagggagggggcctacttgggccctggtttccctcacatgttttttatggtgcatcccgagtaccggcccaaaaaacctcccaaccagtttgtgcccaggtttttcggtttcaaaatccatccgatggcctaccaggtggagttccaagccgccagcaattttaagagccccgttaaggagattttggtgattccctcccccccctgtccggcagtttttgacttttccttttttttttgcccccctttcaggaaccctgtatggtttttagtttaaattaaaggagtggtttttttggtgggaatattaaataaagtaaaagaaaaggcca

SEQ ID NO: 596581 - DNA, 799 bp, Homo sapiens
  misc_feature (291)..(291): n is a, c, g, or t
ggcaaaggacaacccccccgtggcaataattcctctcgaccggggcatataatgcaccccccgcgcagtgcttgtcacagaccacacaagataccggccgccccaaactcgcccggggcagacacacgtttctacaaacaaacagggtggggcaaaactccctgcgggccacatatgagtgacaccacggctgtttgtagagaggccaccccctgcgggaccagaacacacgtcccacgtcaacgccccactttgttggagagaagagcatggctccgacaagagatggtntcccgcacagcgccgggtggccaacaccatgacgagggacaccccacacgctcgccatagtcgccggggcataagcaactctccccggcgaacaggatgtccgtgcgctacaacacctacaccacacacgtgtatcacacacacggccgctctgctgtgaaatattcgcacgcgcggcgccccactacacaggcggagtgtctcgcacgcgctctcactcgcgcgcacacacacgggcgctcgggcagtgtccgctgcccacagtccgggcgcacacacaatgtttggctccaccacattccacgctctctatgggggacaagaccccccgccacctgaacgaccacgctggaagttaggcggggagaagataagcaccacatgctggctcttccccacgccaccaggaaagcttcgaggggaatgtacaaaaaacggggtatacctcccccacaaaaaaagatctccacaacaggaggggccaacaagaaaacgccccaacaataga

SEQ ID NO: 596582 - DNA, 1176 bp, Homo sapiens
  misc_feature (246)..(246): n is a, c, g, or t
agcggattgggcgacgacagcgagggcgatttatacttgggtgaatgcctctccagattctgaggtgcctgctcagtcataggtgcaggccattggctgaatcgctacggtgaacgccacgtgtctcgctagccttccctgatacccgagttcactctcagttcacgaatggatacgttctgctggtcctcccttacagttccagatacacgtttctgcacacgaagggacctggaagagctctgnagcaagctgatgaatcgcttctcccatgcatgaactgcactggaaggatgcgactgtaaggaaagttggccgtcccacaattagtcgcacgggtacgctcagaacgcttcggtcctggggaagagaatcgaataccgagaagaatcgggcgcttccatgatcgtaatcgttgacgtggacgtcaccaccattaagcgtttccatttgctcgattccgcccgagcaaacgttattgccagttgacagtttggctcctgagtaccttcttaatctatgctatggtcacttgctctgccattggtcccgcctctcaaaacgccccaaggcgacagacacaggatgaagggcctaatcttagcaaaatcggcccctggctggtggcgcagaagtcttccgaagactacggccgaaccgttttctcaattacaggatttattcactctgtgacaggtcaagcttaattagttgctcccggaacacacttaattggagcgcccctaattagcttgaggcaccatggcggcttaattcttaaatctaattcaacatttcattccttagggcggggaaggcctatctgtgactaggagggcttcaacacagtttggcctatctgccggaactctcctttaaccgccgttgcgcaatatgtccctttaaccgtgggagaaggttctcaaggaagaatttcctccttgtggagaggataggcgaagaattagcgatcccaaatttccgttcacataattttctctttagacagttattggaatatagtcttttgcgcaaacccaaaaagggtatacatattttcacccttgggaagtttggcaatcccacggcacacaggaactttcgtaacaccagaatataatcccaacatatatattcgttttcttataacagcatatatttgtaatcttcaataac

SEQ ID NO: 596583 - DNA, 1412 bp, Homo sapiens
  misc_feature (922)..(926): n is a, c, g, or t
  misc_feature (1313)..(1313): n is a, c, g, or t
cacccttggactcgatacaggcggctgctgcttttctcctggcccctcttggattttccggatttttgaaagacccagtggcccaggagcaagaggaggaaggaggaaggggcagatctgcagaggaatgtgagagcctcccaaagcgagagccgccgaaaagaatctgggagccagagggacagccgagccctgcccgggtttctggaatggtggtttcagagtgagtctcttctattttagaacgtagtaccagtggaaagtgtcgaatttttcccctcgcagggcagatttctccaggtcacttgacttttcttctgggagtaggagttaggagagattcccctctaagcccccagaggctgctaagggaggaggagactgtggacatgagccctccctgctcacaagcatatgcccggagacctgatagggcagtttctgggccatggacattgctttgaagacgggcggagactggacagcatctgtaggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctnnnnntgtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaagccnatccccacccatttgcctgctctgtggaggaccccacaaaacagaccaaattcaagggcatcaaaagctacatctcctacaagctcacaccccatccta

SEQ ID NO: 596584 - DNA, 275 bp, Homo sapiens
ccctgctggtcccgtggtgagggctggggcgagggacggcgatgtgtcacaggcaaatagctgaaggaccgagaggccctgatggaggctatagacttccggagactgcggaacctccgctcgccagggggtggcttcttggggcttgcaggtttggacaaggcctgagggccaggcttagcaggggaaggagggacactccttgtggctccagagcattgggtgtggcggaatcccccaaagacaatttatggagacctggaggagcggtgtct

SEQ ID NO: 596585 - DNA, 154 bp, Homo sapiens
  misc_feature (136)..(137): n is a, c, g, or t
actgcaactctgtgcccctacagcagaaacaatagtcaggaggttgagaacaggctggttaacatggtgaaatgccatctctattaaaaatacaaaaattagctaggtatggtcgcacgacacctgttaatcccanngctccttgggacggctg

SEQ ID NO: 596586 - DNA, 544 bp, Homo sapiens
ttctcagccatctacacacacggtactgaacttcgttgcttgatgattcagggaaaagaatctgagtgtcggagaggactttagttgtcttccaaggatctatgggatcaatttaagaaaaaaaaaagaagaacctttcaatgagaaataaccacaagtggaaggtcaatggaccacaaaataccagctccattcctgataaaagtcttgggagaatgtattttatatcgtgtagacaaattttatttactaaggaatgtttcctctctacaatgggatcatcccagtcacgggcacaactgagcacggcctctttaaaggctgggcagaaagcagactactgtcagcacacaggtctcaagtgaggacagaacatgggactgggctgaatgagtagcaaatggagggcaggagagaggccaagagcttaagtcagggaagtccctccacaggggaataggaagaatggaggctgagtgtcccccttacaatataggtacatgtccccctgtgttaccctttctaacatccctactgtgtagtt

SEQ ID NO: 596587 - DNA, 305 bp, Homo sapiens
gaggtgttctagaggatcccatgcgcgacgcttccatcactgaacagaagtaccatactaatgcaagatattaataagtagggaaacggaaaggtagagaagggatataagaactctgtactatgtgctcatgttttctgtaaatgtaaaacttctctaaaaaatctgtctggaaaaaaaaaacaaaaggcaaatgagtggcggccgggagcggatgggggataggggaacacgagcggagtcggaggggagaaaggtgggggggtgatgaatatgtccactatctggagggaagcgtcgcgcat

SEQ ID NO: 596588 - DNA, 931 bp, Homo sapiens
tgcgtaccaccatgcccagctaattttgtatttttagtagagacggggtttcaccatgttgaccaggctggtgttgaactcctggcctcgtgatccatgtgcgtcggcctcccaaagtgctgggattacaggcctgagccaccgcacccggccttccttacacattttctatgtcagatgatcatgtcgtctacaaataatgtgtttcttcctttgcaatctgtgtatcttcattttttcttgcccaattccactgactagtttttccacatgtgagatcgcactcaggagtggtgtgagtaggcatcctcttgctcatgatcttagggcgaaagccatttggtctttcttcatgtagtatagatcagcatcgaggacactctacttatatttttagcttcggctacgaattcatcacttactgcacctcgatactgaattcgtcagtactctctacaatctgttaagatgataacagcagtacgccctcttccttagttccctggaccatacattctggtgatctccaccactgtcggaacaaccttgccatctcctgggatacctcacatcgggctgctgatgtgcttatcctttgtggctacgttgctggattgccattcaccaaggctcgtgaccgatcccgtgcccagcgcatgcagcatcatgccataccctccctgccccccaccccgcgcgccaccgagacagcactcaccagcttcacgagcagacggcatccatagcctcccgaaaacaccccggcccacgccacgaccacaatcgacgcacacatacagcccgcacaatgcctacgccaccaacaccaaccgacacaccacctgacccgccggctcgaagcacacgctcacgaccacatcacagacccacgcaggcgtcggacgagacgccctaccgcgcgcccgccccc

SEQ ID NO: 596589 - DNA, 412 bp, Homo sapiens
ctggttagcatgcatgggcaccatctctactggggtctctctgactgtcacaatgttgagtcctgccgggaagcactactagcatccatcagtggggtcatggctgtacagcttcatatgctcggtacactctcatataggaaagaactggttcatcggccacccaactttctaaatatctcgcaggcagtcatgttccgttctccggggcagaccttaagtctgcatttccggatcatggcttgatcacgaccgttacgaagggttcagcatgtctcctatcacgtcttacgcttcacgtgcggagcgtcggtagcgcggatcgcaggtgcagtcgacagatactggtccgtcttgtctctgcaagtcttcggcacatgttgtcactgctaccgcacacggtgcgcctaac

SEQ ID NO: 596590 - DNA, 252 bp, Homo sapiens
gtcaaatgtcttccacaatcatgatgagcgttgtgtactatggttcgatattgtagacaggtcatatacaatgccactggtagatgatccattgcgagcatatctttcatataagaatctacagttatatatggtagcaccgtattctacacatgtcctagagatacatagatgagcataggagtatccaactgcacgctcatggtccgagatcctgctcttaaagtataagtgtatgacgttacgagcctg

SEQ ID NO: 596591 - DNA, 426 bp, Homo sapiens
  misc_feature (426)..(426): n is a, c, g, or t
cacgagggcgcagcttcttcgcggtgccgcgcttctgcaggctgcgcaggctggccgcctgcgccttgctgcggccttcggccagcgcttcggcgaaattggcgaacagcacggtgaaccacagccacagcgcgttggcgccgatgaaccaggccggcgcctcgccctgaccggccagcgcctgcagccacagcgcgctgatcagcacggcgcacagccagaccacgaacatgaccggattgcgccattgcgcggccggattgagcttgatgaaggcatcgcgcaccgcgccgcgcagcagcgcgggatcaagcagaccggcagtcgggcgcgaagggtgaagggcgttcgtcatgatcctgaaaacctcagcgatacaggttgatctgctcgaccaccgggccgagcgccagcgcgggcaggtan

SEQ ID NO: 596592 - DNA, 706 bp, Homo sapiens
caggtctaaaactagcaaagcctgcattaaaaatttcggttggggcgatactcggagtcagaacccaagctccgagcagatacatgctaagaaattcagcagtcaaagcgaactactatactcaattgatccaataacttgaccagcggaacgagtataccctagggataacatggcgcaatcctatgctagagtccatatcaaccatagggtatacgacctcgatgttggatcaagacatcccgatggtgcatgcgctattaaaggttcgttcgttcaacgattaaagtcctacgttgatctgagttcagaccggagtactccaggtcggtctctatctacttcaaattcctccactgtacgaggaggacaaggagaaataacggcctaccttcacaaaggcgccttcccccgtagaatgatatcatctcaacttagcattatacccacacccacccaagaacagggttcgtgaagatggcagaagccccggtaatcgtgatacgaacttcataaattttaccagtccgaatgttcaattcctcttcttaacaaatatccatggccgaactcctcattcctcatatgtgccattctaatcgcaatggggttcctaatgcttaccgaacgaaaaattgtaggctatgtacgaatagcaaaggcccacgttgtggccctagggtaataaaaccttcgtgaagcctaa

SEQ ID NO: 596593 - DNA, 338 bp, Homo sapiens
tgatatgtgccctaaggcatatacatctctacgaggtgtacagaggaaggccctgaggaccgggctggagtccgtgtgggtagacaagctcctggaggtgagtcggcaacctctccgccccgagtggcagatgtgccctctggaggtacatggtccctggtattagggtgcttggctgccttctcccggcctccccaagagttccaagcacaggacacccagacttccgggtgaagccacggaacctgtaaaccccaggagagaatcacttgggcaagtgccacctgggctttccgttgtcaccctggctcccatccagcgccctgattgctcatctt

SEQ ID NO: 596594 - DNA, 310 bp, Homo sapiens
tttccagagacaattaggaaaactggtctatgtgggctcttttaaaaaatacattataaaagtgcagtgttttcatgcaattgccccgtgttctaccaaccgtaagcattgggaagggtgcccactacctgtcgctgagacctcaccagcagggaacacacacaggaccaggggctttgtgaatacttgtggaatggatgaacaaatgaattgacgggtggatgagtacaaacatgtcagagtacaaacatacaggcaaaaatcaagcatggaaaattagaaacatattatgtgaacaatccactctgca

SEQ ID NO: 596595 - DNA, 145 bp, Homo sapiens
caaactggcctgtgccttatcttctggtggagtgaaaaaatttgagccagtaaagccaaatcgtaacttacagcaagcagcatgccgcataccttgctctatgctagattagcaattgtgccttaaaaacgtgacatttggaata

SEQ ID NO: 596596 - DNA, 101 bp, Homo sapiens
tccccttaaaaacattatgccagtgaaataagggccgtcacagcgctatatactgcacaattccacttatataggtgtctaaaatagttcaactcataaaa

SEQ ID NO: 596597 - DNA, 157 bp, Homo sapiens
tcataggcaatacttaaagtcttagagtcagtttcatctgttgtttctgctagctctcatttataatttctttcattgtatttttaataatttttctttcttttcgtcttctcttcattttttatttttttttatatttttggaaaatatatgggcc

SEQ ID NO: 596598 - DNA, 522 bp, Homo sapiens
  misc_feature (21)..(21): n is a, c, g, or t
  misc_feature (327)..(327): n is a, c, g, or t
  misc_feature (416)..(416): n is a, c, g, or t
  misc_feature (472)..(472): n is a, c, g, or t
  misc_feature (512)..(512): n is a, c, g, or t
agagtttgaggccagctgcanaccatggtgaaactccatctctactaaaactataaaaattaggctgggattacaggcatgagcaccgtgccctgccctttattactatttttttagagacagggtctcactctgttgcccaagctggagtgcagtggcagattcatagttcactgcatcctcgacttcctggggctcaagcaatcctcctgcctccttccccagtagctgggactacaggtgtacaccaccatgcccagataatttttttgtttattttttgtagagatggggtctcgccatgttgcccagggtggcattagcatnattttaagtgctcattgggccacatgtgatgtgacagcacagatataggaatatttccatcatcacagaaagtttttggaaatagtggntcttctgtaggtaaggttttctatagggggagattgtatttttgactcttgagtanttctttgaaattaatgggaccatttgggtggctggttttncataaattca

SEQ ID NO: 596599 - DNA, 191 bp, Homo sapiens
gcggaccggtaaggtagctgtactggggcgtcactccaggccgtactcatactacaggatatttactattacgcccaggatcagcagaagatagcgtagctctcaaatgtgtgttcctgctatttctaatgaatattttaaattcattcaacaagcacctagtaggtgcctgctgttatccctacattaca

SEQ ID NO: 596600 - DNA, 364 bp, Homo sapiens
gggcattattttgagcatttattttggggggaggtttaaaaaaactttaacatcaaatcaaatggtaaattaatttaaaaaaattgccttaaggccctactaaagaatgggcccccagcctttaagtgatagttgcaaaatcctggtttaaaaaaaaaaaaaaagttggcttaaacattttctttaacaggggtctttttttttcaaaaaccggtctttttctggctttttttccccggcaattgaggaaggattttgccttccctactcactgagaagtattgacttggggggacacattttaaagcatttttgatttgaaaattttgggacatttttatcaattattaacccttttttttta

SEQ ID NO: 596601 - DNA, 124 bp, Homo sapiens
tggcagaaacgttcgtcatatccagacgggtggtggtcgggcagagacactcctcagttcccagactggggttgcggctggggagaggtgctcaccaatctcagacgatgggcggctgggcaga

SEQ ID NO: 596602 - DNA, 226 bp, Homo sapiens
  misc_feature (16)..(16): n is a, c, g, or t
cctctccagtgacatntggaacgatgctactgttttaagttggccgctgtacacgtttggcttatgttataatattcattattgaacacttacaggtcgttgaatggcttaaaatgtacggcctccagttcattttcatggtatctttcgtgagtgtgcatgacagtctcatttcgcagctgtattaatatgtaacgttatttgaatgaaactcagaagcagtacg

SEQ ID NO: 596603 - DNA, 567 bp, Homo sapiens
gatttgcatttctctgatgatcagtgaagttaagcatctttttatatgcctgttgagatttaaatgtcttattttataaaatgtctgttctgggctgggtgtggtggctcacgcatgtaatcccagcacttggagaggctgaggtgggtgtatcgtctggggtcaggtgttcaagaccagcctggacaatatggtgaaaccccgtctctactaaaggtgcaaagattggctgggcatggtggtgggcgcctgtagtcccaactactcgggagtctgaggcagagaattgcttgagcccgggaggcggaagttgcagtgggctgagaccgcactactgtactccggcctgagcgacacggcgggactccgtctcagcaaaagaaaaaaaagtaaggaggctgtatcaatggatctactatatatgctttttgtaaaataaggatcatagtttcacctttcttatactattatggtgagagtaaatcaatgaaagtcatttagaacagtgtgtggggtaaatgtaaggacacaataaatgtcaacctattatttcaaaaaaaaaaaggg

SEQ ID NO: 596604 - DNA, 649 bp, Homo sapiens
cctgacacacggttgggctggggctcatcagtggtggtggagaaccgacaccccaaggcctacctgcacctgtgcattgtgtgactgcaccgacatgcttcaacgtgtgtgtccacacgcggcagcctgctgtacccaagtgactacgctgtgccaccccatgcacatggcatgtgtcctgtgtgatcttgtcccatgctagaaggtgcaactgcctgggcttctctatcacccacctgcctgtgcacatctgcaatggcattgcccatgtgcctatcctacagtgacttggacatgcctccaatgtggtgacccacatgtcccccccacttcactgccatgacgtgtctgcctgtgtcttgccattgtgtgccccagacctgacatgtgacacacacaattgcactagtgtgtggcatggtggtggcttgatagacagcaagaaactagtggactcacgaacccaactcacacgcaaacacactgacacacttcttcagttagattgggtgcagcaaccccccacaagccacgacgtgaccggcagaatgcaatacacatcgaaaattcatcaagtagagccacctagacccacattggaaagcttgaacaagacccaaaggtaggagtcaatccattcaccattaga

SEQ ID NO: 596605 - DNA, 172 bp, Homo sapiens
gaatgagcagcaaaacaacattccatggtgcacgaccagagggcatgtgggctggtcccaagtccagtgtgtcaatgtgctcttactgagccctgctgaagagcaggttctctcgtgtggaaaggatgtgcgacagatgtgctggaggcagtgtcactatgcatgccacatg

SEQ ID NO: 596606 - DNA, 443 bp, Homo sapiens
  misc_feature (113)..(113): n is a, c, g, or t
  misc_feature (158)..(158): n is a, c, g, or t
  misc_feature (245)..(245): n is a, c, g, or t
  misc_feature (375)..(375): n is a, c, g, or t
gggcgcggtggctcatgctgttatcccagcactttgggaggctgagacgggcagatcacctgaggtcaggagttcgagaccagccaggccaacatggtgggaccctgtcctanctaaaaatacaaaaattaggcaggcgtggtggcgggtgcctgtgnccaagctactcaggaggctgagacaggagaatcacttgaacccatgaggcagaggttgcagtgagccgagatcgtgccattgcactnccagcctggggtgacagagtatcttgatctcaaaaaaataaataaataacaaatttaaaaaacatattctattattaaaataaaatttttagttttcactttttaattttatttttattttttacatttnacatttctccttatttttgggtttggcagagtgttcttggttagggtcttacctggattttttttttt

SEQ ID NO: 596607 - DNA, 408 bp, Homo sapiens
  misc_feature (35)..(35): n is a, c, g, or t
  misc_feature (48)..(48): n is a, c, g, or t
  misc_feature (51)..(51): n is a, c, g, or t
  misc_feature (87)..(87): n is a, c, g, or t
  misc_feature (100)..(100): n is a, c, g, or t
  misc_feature (112)..(112): n is a, c, g, or t
  misc_feature (130)..(130): n is a, c, g, or t
  misc_feature (175)..(175): n is a, c, g, or t
aaaacagcctgagatgggatgggctggcgggggtntgcgcattgccanagntgagctgcggccagaggaccaaccccaccgtgggtntccctttcactgntggccaccgctntgcctgtttgcccgcccncaaactgggggtgattatggcaactccctcttacctagtgtttgncctatcctgagcctggtgtgttaaacaaaggctgagtccacctggtgggtgggaggtgggagcacgggagtgacaggggctcactccggttgccctggggcacacaggaagggaagagtgaggccaggctagtggcctaacaccagcaggtctcacctcagagcacacacaaatcctggtgtgccaagagagatttaaatatttaaataaaaaattttaattcctatgcaaaa

SEQ ID NO: 596608 - DNA, 420 bp, Homo sapiens
ggaaacaggactcgctatacacaggtgccaccatagtgtgcttagatgatgacagctagcatcttatttgcgttcaacataagtcatccacataacacaatatagatgagaaaagatgggcaggtgtggtgggctcatgccgctaatccttgtactcttgggaggccgagacagacggcatagtgagccgaagacaccgacaccatcatgtccaaactgtttcccggctgtctctactaaaaatacaaaaattagccaggcgtggtggtgtgggcctgtagtcccagctactcaggaggctgaggcaagagaatcgcttgaacccggaaggcagagattgcagtcagccaagatcatgccactacactccagcctgggtgacggagtgagactctatctcaaaaaaataaaaattaaaaa

SEQ ID NO: 596609 - DNA, 363 bp, Homo sapiens
  misc_feature (6)..(6): n is a, c, g, or t
  misc_feature (19)..(19): n is a, c, g, or t
  misc_feature (94)..(94): n is a, c, g, or t
  misc_feature (101)..(101): n is a, c, g, or t
cccccnaaacccttcctcngggggcaaaaatatttttattagtatggctaagctccttatttcccatttttcaataattaacatttcaactggntcatacnaaagcaatgggtggcccacactgttttctccctcagtactaaactgtactagtagtgttgaattctttactgccaccctattgcctaagtaaaattataattattcccagttgcacttaagaataatattggtgaagcagtacttattaattatattaaatttcaaacttcgatagctaatgtgataaagtgagaagtacaatagagttctagtgcctcataggtgactagaggcactatgtaaggtcaatggtgactttaa

SEQ ID NO: 596610 - DNA, 511 bp, Homo sapiens
  misc_feature (28)..(28): n is a, c, g, or t
  misc_feature (35)..(35): n is a, c, g, or t
  misc_feature (56)..(56): n is a, c, g, or t
  misc_feature (70)..(70): n is a, c, g, or t
ggaaaaacctcaactcttgaactgtagnctccctnacctttcaaggcctatcaaanggtgaaacacacantccccaccatgaagcaaaaccctatcagggcaaaaagcagcttcccttgccttattaccctttcctaggttcaatgtcccccttcagtttgaccctgatcattaagttgttgtagttcctctgggtctttaaagatagttttaatggcccaggcatggtggcttatgtctgtaatcccaacactttgggaggccaagacagcaggatcacttgaggtcaggagtttgagaccagcctcgcccaacatggtgaaacactgagtctattaaaaacaatacaaacattagtcaggcatgctggtgtgcacctgtaatcccagctaccctggaggctaaggtgggagaattgcttggacctgggaggtggaggctgcagtgagccgagatcatgccactgcactccagactgtgtgacagcgcaagactctatatcgaaaaaaaa

SEQ ID NO: 596611 - DNA, 319 bp, Homo sapiens
gctctttgtctgagcgcgctcggcttttatttttttttctctctccttccctgcagcaggggccggtgtccagctgcctactttctgcccggatctctggctcctcattctctccgggtctccggcaagactaaaggccctcggggattatcgcaggcagccatggcctgtgtgtgcacactgctggaggccccgggagcccctgtccggccccgcgcctctactttggccgcctggcgggaccagggggtccctgggactacctggctaaccgggaggtgccggcgcagagatggtgtggagacgcccgggaaaccca

SEQ ID NO: 596612 - DNA, 326 bp, Homo sapiens
  misc_feature (48)..(49): n is a, c, g, or t
accagcgcagacgatgggggcagaaagagcgggacaacgcacatttcnngtgctgcagataaagggggagccgagaaggctctcagctcctgggaggtgccaaggagcctccgtaggcactggggggagggagacgaaagaaggagcctcggacagtggcctggagtgcccctgggcccctgtttaggtttcaagggggtgccgtgggcatccccatactgccccccacatacagcccgaatcccccctcctcgaaggatacagcttgaccacgtctgtgtccatccgcctcttgcccggactaggggatgacatcgtctgccgct

SEQ ID NO: 596613 - DNA, 341 bp, Homo sapiens
caagaggctccccggtttaagccgagagacgagaggacattccacatcattatactacatgatcgctggagccaaggagacagatgagaagtgacttgcttttcggagggcttcaacaactacaccttcctctccaatggctttgtgcccatcccacgcagcccaggtatgactgacgatgttccagagaaaccgctggtaggccatggacaatcatggagtttcaagcgacggacggacgcagactagtccactatatgaatggatggtactcagtcggctcctgacagccttgtgaatatatcgatcgttcaacgaagcgaacagaaaccacaggacca

SEQ ID NO: 596614 - DNA, 574 bp, Homo sapiens
  misc_feature (488)..(488): n is a, c, g, or t
  misc_feature (525)..(525): n is a, c, g, or t
ctgggtacccacgcagcgagtcaagggagttttcggagccagagagagaaagatgtgaaggctgtggagtaaggctgaaaccagcctcctgccctatagtcccacactgcagggggtgcgactttaaaacagaacttcaagttgttaacactcacaagcattgcattactgtgaaggaagtagccgcatccataacaggatgtgatggtctacagcttttcctttaaaagctgaaaaggtaccatgtgtgctcgctaggcatataatccagatatgctccagagttctgagattcttccatgaaaggttaactagaagctagaatatttttttatatttttgtaacaattggcttttttcatgggggggaggggagtagagggttagtatttatagtcctaacaagtccaaaaatttttataagtgtcttcagattataaataaccctccaaattttgcaatgtttacatgttttttttttaagatgncaatatgcttgatttgctttttaaataaagtttagcngttctaagagattacttccagtaggatggctggttatgatagttggatt

SEQ ID NO: 596615 - DNA, 430 bp, Homo sapiens
  misc_feature (344)..(344): n is a, c, g, or t
  misc_feature (401)..(401): n is a, c, g, or t
  misc_feature (419)..(424): n is a, c, g, or t
aacacgacttaaaagtggcttcagaggaaaagcaagaaacgcttgaaagaagtgaaaataaacagccagaggtgtcaaagcccacagaatgtagaacacccagagtgaaccctaatgtgaacatggacttcggatgatgatgtcggttcatcgaaacacccagagtgaaccctaatgtgaacatggacttcggatgatgatgtcggttcattgaaaacacccagagtgaaccctaatgtgaacatggactttggatgatgatgtgggttcatcgattgtaccaaaaatgcctctgtggtacaggatgctgacggtgcggaaggccacgagtgtgtggagcaggngtatatgggaactctctgtaccttccacttaaatttgttgtgaacctaaaattgctntaaaaaataaagtctatnnnnnntaataa

SEQ ID NO: 596616 - DNA, 202 bp, Homo sapiens
ggctctttttctctgatcgctctcattcgcatgagtatggttctataatccagcagcttctctaagaggctgctgaccaggagtgcgaatactacccagagctggagaggtatatgtgtatccggcaatgttctaggcgcagtttttccagaagaaccttgtattgtacgtctcctctgcccccttctacctcctggtccaa

SEQ ID NO: 596617 - DNA, 519 bp, Homo sapiens
  misc_feature (433)..(433): n is a, c, g, or t
  misc_feature (490)..(490): n is a, c, g, or t
  misc_feature (508)..(513): n is a, c, g, or t
tgaggaccctgagggcagaggtgaggtcccgccttcccacgctgtcagcaggcgtcacatcacggtggaaactagctgaagaccctgagggcagagatgaagtcccgccttcccacgctgtcagcaggcgtcacagtggaacagtgatgctttcagacatgtgtcaaagcccacagaatgtagaacacccagagtgaaccctaatgtgaacatggacttcggatgatgatgtcggttcatcgaaacacccagagtgaaccctaatgtgaacatggacttcggatgatgatgtcggttcattgaaaacacccagagtgaaccctaatgtgaacatggactttggatgatgatgtgggttcatcgattgtaccaaaaatgcctctgtggtacaggatgctgacggtgcggaaggccacgagtgtgtggagcaggngtatatgggaactctctgtaccttccacttaaatttgttgtgaacctaaaattgctntaaaaaataaagtctatnnnnnntaataa

SEQ ID NO: 596618 - DNA, 152 bp, Homo sapiens
ctgctcctgctgacttctccagcggggtctatctcacactgaggacaactgggtgctgtaccaaccagaggcagctccatgtcctccgcgtcggcatcatacccagtgccacacaacaaaaattggctgcaaccatcccctatcaggacccg

SEQ ID NO: 596619 - DNA, 633 bp, Homo sapiens
ggtctatcacgtgggtcatatataattagaaatgtcccctcacagcagatcaaatgtaaatgcttccagttaaggagctaaattgaggtcctcagctgcatgaggaacgcctgtacatccccttgcacaggcctattctaaatcgcttaaactatgctgatagctgcttaggttcttgagtagtactgctcttaaacgtagggaggccctgagaactaaattttgccccaaaataaaaacagaatttatgagattgcctcctgtcatttgggttcacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacattattctggggagaaggttcaagagattcatacagattgtcacactccttgaaggttcagatactctgcaggaaacggggaagaaaaccctcccattaggaagcatgctttggcagtttaatagcgatggtgccggtgatagggacttcaagaggtaaatgcaccttgtattgcataagaagcattcctaatcaataaatca

SEQ ID NO: 596620 - DNA, 871 bp, Homo sapiens
gggtctaacatttaccaccatcacggcttctattcccactctttctggcctaaccccttaaacgtgtactcacaaccttgccgtacaacacaccacgtactgttgccatacaccggccatacagtcccactgccctcgagaatgtatcacaaaacctcaccaccaagggcggaaaaaaccccttgatatttcgggacccccctaaccaatgttcctgttattgaaaaaaaccccctcagagggggaccccctgtcccaaaccccatgtgatagtatactttttggcacgatgggacgtgatacatttcggggccgcacacactctaggaaaccttggaatatctattaatcatgcaccaagacctttttaagttaaaattcggaccaaatatatcccccactatcaagtttcttcgtgtaattcgtctccgcgccccccatatgtcgtgttacttcccgtggcaccaaaatctctcgaacatggaatatcactactcctaataaatatttggacaccccctgtctatcacacggtgcactgcttggcgaccgcaaccccgttggtccaccacccccttggggaagactcgcagtgttcatcctttcccgtgttgcttctgatggtctatatccccccttgtccacagcttccgggatccctcgtgtgtctccttgatgcaaatccccatttgatcatgtcatctgctggtgatacgcgtcgctgactagacgccgcgagttcttggggacgtggggccagaggctctcgctgtcgaagcctacgggggcgaggggtcctccgggagcccggcggttgcgccccaccccccccccccggggccaccccaacttccttttctcacaaaaacaa

SEQ ID NO: 596621 - DNA, 383 bp, Homo sapiens
cccccccccccctaaattcaaaatctttttgtttttttttagacggagtctccctctgtcccccaggttggagtgtactggggcgatttcggctccctgcaagctccccctcccaggttcctgccattttcctgccccagcctcccaagtagctggggctacaggcccccccccccatgcccggcccattttttgtattttttagtaaaaaagggggttcccccggttaaccaggatggttttcaaatttcctgacctcgtgatccccccctttttgccccctaaaggactgggattacaggggtgagcccccgggcccccccctaaattgaatttttaaatcccccttgttcataaacccgtatatttggtttcccggccca

SEQ ID NO: 596622 - DNA, 654 bp, Homo sapiens
taaagtccaattactttctgtattttggggatgggtgttaattgctattaaaaaaacttgtttttgaaaaaactaaataatcaatgcctggcagctcaagtgaatatggtagtggcattccccgtggggaatggaagaggtggattcccaacatttgcgtgctctgcaaagtgcccgtgccaaaaggggaaagtcgcagcccggcagccctttcgacagatagccaacaggtggattccagtggtcagcaagggctcagtttccattacccgctactccgtgtactgcagcagaatgaagcaaagcacatctgttctctgctgacttctggcatttggtgggcacgggcagcttccaacagggctgcatccttgtgggacggactcttgctgtagcaattgaaccaccagcgctgcggccaggcgcacattgcccagtccggccctgctggggaccccgtctccacctgtcctgtccttgggagtgtttcttcgggcccaggagggcgtccccaattggagccgcgaggcattgggtatcgaagcgtcctccctggcgccccccggtggttgccccacgtccggagaacaaggccgcgattttccaggcgcccccccggtggttaccctcagccatgcggttcccgagactcca

SEQ ID NO: 596623 - DNA, 244 bp, Homo sapiens
gggtcatacggactgtgttcaggggacgggggccgacgccgtcacccccgacatatgggcaggtcagtcggccatagcgttgtcggcaccaggacgacgcccgatgtcgatacccagaccagaccgggtgtcttcctcagagccgcgcaagtcgatctcttggccctccgagttgagcacctgcacattcaggcagagtgacttcatctccttgacgagcaccttgaaggattcaggaataccc

SEQ ID NO: 596624 - DNA, 204 bp, Homo sapiens
cgtgtttctgtggtttttaaattcaaaataccgcgttccactactctcagttgtattttttttttcttgtccaaggatgatttttgtttaataacatgcagccgcccgatgaaagatatcttctatttaggggcgattggccttatgaccgagcctcctctattgcctaagtcctatcgcacacctatcttaatattcataact

SEQ ID NO: 596625 - DNA, 432 bp, Homo sapiens
gttggtgtacatgtatatgtatgttgagcgtgtgtctgtgtgtatctatgtgttaagcatttctgacatgtctgtgtgtgtacacatacttgtgtgtctgagcaattctctgtgcgtgtatctgtatgtgtttaagcatttctgcgtgtgtgtgtacacatatttgtgtgtgtgagagcagttctgtgtgtgtgtgagtgtatctgtgtgtgttcgagccttactgtgtgtgcacatgtgtcgtatgtgtctgttttacgtgtctatctgtacatgcacacatgtttcagctgaaaagagtgcggagggctaaaggtgactgtgacaatgagtgtgtactaggagagctgtgtgtgggacgctgcgtgcggctgctgcaaagtaggtgtgacagagtgtgggtgtgctcgtgagcctgcgtgtagagcgtgc

SEQ ID NO: 596626 - DNA, 479 bp, Homo sapiens
  misc_feature (1)..(1): n is a, c, g, or t
  misc_feature (14)..(14): n is a, c, g, or t
  misc_feature (39)..(39): n is a, c, g, or t
  misc_feature (50)..(50): n is a, c, g, or t
  misc_feature (54)..(54): n is a, c, g, or t
  misc_feature (60)..(60): n is a, c, g, or t
  misc_feature (63)..(63): n is a, c, g, or t
  misc_feature (65)..(65): n is a, c, g, or t
  misc_feature (69)..(69): n is a, c, g, or t
  misc_feature (80)..(80): n is a, c, g, or t
  misc_feature (102)..(102): n is a, c, g, or t
  misc_feature (114)..(114): n is a, c, g, or t
  misc_feature (136)..(136): n is a, c, g, or t
  misc_feature (164)..(164): n is a, c, g, or t
  misc_feature (193)..(193): n is a, c, g, or t
  misc_feature (203)..(203): n is a, c, g, or t
  misc_feature (214)..(214): n is a, c, g, or t
  misc_feature (217)..(217): n is a, c, g, or t
  misc_feature (243)..(243): n is a, c, g, or t
  misc_feature (246)..(246): n is a, c, g, or t
  misc_feature (248)..(248): n is a, c, g, or t
  misc_feature (255)..(255): n is a, c, g, or t
  misc_feature (257)..(257): n is a, c, g, or t
  misc_feature (275)..(275): n is a, c, g, or t
  misc_feature (280)..(280): n is a, c, g, or t
  misc_feature (282)..(282): n is a, c, g, or t
  misc_feature (289)..(289): n is a, c, g, or t
  misc_feature (302)..(302): n is a, c, g, or t
  misc_feature (320)..(320): n is a, c, g, or t
  misc_feature (343)..(343): n is a, c, g, or t
  misc_feature (348)..(348): n is a, c, g, or t
  misc_feature (362)..(362): n is a, c, g, or t
  misc_feature (366)..(366): n is a, c, g, or t
  misc_feature (476)..(476): n is a, c, g, or t
nccacacacaaggntttagcagcccttttacttccacanccaaacccccngggnccccanaanancccngtgagggaggnaggggaggaaggtttcagaganccccatttaaanaagaggatgccgaggcacaaanaggggaagtgacttgtccaagggcaaanaaccagcagtgtagagggcccaaagccanccttcccccncttgaaccccngcnccccggccccctggcagtccccacanccncnctattcncnctgtgtcccccacccccncaacncncctgggnctgcagggacccnaaaggcagcctggcagcngagatttttcaggaatggcaacnggggnaggcctggtcaacnccanaaaggaactgaccctgaagagcatgaggccagctttgcttctccccatttcccagtgggatggaaggcctagtaggtcccagggcaaggatggagcaaggcatgatttangaa

SEQ ID NO: 596627 - DNA, 392 bp, Homo sapiens
gacgaggtggattactatgagaacaagatgtacctgactcccattgataaacatatgctcctcaaagtgatgggctttggtctctacctaatggatggaaatgtcagtaacatttacagactggatgccaataagagaattaatcttagcacaattgatcaattctttaagcagctgcaggtggtgccccttttcgtgcgacatgcaaatagagctggacagatacattaagacgagtgctcactatgaagagaacatgtccaagtggacgtgcacccagaacagcatcagcccccagtacaatatctgagagcagatggttcagatccggcatgatcacatccgcttcatctccgaactcgctcgctacatcaacagtgaggtggtgacgg

SEQ ID NO: 596628 - DNA, 408 bp, Homo sapiens
ctcgggtatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatgccagggcaacagaatgagacttggtttaccaaaaaaaaaggtgacttgattccgggaaaaaattgcctggctatatccagccagatatggcaaaaagtctcagggtgtcactgtgaatgatcagggcctgggggggggtgccccctatcagactacgggtgtacagaggcccaaaaaagggtgccgtaggttcctaaatgtgaattgatgagaagca

SEQ ID NO: 596629 - DNA, 1621 bp, Homo sapiens
  misc_feature (523)..(523): n is a, c, g, or t
  misc_feature (1579)..(1579): n is a, c, g, or t
attctttgtaagtgggttaccgacgggggaagtagatcccctaagctcgccagtggaacttgtgttagtgggccaacgacacgtatggacatgagtcgaacatgacatgcatcgtatttcactgagagctgacactggacagctcagtgtgctagctctatatttctcagcactattcatatgaataggatagttggaccagtgttacggtagagcccgattgtatccacaaactttcggcgacaaggaacatgtgtggattacatccgcttgaggcagctgggcctgttcgatgtcgcacagttatcatcattgagaagctgatacttgtggtcagaagctagctcattgggggaaatgagatagacaatctcaccaattggtgcagatgcagtttccacacgttgtgatcgaaaatacctgtatatgactgattttcgcgtgatgtacattcacattagcctcgcgtatagaaggcctttacaccatggaaattgagccgtatagaaagggatgacaaganggcccatagaagtgaaaacctacacaaagcctgagggccagacgatctcacaaatcccttggccaccccgtttcgcttgcggggcccttgcgagccaattgaaccgggtgccggactcgcccattggggttatctttgccctgtgcccattttacggtcgttggccattggccaaggagcccttgctatcggtcgatttctcttcggtgacgggcggagcgacgctttttgcacagggcggcactttttcccttttttggcccgtgggcccctgtttctcgggcccaagctgatttagatcggccttgtcgttggggcctttgccgcccttaactccagtgtgaaagccgcattttgtaactgggtccccaattcaggttatggccttcaaagaagttgtgtccattcgccgactactcggcacgccgcaaattgagttggtgacaccgtgtgtgttctttagtaccaatcaaagcttaaaggaaaatttgaggcaggcggcgtaccgcgcattggtaatataggcgggcccctaggatggccaaaacgttccagcgaatatcgggccttcgtgttaagcttatgcttctcataacacgggcacctaaaggtaaacggattggcgctagtaaagtgaccacttcccttgggtatgttccaatgctttttggccagaattacatcgccgaggttattagatttcgaggggattgccaagaactgaaacagtgggcgcccttgaggggtctcccctcaattctaccttcccgtttgttgtataacgtttaagctatgaggggcacattttacacacacaatggcatccgtgtcacatggcgctcacaaaagaacccccttttcgctttacttttgtcctttaagagaagggacatgggcacaaagggaaaccattacattccccaagtatttgatttgagggaacctttgccctcccgtaggagaatatgtgggaccattccaagggcgcaaaagctgagtgaaatatttgtcaagtataagccccatccaattaatgcctgtggtgggaagagagcnagcgcctctgtgcgcttgtgaacaaaggaacacatttccccc

SEQ ID NO: 596630 - DNA, 430 bp, Homo sapiens
ggccgggccaatttttgtattttcagtatagatggaattttgtcatgctagctaggctgttctcaaattcctgacctcaggtgatctgtcagccccagcctcccaaagtgttggcattgcaggcaacatggcaaaaccccgtctctacaaaaaatatgaccaattagccagctgtgccgccgcatctgcgctccctgctacttgccaggctgcggtgcctcgcctgagcccaggaggctgcggctgagtgccctccctccccccacctccaccctccctcacccccccacctcccctctccccatccccccttccccccctccccccccccccccccccctcccccacccccctcccactcccctccccccccccctccccacgctcccccttcccccccccccccccccccatcctcccccccctcccc

SEQ ID NO: 596631 - DNA, 172 bp, Homo sapiens
attctaggacatgcagagagtttcttcagtacgtaccactccaaatgtcaacaaaatttaatgcaacagaaacctaaatgtttgtacttcagcaacgaaatcattcaattggcaggcaaaacattttctattacatatttctaaaaacatgagaaagggaggaaaaaaaaaa

SEQ ID NO: 596632 - DNA, 651 bp, Homo sapiens
  misc_feature (125)..(125): n is a, c, g, or t
  misc_feature (269)..(269): n is a, c, g, or t
  misc_feature (467)..(469): n is a, c, g, or t
agagcggggtcgtctttaatggggaacgagcgcagaggggttgggggtctggggtctcccaacccccccctcttttgggcccaggggaaagggcaccattcctcccgggctttccccctgagggnggattctttagtccaaacacgggttaggggttggggccgagaccaaggcctgggatccaaggggttaaaataaggggctgggggggccctccaggggaggattagttaaccaggggccctctccccttccagtttcttgtgaangggaacagcaatcaaaatttgccccgcttggccctcatcaacaaaggggggggggtccccctgcccccccccccctaaatccccaggaaaaagggggtttgccccgtggggggggggcccccccccctgtccccccaaaaagggcagcccctgggggtccccggggaggttttcccccgggcccaatattccggtttnnncttggggcccaacaaaggggggttttccccctccccctaaaatttttgccccaaaaaggggggcccccctttccctttggccccgcccccccccaggggcgggggtttgtctttcccccctgggatccccccccttttttggggcccggggccttttctaaaaaaaaaaaggttttttttta

SEQ ID NO: 596633 - DNA, 302 bp, Homo sapiens
  misc_feature (57)..(57): n is a, c, g, or t
  misc_feature (77)..(77): n is a, c, g, or t
  misc_feature (79)..(79): n is a, c, g, or t
  misc_feature (158)..(158): n is a, c, g, or t
  misc_feature (191)..(191): n is a, c, g, or t
ctccaaaggaactggctgaggcagaagtcctcagatggaggaggctgggcacctgcntggttggagcacagcccttntnccaacctgcatgggactctaacatgagcagagtagcaagtggagtcaggaacttagggctggggagattggaggttgantagggaagtcatataggccttgttgagaaaatnagatttgagcactcttagaagtttaccagcagagatctggggaagagaagaggtagttttcagggtaggggtatacctgtaaatccagggaaagaagccagcatggccaga

SEQ ID NO: 596634 - DNA, 1112 bp, Homo sapiens
  misc_feature (49)..(50): n is a, c, g, or t
  misc_feature (52)..(52): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (331)..(331): n is a, c, g, or t
  misc_feature (357)..(357): n is a, c, g, or t
  misc_feature (366)..(366): n is a, c, g, or t
  misc_feature (396)..(396): n is a, c, g, or t
  misc_feature (398)..(399): n is a, c, g, or t
  misc_feature (430)..(431): n is a, c, g, or t
  misc_feature (436)..(436): n is a, c, g, or t
  misc_feature (445)..(446): n is a, c, g, or t
  misc_feature (469)..(469): n is a, c, g, or t
  misc_feature (471)..(471): n is a, c, g, or t
  misc_feature (474)..(474): n is a, c, g, or t
  misc_feature (483)..(483): n is a, c, g, or t
atttttgacatgtgaatggtgatagtctctggttctccccatccccacnnangcgtgggccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttcttttnttnttngggacntcggtttccactcttaggcttttaancaatagttnatggctttaatccctctcagattctaatancnngagagcgagggggctatatggaatctcggtnntgccntggagaacnngagctatgaagaggatcttattnanacnggcgggtcnggactttatgggattggacactggtccctttctttaattggtggaaaaaaaaaaaaacccctgaagtgtctgggaaacccctaaaggtcttgggggaatcctcaaaaagcggggagaggtcacaggtatttagctccttaacggtgggaagaccaatttctaggtatagaggtattaggaccttggggaatcgcgggccactggaatagaaggggccatatcgcgcacattacagtgttttggaacaggtccggcacctatggagccggaccggggttaactccatatagtggacccaaaacttttataccttgtgggcacagggaatggacccgtggtggttaaccacagggcgcaccaaccggtaccgggacgggatataaaccgctttgtgtacttgtgacaccacaagcttctactttaagttcggtgtgcccacgaatccccataggggggggggccagcatactacaataagagcaaaacatgtcggcgtccgaataaccatccatcaacaacccggctaacaatcagctgggcgccacatgtgggccgccacaaattatgctcgtgaggaggagaataatatcggagagtatgcatacacactacatcagagcgcagtatgt

SEQ ID NO: 596635 - DNA, 114 bp, Homo sapiens
gagacagtggatagtgttgagggcattgtgaggacagtggagagtgaggaggacagtgtggtggactgtgaaaactgttgagggcagtgtgggtgcagttgagagtgtggaggg

SEQ ID NO: 596636 - DNA, 706 bp, Homo sapiens
  misc_feature (49)..(50): n is a, c, g, or t
  misc_feature (52)..(52): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (331)..(331): n is a, c, g, or t
  misc_feature (357)..(357): n is a, c, g, or t
  misc_feature (366)..(366): n is a, c, g, or t
  misc_feature (396)..(396): n is a, c, g, or t
  misc_feature (398)..(399): n is a, c, g, or t
  misc_feature (430)..(431): n is a, c, g, or t
  misc_feature (436)..(436): n is a, c, g, or t
  misc_feature (445)..(446): n is a, c, g, or t
  misc_feature (469)..(469): n is a, c, g, or t
  misc_feature (471)..(471): n is a, c, g, or t
  misc_feature (474)..(474): n is a, c, g, or t
  misc_feature (483)..(483): n is a, c, g, or t
atttttgacatgtgaatggtgatagtctctggttctccccatccccacnnangcgtgggccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttcttttnttnttngggacntcggtttccactcttaggcttttaancaatagttnatggctttaatccctctcagattctaatancnngagagcgagggggctatatggaatctcggtnntgccntggagaacnngagctatgaagaggatcttattnanacnggcgggtcnggactttaaaaaaaaaaaaaagaaaaaaaaaaaaaaaaaaacacaagagaaataaaaaaagaaaaaagaaccgaacaaaacagaaagaccacaaacaagaaaatgaaaaatacaaaagaacaggggggaggatacacaaagacacaccagcccaggcacgcactcgacatagcaaagcacccatggacagaagccgaccgcctacgcaagaacgccataaaag

SEQ ID NO: 596637 - DNA, 503 bp, Homo sapiens
ggtggagacggtgtctcactattcgcccaagtgggtcttgaactcgtggggctcaagcagtcctccaagctggcctcccaaagtgctgagattacaggcaagagccaccaggccgggccttagatggttttgggagcgggagtggataaggtttccccatctaaggcaattctctgctatacagatgggggctctacgggcagtggtggtcctagggaggtagaatgcaaggcctgggatgcgccatgctattccagggttctctaccagggtctgcacggtgggtgacataaccacgcaacagaatcctgcatcaccatggacaatctagtactggacggaggccttggaaggctgggagggcaacacccacagaacactagtgctaggggctgaatactttggtgttcccggctctgccaaagtcatatgctcaaatccccatcccgggttacatgtgtatacgaaggtagaagcccggggaggggctccggtcatgaggg

SEQ ID NO: 596638 - DNA, 1033 bp, Homo sapiens
ggacgggtgggtcgagccacgcgtccgctttgtctattgagctggcatgccaagcggctggcatccatggccacgctgctggcccgaggcgtggctggtctcattgtctgtgaactggcgtgaggaggacttccgtggccggtctccccccctcgggatccacgctaccatgaggtccactacatcctgctggatccttcctgcagtggctcgggtatgccgagcagacaggtggaggagcccggggcaggcacactctagctccggtgcgtctgcatgcgcctggcagggttccatgcagctgagccctgttggcactgcactcacttgcccttgcctgtcgagcggcatcggtctactccacggtgctctctctgccaggaggagaatgaagacgtggtgccgagatgcgctggaggagaagccgggcgcttcagagctagctcccgacctgactgcctgggcccgatccgatgcctgagcactgttcgccggtgtgccgagtcactggcgtccgggacatcccactgatgaagcacattcagcaggtggttcttcgtggctgtaattgaagcgggtcgaaggtgcccaagctcagctcagaggcaggatgcatcatgatgcacgaggtgcataccctcagtggcaagtcccgcatgagaaagaatggacagtattggagccgagcggtgcttgactccgcttgcacatagcagaggctccgggctgactccttcctggtgggacaggaagatggccggtctctccggggggccctgtgcctcaccgcagagccggttgggtttggaacggtatggggtcctcctgggcgggtcttgctgggaaccagggtgccgcacataaatgggacgtgctaaacaaaaaggggcggcgagaaatctcggggcgcgacggcaccttgaaaggggccagagataatcggcgcgcgcacagcggaaagcagatgaacccgcgagagccccaacacagaaggtacggggtgcagacgacgggacattgggagacgaacagt

SEQ ID NO: 596639 - DNA, 243 bp, Homo sapiens
tgcgacgacaggttggatgcgacgaacggttggaccagttccgcagacaccggacatgcggctgtgcgagaacctgttcccccagcatcagccctggccgagtgtcgtctgggagtgcctgaaggagaatggtcctggactgcttatgaagcagcgtctgtgactatctggagcagcaggtgtgcaggggcaaccagctcggggactttggggccccttgggttacaacttacacttgtcaac

SEQ ID NO: 596640 - DNA, 368 bp, Homo sapiens
aagaatcatctctcctgggcctgacagtttcagaatgctaaggcacgcaggggttgaatccagtgtccagaggattacagagttctcatacattgctggtgggaatgtaaaatggtgccgctgtataggaaagcagtccagcagtttctcaaaatgctagacatagaattacacagtaactctgagtaacattccacttcaaggattgaaagagaattgaaagcatatgtctacacaaaaacgtgtacataaatgcccataggagcattattcataatagccaaaaagtggaaacaacctaaatgcccatcgatggacaaatggataaacaaaatgtggtatatgcatatgatggaatattattcagc

SEQ ID NO: 596641 - DNA, 551 bp, Homo sapiens
agtacttgtcgcgtactaaaatcagaagaataaacaatgagtatcttagttcctactatacgcacaaagctttctcataaactactcccattcatgacacagtgttctcaatagcagtttgacatagctgatgcagacatacaaataggaacatgagtaatgaagatatatcaaataaggaagaggggtatacaaaaagactatactgatagcgagagcattagaaatagataattaaagatttacggtcagatatactactaggctgtaaacatagaagaactgaactgcatggaaaatacaaaagggcaaattaagggacagctacttcagaaggtagtaggtacaaacaaattacagacctccaaaaatagtccaacacacgaataaatccccaagaaaccttgtgactatagttacctataacgtggtagaacagggacacttgcagtgtaaattaagtaggacacaccctatgagatggggagattaattccgcatatcctcaagtagcccaaatttaatcgtatgaattcttaaaagcagagggt

SEQ ID NO: 596642 - DNA, 1807 bp, Homo sapiens
tgcggtgggctgggctgcttgttgtgatacggcatcgcgggtcgactgtgatgagtcatcatgtggctctctgtgtctgtgtcctcatcttcatgtgaatagctgccgcggctgcgatctggtctaccttgccttggcacgatgttgttgagcgactgacgcgtgccgcggggcggccggtgtgagtcacggttgtgtgctagcgaacgcggaggatcccgtgtgttgtgtgggcgccgctgtaggcgggctcattgattttgtgggctgcctcccctctgttgtatggcatcacctcgtggttggtgtccgaacgataagagcggctgccggcgttggtggttgatgcggccgcgtgtctccgtggcggggttgtttcgcgctgggggagatgatgtctgggttgttcgatgactcccacgtgcgcggttgtcgccgccgggatagccgcgcctgttggggggggtgtcaccgaggcccgccgcacataggtggatggggttgtctggtataccacagcgagagctgttgttatcgtgtttgtggctgcgtgcgggttgtgttgtatttcgagtgggtggggggggtgttttggagttgtacgacggccgtttgtgtgagtgggatgtgttcggatcggcgcgcccctgtgtcagtgggaggtgggcaacgtgttgggtgcggcccggtgggagttgtggtgggtgcgtgtgttgtcgcctgatgggtctttccctggggttgatatgggggcgcggctgcttgtgtttgtcggccttgggatagcagaacgctttttcgagggccagcggtgcctcttgtgtatcctgtggtgatgcttgtgtgagtgtgtaggtgcgtgtgtgagcacaaccttggtgtttctatggagggacggggcctcgtcaacggggggagatgagtttaagtggtgtgtactccgccgcgttgctgttggggaggccgtggtgtggcgcgctggggcgccgcggccggcacggtgcgacgttccctgtatgggtggccccgctgcatcttgtcggccgcccgtttcggcccagattgcctcgcctaataccgcgcgaacatcccccctgttgtaggccactgttacccaccgcagcccgagaggtgttcacacgcgagatgtctccgctctccctctctatgaccacgtctcgcagagtgtcccatgtttgtggcccaccccccacacttgggttgatacttcgagagaccctcatctcgagggtgacaccacccgcagagctattcgcgcgcgcgagcactatatatttctgtgcacaactttccctatacacatatacttttctccccgactctatatttcgtctatagagaccacacgcggcgagcactctcggcgagactctccttctgagacgcgttagagacacacattcgagagaatgtgatactctctccgcagattgtagaagcgcgccgcacatgttgggtattataatagaatgtatcactctaccacaagagacgttcgttgtcacactcacatgagagctgtgccccaccacattatgggcttataaaaccacgagatgcacacatgttcccggagacggtttatagaccacaaccacctttcacccgctaacaccgagccgcggggtaatatctatcggtcacaatgctctgagaaatctgtggaggcacaaaccaccacgtttcaatgcccactcgtcctatgagaattaaattccccttaaaaatctttgaaatagggcccgtatttaccctatagcaccccctttaccccctttagagccca

SEQ ID NO: 596643 - DNA, 284 bp, Homo sapiens
tcgttagttaattgagaatagatatttgcccctgtaagtgcacacctctcatgatagcctcacgaatgtggaatacgcttcgaaaagaaattgtccttgaagcttgtcatcttatatcagcagtggattgtagaacttgtggctgattgggcccttgtattcgaacgttaagtgtcccccttgttatgtggtttaataccctgtacatattttggagtacactctttagtacgtgtggcttggacacttccgggcctgaggtaagaacgtgcttgtggaagaca

SEQ ID NO: 596644 - DNA, 554 bp, Homo sapiens
ctctagagtataccaggacttgcatcctgcacttaccgctgctgctggcgctgccgccctgagacactgcctgcgcagctccggccgcctgggtcccggtgactagtcgccgatatttggagttcttacaacatggcagacattgacaacaaagaacagtctgaacttgatcaagatttgcatgatgttgaagaagtagaagaagaggaaactggtgaagaaacaaaactcaaagcacgtcagctaaccgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagattgaagccaaattctatgaggaagttcatgatcttgaaaggaagtatgctgttctctatcagcctctatttgataagcgatttgaaattattaatgcaatttatgaacctacggaagaagaatgtgaatggaaaccagatgaagaagatga

SEQ ID NO: 596645 - DNA, 269 bp, Homo sapiens
aagccgtagtacccgatggcacctggacagactcatagagttctagtcacgatagatagctaatctctctggtctcagccagaggaactcctttcctgctgggatagctgctgccaagcagtgacagtggccttccttactgagcgttcctcttgttcagcgtctttacctcgattatacgatacagtcctagttctctgataccatctcagcgtcataaacaactgttcgtgtctgggtactaaccctttcggcagcggtaccgaggc

SEQ ID NO: 596646 - DNA, 141 bp, Homo sapiens
ggatttgctggtgcagtacaactaggcttaatagggacatgtctgtatcccagcactttagaaggccaaggcgggcagatcacgaggtcaggagtttttagaccagcctggccaacgtggtgaaaccccgtctctacaaaa

SEQ ID NO: 596647 - DNA, 155 bp, Homo sapiens
tgtctgaggatcccggtgtacagctaattcaccaactgaaatttttttaagttgtattttaatcatacgtgtttttataaaaactatactagcatgacctgcagtttttacaaaacaaaaaaaacaaagtaatcaaaatttagtgggaaatgtta

SEQ ID NO: 596648 - DNA, 353 bp, Homo sapiens
acacaggcccaaccctctgggcagctgagacccacacaggggcctgggtggggactgcagaagctgctttggcctggctgcgggtccctgagaaaggagcgtttttttccggttcacagtcccaggctgctgggtgtggtgccggaactgtccaattccagtaggaatcgggttgaattcccagccttcctcttactgggcccacattacacctccgtcctttggggacctcgccagttataaactctctgtgcctcagtttccccatctataaactgaggacaccaggccatataacatcctcctatatttccatgtttggaactgagctggtggccccatgtcacctgggc

SEQ ID NO: 596649 - DNA, 381 bp, Homo sapiens
tcatcaatagatattgttctatagattctcttgtatgtcgttcgtgtctctgactggcttatggtacttagaatgatgctgggacgtcatgacaaatgagttacggaggattccctctttttctattgattggaatagtttcggagggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtgtgtgtccaggaatttatccatttcttctagattttctagtttatttgcgtagaggtgtttgtagta

SEQ ID NO: 596650 - DNA, 274 bp, Homo sapiens
  misc_feature (166)..(167): n is a, c, g, or t
  misc_feature (169)..(169): n is a, c, g, or t
  misc_feature (201)..(202): n is a, c, g, or t
gtttgcttcaacagtatatcctaataagcctcacctatttaatccaatgagttttaaatctaaatctcattcccttcttctttccctaccttttttttctttttttcttaaaaaaatattttgtgttattgacagaaattcatgtttggtgtggcataaagcattnnanaaatttatcaggttgtgggactgcttccttgnnacattttgtgctatgttttaaaaaaataattaaaaaacagtggcgttaataaaaatgtcaatgtgaaaaaaa

SEQ ID NO: 596651 - DNA, 196 bp, Homo sapiens
tagacctctcatagtagcttatttgttcatttagtgacctcaactaatttgtcgccatttcttctgtaatagtgtcatgagagggtaccgagcactagctattgactctactctggctggtatcaatcctgtattaattcctatacactaaactggttctggccagcctctagagaaatcccagaacactcagccc

SEQ ID NO: 596652 - DNA, 406 bp, Homo sapiens
agaagcctcttaaatagaagatccctggggaagaagatatcctgccccaggtccttacagagtgtagtattaggaagagtgaagacctgattcatatgccgtgcctccaggcttgagagtgtcttgcacagatcctagaaggccacacataaaggagtaaaaagcaggcactcagctggtttgaagccaagcttacagcttcacatacctgccagcaaggaaaagagtcgggaaaaagacacagaatctgttgcagaagtcccctcttctgcagggagaagttatgtcacagcagaagtggcctcctagcaagagagtctgcctggtttagcccagcagcttatgagctattatgagcacagccttcaggataggcatgaagctgcacacctcgctagagctcgtg

SEQ ID NO: 596653 - DNA, 792 bp, Homo sapiens
gcgctccttcttgctcctgctctcttcttctcttgttttgtcgttctcgcccttgtttttcgcttttcctctgtgcttgttctttttctcttttgtttgctgcttttgttgtgtttgttgtgttttgcttttttgttttgctttgttcttctgtttgtttcggctgccgctcgccgtctcccgccacccccccctcctctcccttcctcccccccttcctctcccgcgcctctctccccctcccccctctccccccctcttctccctttcgccctccgtccgccctcccccgcccccgccccgcgcgccctccccgcccccccccccccggccggcgcgggggtgcgctgccctctcgtcggtccttgtttgtggtctcccgccccgctctcgctcttctcgtcgtcgtgcttcccggcggggttgactcgcccgcctcctttcgctttcttccctctcctgtccgcctcctcgccttttggcgccccccccccgctctgttgtctctcctgtccgctcgctctgttttttcgccgtccgccgcctcctccttctcccttctcctttcctctctttctctgtcgctctccgcccccctcgtctctgctctctcctgcttctttgtggttgcgtcccgcccgcgcccctctcaccctcctgcgctccccccccccccccccccccttttgtttcgtcctcgccccccccccccccctttttttttttttttttttttttttttttttttctctctctctctctctctctatatagataagaataaaatatata

SEQ ID NO: 596654 - DNA, 278 bp, Homo sapiens
agtgcatagattctcgagctctgtaatgtcgggtcggagtagcgtattgatggcgcaggtgagggggccgccatatgcattctaggctattaataatcggagtatacgtagccggtaagttaacaaccggtacctctagaactatagctagcatgcgcaaatttaaagcgctgatatcgatcgcgcgcagatctgtcatgatgatcattgcaattggatccatatatagggcccgggttataattacctcaggtcgacgttccatggccattcgaatt

SEQ ID NO: 596655 - DNA, 295 bp, Homo sapiens
tcgtcgaaaggcacatctctgtggcgcagtccattcgtcatccagtggctatagcaggtgccagatggtgtcggcagtggccttaggcctgggtggagagaagcagggtactcctatggcagatggtcttggcgttggaggtggcttcagttccagcagtggcagagccattgagggatggcctcagactctgttggaaggcggcagttccaacatcaaagtacaccaccacactcctcctccagacaggacagagctatagagggcactaaatgtgcgttctgcatagactctc

SEQ ID NO: 596656 - DNA, 506 bp, Homo sapiens
taatctttatttcttgtctctttcttcttttttttctgggatggagttttgctctcaaaggctgagtgcagtggcacgatcttggctcactgcaatctccgcctcccaggtttaagcgattctcctgcctcagcctcccgagtagctgggattacaggcgcctgccactatgcccagctaatttttgtatttttagtagagacagggtttcaccatgttggccaggatggtctcaatctccacctcatgatccgcccgcctctgcctcctgaagtattgggattacaggtgtgagccaccacacccggccagtgcctaggttttattaaaagaaaataattatggctgataatttattgagggctatattctcaatacttggcatgtattatttagttctgacaaacccactgagcgtagtcattgtcgaactgaagtttggagaagaaactggtcagggctcccagttcataaatagattggagaaacacagatccagacctaga

SEQ ID NO: 596657 - DNA, 318 bp, Homo sapiens
agcggctgggcaacgcgtgctgagcaagctgcagtctccatcgcgggcccgcgcagggggcagtcccgggggctcagtaagcgcacgcgcgtcaccgtcaagtatgaccggcgggactgcagcgcggctgacgttgagaagtggatcgacgggccccttgaagactgtaccgcggcatggaggcagacatgcccatgagatccacatttatgaattgttggagttagagaattaagaggagagaagcccgaaaatccaaggactcctgaagtcatgtgggaaacctgtcgaggacttcatccaggagctgctggcaaa

SEQ ID NO: 596658 - DNA, 1351 bp, Homo sapiens
cggccgcccttttttttttttatggaaacaattcttaatcatttattttcacaacacgggatactataaagaacctaagaaaatcagacaattttaataacccataaacagtgtgtggaactccacttggccgaatttaaatctgtggcgtaaacaatagccgtgccacccaccctcacaccgaaataaacgtggctcccgtgcatagtgaacaaacaaaaaaaaacacaaaaacaaaaaacaaaaacaaacacaacacaacacacaacaaaaaaacaaacacaacaaacacaacacaacaaacacacaaccaccaacacacacaccacacacaacacatacaacaacatctaactcaataatataaaactactaaacaactatcacatcacacaaagagagcggtgcacgcaacatctatgacaacaataatcttcttaacaacctctaaagacaaccaaacacaacaatctcaacatttcaacccgaacacataccacaacataaaaaaagaatacgaccaccacgacctaacacacacacaaatcaaaccacacaaccaccactacccaaacaatctcccacacaacaaacccacacctcaccacctcaccacatctaccatccgcattaccaaacaaacaaaacaacttactaacacaacacaaaacaacacataaccacatcttacatcatatctctcaacacttacaatacaaataacaatcactaccattaccgcaccacactacaccaatcactcacacaagcacactcacaacatctccaatctcactccaacacaacaacaaaaataaccaaaaatagtatatactataacctaaccatcaaaactactctacacacataccaacaacaaatcacagactatccatactcccctcccactacttcctaatactacacacagatcacacacacatccacataccgcacacgactcgctcccacatactactaatcgagaccatcgaccatccaccactaacccaaacatcctccttacgcaccaacaccgacctcctatatctagctatacatctacaccacactaactactctccaacacctagtacacataaacaaacaactattcacatagatacgtaaactcataatcgagccatatatgttagccactactactacactattattacacaactaccactacgaactcacatacactccttcataattatcacaacatacaaatacatacatacaaacagataatctatatatcatactaaatactcatccaactcaccacagcagattcacaagtaattttatatagttcactattctaataacactcttcgactag

SEQ ID NO: 596659 - DNA, 653 bp, Homo sapiens
agcgggcgcggttgttggccatccagtgccttccgcagcgccgctaaagcgcagttctcgtggtgtaactttttctttttttttcagccacttccggctcctgcgtcgctccggaagcctgcgataaccagaaaaccaaggaagaccagaaccaacaagaaaaaaacaaggcataccaaagaacaagcaaaaaaataacatgaaaaatcaaatacaaaacacaaacaccaaaataaacaaatagccaaatgcagcatagagcgcaaactccatcaatcgatgaaaaaaactgaatatgcacatggaaataatcgaaatcaaggaaattcccataaagctagtgtaaaaacagacgatactaataatagctacggaaacagttatgaaaaagactgtgcgaagtaaatcataagggaaccaaatattggataatgacgtaaaaataacattcggaaaagatgggaaaaggtaatcgtatatattaaatcactttaaacgaattacctggtatccgttggtaggcagcgatttaaattgtgcagttaacacagtaactagtcttgattttattacttttgcattaagtttactcggagatgctttaataagaggctatctttatattgaatttgaggagaattaacgtctatgat

SEQ ID NO: 596660 - DNA, 283 bp, Homo sapiens
aggagtcgcaggtctcactttaaatcaaaagtagaaatgattgagcttagtgaggaaggcatgtcaaaatgcaagactggctgaaggctaggtctcttgtgctaaacacttagtcacattgtgaatgcaaaggtaaagttcttgaaggaaattgaaagtgctgggctgtgcgtggtggctcttacctgtaactgcaacacttggggaggctaagatgggaggatcacctgaggccatgagtttgagaccagtccgggtaacatagcaagacctccacctctac

SEQ ID NO: 596661 - DNA, 721 bp, Homo sapiens
ccaccccggcggcgcccatagccagccctccgtctacctcttcaccgcaccctcggactgccccaaggcccccgccggcgtccagcgccgcgcagcagcgcgccgcgccgctctccttagtcgccgccagtgacgatcgcggtccaacctcgcaggtgcgccagaagtaccaccaggactcagaggccgccatcaaccgccagatcaacctggagcttctacgcctgcctaacgttttacctgtcctatgtcttactacttttgacccgcgatgatgtggttttgaagaacttttgccaaaatatcgtttgcttcaccaatctcatgaggagagggaacattgctgagaaactgagtgaagctgcagaaccaacgaggtggccgaatcttccttcaggatatcaggaaaccagatgtgatgactgggagagcgggctgaatgcaatggagtgtgccattacatttggaaccaactgtgtgaatcagtcactaactggaactgcaataatgccatgacgaaaaatgacccccattgtgtgtgacttcattgagacacattacctgaatgagcaggtgaacagccatcaaagaatggcgtgaccacgtgaccaattgcgccagatgtggagcgccgaatcttggcttggggaatatctcttgagaagcaccacctgggagacagtgataatgaaagctaagctcggggtaatttcccatagcg

SEQ ID NO: 596662 - DNA, 423 bp, Homo sapiens
agggaaagagcaaagatatatgtggcagagaacaaaagattgagaagtcaatgaaggagatttaaaaatggctgatgagagcaacagggaagtgtagataaataaagaaggagagttataaagaggctggaaacgaaagagtgtcaagaataaaatgggaagaatgagtgataatggagagccagacagaaggagagtatgaggatacaggctaatgcagagagagccaactggaaggagatatggagggtataaagtggtgaactatatgtcagtgaggtgaagggtgaaagaaagaggcaaaagtcagctatgtcggactatgtctctaagtctatgtcagtctcactctctctctatctctctctctctatctctctctctctctctctctctctctctctctctctctatctctctctc

SEQ ID NO: 596663 - DNA, 264 bp, Homo sapiens
  misc_feature (155)..(155): n is a, c, g, or t
tttaaagcctaaccaaggttgctgggagtccagctggggccggtttccccttcccggctctcacctccgtgtgaatggaaggggctctgctgtgccaaaggggccacagaactgcattccccatttaccgggcttccccaggggtttggcagggntcaattccccacccccccacacacactggtgcaggccacaccagtctgttgttttgggaccagagtatttttgttaataaaactcaaaagccatccatgctcaggaaaa

SEQ ID NO: 596664 - DNA, 162 bp, Homo sapiens
cagagatttctattatctaatacgactggccggcttcttccaagtactctttcaagtacctggtcattacccgcctttctttggcagcaaaacttctaggactcggcgtccaatatggcggccatgtagctacggagcacttgaagcataattagtgtgacg

SEQ ID NO: 596665 - DNA, 405 bp, Homo sapiens
gaacaagttttgactgataacatcgaatggtactaaattagagataatctgtgatatatcctattctagtgcttgttacattccaggggctgatctgttgagcattgtaggcccctaatcttaatttatattgttgctcttaattatgctcattttaccgatgaggaaaggcagattgcaaccacccctatgctgcacagctaatacccagagagcacagtttcgacacatgctatgattctagctaatcctaacttctgagtttcaccagactacgtcggcccttccggcttgtcgagcagcacggcattatctggtacccaccatttgtatcccgccatcatatatccttctgcctaccttgtaggcaacggacgtgtgggtcccctaacgggtgggcccttt

SEQ ID NO: 596666 - DNA, 327 bp, Homo sapiens
tgtgaaagcacaccttcgtgtgcgccgtgttccaagcgaccgggggactatctgcttacggctgccaccgtttgtttagtccaacaaatgaccgcttcaattagcgagtggaactttgctatggataacgttggtttggattcgatgtcgtgactcgactaactgttcagtgacatagcaattttattgagtggcagcttttcaagcgttggtggtagttgcggaaaatactcaattcgggcaggccggttctactcgttgtctaagcgtattgggacgagcgagaggtcacgatttttcgggttgctctcccgttttgcttattca

SEQ ID NO: 596667 - DNA, 261 bp, Homo sapiens
  misc_feature (242)..(242): n is a, c, g, or t
ttgatgccgaacttagtgcggacacccgatcggcatagcgcactacagcccagaactcctgggctcaagcgatcctccagcctgggcgacagagcggactccatctcaaaaaaaaaagaacaccctgggtagctcctactggtggtgcagaggtgaacttggttatcacttcctctgttcccactgcatgctgtgctatggctgtgctgtttatcacagtggtgtctactgtcttatattgncctcccgggggatcctcta

SEQ ID NO: 596668 - DNA, 453 bp, Homo sapiens
  misc_feature (48)..(48): n is a, c, g, or t
  misc_feature (63)..(63): n is a, c, g, or t
  misc_feature (75)..(75): n is a, c, g, or t
  misc_feature (119)..(119): n is a, c, g, or t
  misc_feature (125)..(125): n is a, c, g, or t
  misc_feature (161)..(161): n is a, c, g, or t
  misc_feature (300)..(300): n is a, c, g, or t
  misc_feature (312)..(312): n is a, c, g, or t
  misc_feature (347)..(347): n is a, c, g, or t
  misc_feature (381)..(381): n is a, c, g, or t
  misc_feature (426)..(426): n is a, c, g, or t
  misc_feature (438)..(438): n is a, c, g, or t
ggaccttttccccgaggactgacaaagtccgcaccatgctggttaggnaagatccagggaagnagtcactgaggnacctacctctttcacctacagcagtgtctatgactccattcagncatggnagacgctgttcagacatgtttgtagctgggatctgncccactgtgcactccatcatcaggcaaaatgatcattaatgagggagctgatgggcctccctgggaccagccaacacaggacagtggtgatgcaccgcactgaggcccactgcccagcagaacctgggctctgcagctngccgagaagctnggcagcctgggttgagaacaacgaacgggtgtttnaccacaagcagggcacctacgggggctactttcnagaccagaaggacggctaccgcaaaaacgagggctacattcgccncggttgctaccncagcagcagttttag

SEQ ID NO: 596669 - DNA, 440 bp, Homo sapiens
  misc_feature (88)..(88): n is a, c, g, or t
  misc_feature (164)..(164): n is a, c, g, or t
gaaccttaaaggttttattattaaaagcagcccagattccccatttttacacatgaggattttttttgtggtgaaaaccaggattgantgcatccctttaaagaagttttatgtccctgactttgggtaaaattatttaatttccagaggcttttgtaaatgantgaaggatttgtgagccccaaattgggagttttaaatttgagtgaatggcaggaaagggccatctcccttgagatgattaagtgaacccaactagttctcagaattttccaaagaaggagggaatcagactgaggaagctgtgacataggacttgaagccccaagcctttgaaatttgcgagctgctcatgtgtgagttattatccccgctgtctttctattgagttcccaatctatatttttattgaagtttaaataaagaaaaaatttcccaga

SEQ ID NO: 596670 - DNA, 982 bp, Homo sapiens
  misc_feature (1)..(1): n is a, c, g, or t
  misc_feature (33)..(33): n is a, c, g, or t
ngttcagccaggcgatggagatgatcaaaaccnggcgagatactgtgactggtaagacggtgttattgcttaactatttgcaaacgtcacatttaatggactgaaaaataacaataatatttcgttgtttattattggctcaatccgacaaatccgattgagccgcgctacctgcgcaacgaagatacgacttgtgctgtttgtttgaacttctggggtcgtaccgtccatgcgctatcgcattttccttctcttttttttcgctttgttgccgacgtctttggtgtgggcggcaccagcgcaacgggcgttttccgactggcaggtcacctgtaataaccaaaatttctgcgtggcgcgtaatacgggcgatcataatggactggtgatgaccctgagccgcagcgccggggcgcataccgatgccgttttacgtattgagcgcggcggattgaagtcgccggaggcgtcagaaggggagatagcgccacggctgctgttagatggcgagccgttggcgttaagtggtgacaagtggcggatttcaccatggttattagtaaccgatgatacggcaaccatcaccgcgtttttgcagatgattcaggaagggaaaggcaatcaccttacgcgaatggcgatcagaccatttctctgagtggcttaaagcagcgttgttgtttatttgatgctcagcaaaagcgcggtttgggcagtgaaaaccgcgtggatccagaaagggggaccgaaccgccgctcaggtaccggaccggtgctgcgctgaaagaggtcgcggggttacccaaaggccggaggcattctcaaattcgaaaaagggaacatttgctggattatggaaactggggaataaaatggtctggcatggctcgttgatccattgggtcgtgagggaatggtactgggcgaatgatgataagactgtgatgattatgtgagagagggcttaaccttttttgttgtg

SEQ ID NO: 596671 - DNA, 364 bp, Homo sapiens
agtcattcagatcatggatgaatgccattctgtgttagcttaaccaccatcattcttgataaaatataactttttacctgagtaatgcatacctagtataataggctacagtatttcttgaaatgtagagtccgtatcagtggtggtataaaagattgttttacatgcaacgagatatgctggtatataatattaagtgttttgctaaattatttgcctttcatttctactctaatgttactgattaagataaggggagcagatctcaccttggagctaggatgctttcatgtccctccaaccctcactgattatctttgtaacagagagcaggcctcaggctaggagtgtttgtcagaaaaaa

SEQ ID NO: 596672 - DNA, 1366 bp, Homo sapiens
  misc_feature (287)..(287): n is a, c, g, or t
  misc_feature (486)..(486): n is a, c, g, or t
  misc_feature (908)..(908): n is a, c, g, or t
tctttcctttaaaaaagtttatggtgaaatattctatccagtgatgtacttataacatataagtgtccagtttatacaagttacaaaaagcaaacagcccttcccttttatttttgttttttgtggaaagaaagaaggtcctgggcctctgtgttccacccgagggtgtggtagtctccgagggggtgtacaactcctcagctctccagcgtgggacactcctccacccctcgcgtgggttctcaaagtcgaaagtctcttatgtgtgtccctctcaagccctctcnccgcgagtgatgacgcgtgtggagtatatataccgcgcgcgcgcagcaccacaccacacacatatgtgcgccggtgtctatatcatttgtgtgtgtaatatttctatatagatatacagaacaccgggggtattgtgtgccctctgtgtgtgtgcgccagaggcgtgtgtgctctctcaaacactctcctgatgagacnctgtgtgtgtgaaccccgcgcggtgtgcgcatgtggcggcgcatcccccatagagagtgtgcgcgtggggaaaatctacaagagacgacggtgtgagacgccacacgtgtgcgcggcgctgtgcgcccacacatagacgacggagatacccactctctgtgtgtgacacaccacactctctctccacaagaacacacaacgagacgtgtgtgtagacaacatatttctctagagagcagtcctacaatacaagatatatctacacacgctgtgtgcgcccgtatatgtgcaaccacgtagagaaaacccccgccacatcatttgctcggaggaggaaaaatatacaagcagcagcgatacaatacctctgatgttgcccccaaagggggtgctgtcttctaatcgtcagagggtgggggacnaaagtacgtggtggtagacgactctaggtgagaccaagctgttgcggcaccacaaaacaagcacccacacagcacagcaaaaaactactgcagagagggagggagacgacatataagaccacgtgtagtgtcgccgcagacaacgaccatgtggacaaaaaaaccaacgagggggtgtggcaccgcaccaaaaagagtacccacaaccaacacccccgaaggtgggcgctgcgtggcaccacctcgagagtgggcgactaaaatagaaagagaggctcaccgtgaacaccaaggagacaccacagagtagcaagcgaacaaatagcgatgcacaaacgcggactacaaaggagggaggcccaatataaagaccgcgtgattaaacaaccaaacagagggacgggccgctcaactagtggtaggacccactaagaggcaaagaacaacaaaacaactct

SEQ ID NO: 596673 - DNA, 252 bp, Homo sapiens
gcatagcgccaccaaggcatagcgccaccaaggccatagcgcccaccaaggccatagcgcccaccaaggccatagcgcccaccaaggccatagcgcccaccaaggccatagcgcccaccaaggccatagcgcccaccaaggccatagcgcccaccaaggccatagcgcccaccaaggccatagcgcccaccaaggccagagcgcccaccaaggccatagcgcccaccaaggccatagcgcccaccggggtct

SEQ ID NO: 596674 - DNA, 629 bp, Homo sapiens
tggaaactttaaaatccctcaaaaacggtttattatacaagtgagtttggagtcacgaggggcttatcgggtaggatttctgggtagcagagcgcgggcaccagggcctccaaacttttgggactcgcagcgacagagggtcagctaccagcagggtccggtcatacgggatgaggatgtcttggatctccttctgggaagcctctatccactattatttctgggtaataaggccaccagggcttgggaaatgggactggacggatagcataaaatctggggccacgtggaccaccaccctttacacgggacacggtttgtctacaccagcaaatcggctccttgccagaaaagcaaaattgggtctccaggaagtcttggtgactggtgacgggtggcggcgggttccaatcattctccagggggcacgcccggttacactcttgatggaagaccttgtggcgcgcgtgtttgcgcatgtggcggcacaaaagttgtgtcggctgagtgctttctatgggtgttccgaagaactctggcaccggattggcaaggggacctcttgggacggggctttgggttcccagagctgtgggacatagaaacaaaccttcacgcggcgccggggg

SEQ ID NO: 596675 - DNA, 314 bp, Homo sapiens
atcctatattaggtcagcttgaatcaccattcatatgcatttgcgaagacctaggagaatcatactgtagagaacaccttacaaatgtgaagaatgcgagaaagttttcacgttgcaaatcatcattcttgaaattcataggataattcatactggagagaaaccatacgaatgtaaggtttgcgacaaggcttttaagcatgattcacacctggcaaaacatactataattcacaggggagacaatcattacacatgttatgaatgtagcaaggtttttgatctataagcaatccttgcatgtcatcatagaa

SEQ ID NO: 596676 - DNA, 937 bp, Homo sapiens
gagggttcgaattgcaacggcgctgcgggcgtatgtgttggtgctagaggccgctgcgggtctcgctgggggccgctcgggaccaatttgaagaggtacttggccacgacttattttcacctccggacctttccttccaggcggtgagactctggactgaggagtggcttctcacaatggaacgcggcatcgagtaatttcacagacaccaagcaaattatcgagacaatgcatatgaattctgtattattgtgtcaagtccaagctataaatatcccggcctctccgtttatgcagaagcttggattttggttacttgggtaaatgtgtacctaaatgaaaaagatctccatagaggtgtgtgtcctcattctcccttgggctgtaaacaatagattactcctatattgtatgatcatttatcgaagtgttgtatcagaaccgagcacctaatggatgacgcctacagatttggaaaaggccttcatcatccaaaacattgtgtggctatcgtgctttgactgaagccaattgatggcagtctgtgtctgcaatgcgaatatggagggtgaacagcctctaagtgacttactgaagaacgctataaagtcgcgagatcttttccagcagccattatttacagttgtttgatttcggcgagggcgtaacggatctgcccacgaaggaacttgctcctggcgcctgcggtctccatgtgtattcagggcgctctgaccactaactctgggtgggggtctctccctggtcgatttctgggctgcctggtttgactttgggcacgcgtgtgaccccacacgtggggatggggttcccgcgggcatttcgcgcccctttgggaaggctccctccctattctcggaggcggacctgcgtgcgctcccggcgccctttgtggactttgcctcctccccctgtg

SEQ ID NO: 596677 - DNA, 437 bp, Homo sapiens
gacatgtcacgcatcaatggcactgaacatctgtgcacggtcatgttctgaggcaggacatacacagcccgatgtcagatctgcaaggttgatgtaggactaggggtagcattgatagaggcaggtgtccgggtcctgctgctagctgctaaggggtgatgcctggtacaggatcctggtagtgatccttaaaccatctaaacagtcacattcacgtgttgggaagacatctggaacccgagtaccggaaatccactctggagatcacctgttacactatactatccatggagttagccccgagggctggtatcccagaacggaacattgccagggcagattcctttgcaaggcacaagctgaaaataaagggctgaacagtgggctatctccttcttaagttttgactgacgcagctcctcataatttcttgacgg

SEQ ID NO: 596678 - DNA, 137 bp, Homo sapiens
ggttttgccttgcgttttctttctttctttctttctttctttctttctttctttctttctttctttctctctctctctctctctctctctctctctctctctgtctctctcccctccctcccttctgtcgtcttctc

SEQ ID NO: 596679 - DNA, 245 bp, Homo sapiens
gccattttcagtaattcgccaaaattgacggaacacaaagggaaagaggagaggcacccgatatattttgctctatggctcttttatgaaaacaagtgagttttttccctttgccacatatatgtgaatctatatgaaagggtgatattttagacatcatagggaattgtgtacttttctaaaagagaatgtccccacaagagtttatcactggcacaaacttggtagagatctacatattttac

SEQ ID NO: 596680 - DNA, 435 bp, Homo sapiens
cagggttcattttcccctcaaggctctgacacatctgtctgggctaccgcaacattctccctcacataccatagtgcagcatgtctacattcctcgggcccacttaatgacttttgcactctgatttacatttttagaagcatctctgtggttgctgtgaagaatacaggaaggaggcaaggcaagtgtggaagcaggctactcactttagctgttggtaagtcatggcctatgctgttgattaggttggactacggtgcgtactgatcaagttgtgagatttgggatcgtattagttgtctatactgtggaacaagttatcctaaacttagcttaagacagttaatgttatctcacaggggtttgagtgccgcttagctcggtgcctcatgctcagggtctcacaaggttacagcttagatcttctcttaggct

SEQ ID NO: 596681 - DNA, 148 bp, Homo sapiens
aagcttatactgtactatatgccaagtcataaatacagccaacattatttcatgaaaagagcactgtcaggagatagatgattttggtttaattgcctattttactgtccctaacattcacgttcttgaacgaacggtcattttagcc

SEQ ID NO: 596682 - DNA, 199 bp, Homo sapiens
tgtaaaccggataaagtttggtttagacgttaggtaattgtttgtgattttaagcctaatgtggggacagggagtgagtgcaagacgttttgtgacccccttattatacaaatgggggcttgaatcgggagtactattagattgctaacgttaaggagtggtaggtagtctggttctaggaataatgggggaagtatgt

SEQ ID NO: 596683 - DNA, 409 bp, Homo sapiens
  misc_feature (1)..(1): n is a, c, g, or t
nctatcctttcagacagagatatcaagatatctatgttaaggacacttaaataaactcgagctaacatcatggagaacggaattcagaattctatcagataaatttatcaaagagattgagatactaaaagagaacctagcataaattctggagttgaaaatgcagttgaaagactgaagaatgtgtgtttttataactagctgaattgatccagaagaagaaagaattggtgagcttcacgacaagctatttataagataccaaataatatatgaatgacacatgcctagaagactctagaaaaatgcctcaaaagggcatatctccgagttattgaccatctagaagtggtagagagaagtataggtagaaagttttttcggaaggccagtaacagataacttctga

SEQ ID NO: 596684 - DNA, 1251 bp, Homo sapiens
caaaggcgacggaatggaggaggtgcctcacgactgtccagggccgacagcgcccaggcgggcagaggggcttatcatgtcagggatgccccaacctagcaatgatacactgtctaaggagacgggaatgctcaccgattacgatcctacaaaaaatagaaagaacttaaatagataagaatgaatggacgaatgaagatcagcatatataacgatataaggaaaggacttgaaaagataaagagccggatattggggtggattgaagcgcattcaggcgcccacctgttgctccattggtcgctagcattagaggattgtaaatgcatcagcgagattggcaacggtcgataaagccaacatatagaatgaggagatatgcttactgaggacttcatgatataataaatatgagaaaaaggaaaatgagacttaagaatgtcaaaaaggctatattgggcgaagaactagctatataataacgatataatataacagatctgggaatgtaaaaatgacaagtagatagctggcaagacgacgaattgcattaacgccaaggcgtaagaggggcgaaagatacaacagattagtttggaaaccccaggggatgtggaaatggaggcagaaaatgctaatggcaatggaaccctggccaaaaggaggaaaaatggaccaatttgggatgtaaaatgagcggaattaactgcatccaggaagggataatgtgccccctcatccgaatgtatcttacgggataaaggatcatccactacagatgctagggcctgagagacttagaagcgcagccaatgcagccacaagacaaggatgggatcaatgaggatgggcaaacatgccaacaacgcccatttataggaatggaacattctacgctggatgtgaaaagcgcttatgggacaaacacgccattggcattcgaaagacccacgaaagagcggaggttgcgagaacctcatatcaagaacagttgaataaataatagaaaatattgcggaaaaggtagggcttaactgaaccaaatagcgcgaaaacgggaattcgaagtggaggaaacaattacctggcgttatatttaaacccgccacttgcaacaatattcaaaaaaggggcggcctaaaggtcccaccagaaatgggcgcagatttagtttaaagaggagaagaacccgcggagccggactccagcggggcaaagaactgaggcgccccctaaggttcgacctcggca

SEQ ID NO: 596685 - DNA, 140 bp, Homo sapiens
cgtggaggcaggacactgcatcgtctcgcactgtgctaagatgctgtcatgatggctgtatcgatgactgtacactcagccgggtgcactgcaccctgggcaatttgccaaggccactttgatgccatttctaagaacta

SEQ ID NO: 596686 - DNA, 625 bp, Homo sapiens
  misc_feature (227)..(227): n is a, c, g, or t
gccagttagccctgcctcagcaacaagttttaacacattcttttggcccaacaaaagaaggacttcgtctgtgaattcaagcttagcctagttttagccaaaaaaccattgcagtcaaagattagaaactggaccagagcaaaatcatgaacataacgggagtcaagagaagggtttctaacatgaaaaagtggggcggggtgtggatacagtgggatgtgcttccnccaggttcaaccccaaggaagtctctggaagcagccccagtcctgatggggagcagaagagctgccatcttcagtcagggtcggagtcagggtccgagaagagctgctgctccatagtctcgcacatggcatcctgcagggacgtaagatgaccccggggcttcatccccattggctggatacttctgttcttgaagagcttgtcaaacatggtcacatgcttcatggcctcgtgctccttttgctcttctgtcatgccctccatagggttagcggctttttcttccatcttcccggtcacaagggttatgctggctttggcttccttgtcttcatttgtgtctgtgtcttcatcttttaagtattggcccccgggccggcttctgcaataaggccct

SEQ ID NO: 596687 - DNA, 248 bp, Homo sapiens
atgatgcctgagaccggcggccatgggaaggattttttgcgaaataccccttctttgccagaaaaccttcttcattaatgggggccttccgaaattattagaacaacttttccaaatggcccttttaaggggggggttttaaaaccaaaaggtggtttggtggtaaagggaaaaataatttgggggtgaagcaaaatatgggggaaagtggagccataattgacacgaggtccccgaaacccggtggt

SEQ ID NO: 596688 - DNA, 861 bp, Homo sapiens
ccaattatggttataaaggcaaaagccaaccatgtttttagtacatatgtatgacgaaaactccagcagtggtccccatcagagcggcttctgattttgactttagccatccatgtccgtgtagttcgggaaatttttacggcattgaagatggcatcatatattgcatggatttaaaaaaaagaatactatggagtatttcaaatatgtattatagagagagaaaatagtgcaatgtcccctcatgtgcacccattatcttactcatggataagtagtttcatcgtataccggtcatccatcttatgatttctttatttgatgaagtgaagcgacgagtaaaatatcagggggtggtttaactatcttctcatgactgggcagctcttagggctcatgtagtaaatacgaattatcgatagaacgaaactggttggcccttgcgtatatctagccttcggtatgatcattgggtgtattttaaataaaaggcgttttgaatatactttttgagacgcgattactaaaaaatttacacacgtggggttaacaatgatcaaactagtgggttttaaatagggttatgtaaggaacaatgacatttatgtatatttgttgaggcgcacatggacccaagaaaagaactcacatagcacggggagggagcgaggctgaccactataagtggaataactgagtggttgatgacgacggaagaaatcagggcctaatactgcgctgtggtgctcccccaaaaaaaaaacacgcgccggggggtatgccagtctttcgacacaaacgtcgcggtttgaggactcctgggggtctgaagaaggggctgccgagccaacgatgtacagt

SEQ ID NO: 596689 - DNA, 751 bp, Homo sapiens
tcttcagaagcagaaggactccatgaaagatgacagaagaagttatttgtgatagccaagtgggactacaccgcccagcaggaccagtgagctggacatcaagaagaactgagcggctgtggttgctggacgactccaagacgtggtaggcgtggtgagtgaactgctggccaacatggactgggctatgtacctgtccaactacgtgtgatgctgtgaagaacatgcactgaatgaatgtggctccctctgtgaatgaacctgaatggacacactagtgcctctggcaagacgcgcagtgaatgaccagcgctgctgggatgctgtcccccactgcccagcactggacagcctgagtaccccgccaatgtgcatgctgtgctgcctgacctgaaatctacgacctcaacatccctggccttctgtcaagttctgcctatgtggcctgatgcgggaggatgagttgtccctggtgaatggggtcgctgcgtcacctgtcatggagaagtgcagcagacggttggtggcgtgggcagctacaaactgggcagatcgagctggttcccctccaactacggtctttggagtgaggtgtgcctgaggcggctgctggagtccccaagcttcctgagcctgtggcaaggggcgctcgctgagcaatggccagggctccgcgtgctgcatgtggtcagacgctgtacccttcgcttcaggcacgggagggctcactcgagcaggggcgactggggtg

SEQ ID NO: 596690 - DNA, 220 bp, Homo sapiens
cagcggtgaagtcacacagggaggtgatagcatgctgacgggtaattatgtaatgcaaaatttgtataatcttcgccttaatactttttgatttcgtggagggggaatgatgagccattcggcccccccttcccccttttttgtcccccaacttgagatgtatgaaggcttttggtctccctgggagtgggtggaggcagccagggcttacctgtacact

SEQ ID NO: 596691 - DNA, 190 bp, Homo sapiens
ttttttttggggggggggggggggggggggggcccccccctggggtttgcccccttttcccgggggggggttttttggctttgtccggccccctttttggggccaggggggggggtgggggtccccggcctggttggcccccccatttaaaagagacggccttttttggattttaagggccccaaggata

SEQ ID NO: 596692 - DNA, 152 bp, Homo sapiens
tcctggcgccatcgaggaagctctttacatagtccagtgtttatttcgaggagtgagggatggcaggctcaaagacttggaaagagatggcttaacagaaaaggagtgtgtgagggagaaattaaacttactgcatgaattcctgcaaacag

SEQ ID NO: 596693 - DNA, 1003 bp, Homo sapiens
cgaattcgagtggcggaccacgtccgcccgtctccgaccttctgcatcgcaggcttcgaggcggctattccacctagacacctaacagatcgcggagccggccggatcgtgagggggtcggacggaggagtcgggcggatcttgtgcatcttggctacctgtgggtcgaagatgtcggacatcggaggactggattacaggagcatcccggcgatcacgcgctattggttcgacgccaccgtcgccgatgcccttggtcggccaaactcgagcctcatcagcccggcctacctcttcctctggacccgaagccttcctattatcgctttcagatttggaggccaatcactgccaccttttattatccctgtgggtccaggaactggattacctttattatggtcaattaatacttatcttatatcagtattctacgcgacttgaaacaggagcttttgatgggaggccagcaagactattatattcatgctcctcttataactggatttgcatcgtagattacatggcttagacaatggatatgcagttgctagatagattcctctgatcatgtcagtactttatgtctgggcccagatgaacagagacatgatgtatcacatggatggaacaccgataaaggctgctataaaccctgggttatcttggatccaatatatcatcggaggctccggaatcaatggagctcatggcaacttggtaggacatcttaaataaccgtaagtcagatacccaatggacttgggaggaaaaatatatacaaacctaaaaataggtccgacggacgaccaaagacaggagaagaacaaggaataggaggcgccgagaaaggaaggccaccgcgtcacaagaacagaacaacaggaagcgaaacagaagaaagagaaaaagacaaaaaaacaaggagaaagagagacatcagcgagaaagaaaaaaacaaagaaaaaaaacagaaaaaagataccacagacgcgccccctct

SEQ ID NO: 596694 - DNA, 310 bp, Homo sapiens
  misc_feature (101)..(101): n is a, c, g, or t
  misc_feature (117)..(117): n is a, c, g, or t
  misc_feature (162)..(162): n is a, c, g, or t
  misc_feature (177)..(177): n is a, c, g, or t
  misc_feature (197)..(197): n is a, c, g, or t
  misc_feature (270)..(270): n is a, c, g, or t
  misc_feature (296)..(296): n is a, c, g, or t
agtaagaaactccccaaaacctccatacctgatcctcacatttctggatactccttgtgtactcagtttagatgtcacctccctccactaactaagcgttnccctctgggtggagtncctttcttgtgtaaccccatagcacctgtgctcacccctgtgctnaaggtattgaaaggnataagacacagtctctcctncagagtctgtggcgtagacagtgagtcatcggatgctacaatgtgctgtgataaatgtatcacagggacagtncaatggaccacatagtaggtactctntgaatatttgttgg

SEQ ID NO: 596695 - DNA, 343 bp, Homo sapiens
tgagatgaatcctgccaacctgagcttggagacagattctctccctatcctgccttgggatgatcacagccaccaccaacaccttcactgcctggtgagaggccaagccagtgaacccaaggtaaactggacagaatcctgacccacagaaactgagataatgtttgttattttaagctgctcaatttgttacagagcaatagataactaactcaaacaccataaaattctaatattttattctatcacacaaaccaagtaataccaagtaaatgccattactatacatatatttttgtaacacaattacatgtgattttttaaaaaagctaaaaaaaaaaaa

SEQ ID NO: 596696 - DNA, 248 bp, Homo sapiens
aaagttgaagatgaacacttgagacttcagcttctcacctactttaggtacaggttgggcgaaccatacacttctggcatggtttgggaaatccaaaatgtcacattctcggggggagggaagcccagaaaattggggtatggttcctaggaggatttaccaccattggccttattggccttttttcctttaataaagtttagagctcgcgagccgggatgctcgtcaattcggcacgagaaaaaaaa

SEQ ID NO: 596697 - DNA, 139 bp, Homo sapiens
gctcttcgctattacctgaagacatcttctatagaaattcaggatggatagatatttgaactaacagaattgacgagataacttgggcaagctactagaatgcaactcaggaacgtgatatattctgtgcccatgtcaa

SEQ ID NO: 596698 - DNA, 359 bp, Homo sapiens
  misc_feature (6)..(6): n is a, c, g, or t
  misc_feature (11)..(11): n is a, c, g, or t
  misc_feature (80)..(80): n is a, c, g, or t
  misc_feature (111)..(111): n is a, c, g, or t
  misc_feature (131)..(131): n is a, c, g, or t
  misc_feature (163)..(163): n is a, c, g, or t
  misc_feature (173)..(173): n is a, c, g, or t
  misc_feature (218)..(218): n is a, c, g, or t
accccnaggtntcactgagtcaagttaaccttggtaactttaaaacagttttgccccaaagatttttaaaaattcccccnggtgcctaattaataatttaatttccatacntccaggagggatggaaaatnagtaccttatggaaatatttttacccgaattnttaccagttntggggggagggttattcctggttttttatttgggtttgctttggncttttgtctgactaattaaatgaaagatgctccttaactaaagtgactaccagacttcacacaatcttgcctttttgagttttggctattttaaaaatgatcaaatgtataataaatataaaataggaattttctcatata

SEQ ID NO: 596699 - DNA, 706 bp, Homo sapiens
ccggccagatggcgggcaagacagctgggtgtacagcgtactcgaaaccacgagcaagtgagctagatcctccgtaggctagccagtgactccatcccagtgccatggcggattctgagcgcgctctcggtgtcctggctggtgggcgcgccatgcgaccaacttctcgcgcacttcgaaagtggaatcctccgtgtttgctgagattataattatgcctggtgatccatgatctggcgttcagtgccgtcgcacacacaggcatactcctccctgttcggtgattgagatgatccttgctgctattttctttgttgtctacatgtgtgacctgtgaacaccaagataccattcagtcaactggtgccctggagtgatttcttccgaaccctcatagcggcaatcctctacctgatcacctccagttgtatgtccttgttgagagaggaaaccgacgtccaaaatcgtcgcaggggtactgggcctaatcgctacgtgcctctttggctatgatgcctatgtcatccttcgcccgttcggcaggcaatgacatacagccagcccccactgatcccgcagatggcccggtgtaggcgaacttcccgtcagtttctctcgtgcaatctgcaaataactcctccattgaagataactcctcccacaccgccaatcaagcaatattcccagcagaccgaattcccacgcc

SEQ ID NO: 596700 - DNA, 103 bp, Homo sapiens
tctagaggatccctcacgccatgtccacaaggctttggctatgtcactttttcaatgctggaagatgttcagagggccctcaaggagattaccacctttgaag

SEQ ID NO: 596701 - DNA, 214 bp, Homo sapiens
aatcttgcttctaattagatagaaatgggaggttattgctgcagccataaatgatcttttagggtgtaactaattcaactaaatctcagatgtccaatttgtgcagcctgttgatgatattattcagtgaaaaatggttggggagattgggaatgattaagaaaattagtcttgctcacaacttaatgataacacttgaggatggtccgcacag

SEQ ID NO: 596702 - DNA, 156 bp, Homo sapiens
  misc_feature (87)..(87): n is a, c, g, or t
  misc_feature (97)..(97): n is a, c, g, or t
  misc_feature (102)..(102): n is a, c, g, or t
  misc_feature (126)..(126): n is a, c, g, or t
cagcgtgaagtgttggaaccctattgaatgcagtggattttatgcagcatggcccaaagcatcctgattgagtgcactggattcaancgagcatcantgaangcagaggattccatgcattgtgtngcaattgatccttattgtatgcagtggagt

SEQ ID NO: 596703 - DNA, 436 bp, Homo sapiens
cgaatctggccccatgttttctgtattcctgtttgtggtaggagataaccagtcttgtttgtttcttacatggcattcctttgttgtcctgggatggtgaggtaatgtttatgggaaatgagcagaggcctgtaggtagcacctgagggtccagggaggtatatggacaggcctgcatcacagcatcctagacttctttggagacccgtttgatagtactttcagtttttggcatttggggtactttgaaatccaacttgtttttaaattccatgttggtgccatagatgtagtttttacagcctgaaaattaactgccatgaacattctttggtgatgtaagcaagtaaaacccaatggactctgttgtgatatccttttgtgttccagcctaggctaagtgtttgtgaaagccatttgtgagtgcttggagtgt

SEQ ID NO: 596704 - DNA, 987 bp, Homo sapiens
gcaagtgtctcagattaagtatgcagcaacaagttcggagtgaatatcctgacagtgtgacaactgaacagttgaattgaacgaaaattgccacgtaatcacccaaatgccaaggtcttactactatattgcaacagaagataactattggagcgtgaagatgcggtaacatgaaagtttgagctagctatccctgcaagaactgtagagtcatctcttggaatgtgctaaggaacttgatgtccataataacttggggttaaattttcactgtttcgagtgcttgcaaatgaatctcaacgtactatgtacatgctctactctgagtgctcgcattgtgctgctttgaccattgcgctggacgaaattggctttacgactgaacagtgttcacgtacaattggtggatggacttccatcggcgaaactgcaatttcaagtgtggataagaggcttagatctactgttactcagccaccgtctagttgcgataatctagctttgcctcgaacgcgtatcgtgggtgattcataggagtatatctatacaggaagccgccggaacgctacctagtgtgtctatctgcgaattctatctactcagcagattaatgatcaggtggcacaagagaagcttgtagcagaaaaatggagttgacagagtgtgtcctcttgcctggctagtttcattcacacaaaaccacgcgcggacacggtggcatgcaaacccgagtccccttccatgctactttattaatgcaccatgcattgagtggatccaactgagattccatgatcctggcgaatagataccatacactgtatccttgacaggtcacccgttaacaatctatccaactaactccaagacacggaatactaaccaatagaaacacatataccatcaggtcaaaggactgaaaggcccatatatggatatcagcaaaaggcacagacaatatttgaggacgtttcccaactcccctag

SEQ ID NO: 596705 - DNA, 360 bp, Homo sapiens
ctcccaactcagggcgagctgctcaaatcattccaccggccccctcggcttgggacaggtagtgtaactcccgatcccagtgtcctagccctgcacacaggtggcttcccgctatcccgcgtgggcaaaacgccctgcacaccacgcggtgcttagagcttggccatgtgtcccatccacatgcctgcaccaacaccacctccagagatgcagatgctgggcaagtggcacgctcaaagcgaacatggaccatggcgctatggcaaagacatcagcacacacaccaacccaaaaggcgtggaccccagtgcccggcccgatggtacccaagcaggtggcactgcaagctcgccccatgag

SEQ ID NO: 596706 - DNA, 391 bp, Homo sapiens
ggcacaggcaccacagagcgccacggcgaccctgaagaaggcgcgctacaatgcgtcagtgccaggagaccatacgcgtgaccaagccctgtacccccaagaccacaggaaaggccaaagccaagaaagggaagggaaaggactagacgccaagcctggatgccaaggagcccctgtgggacacggggcctgtgccacagcccttcctcttccaaggccgagaagtgacccaccagtgcgcttctgtgagctcggtagccttaatcaaacatgccctggcttgtgccttttacattgcagacccacccctaagtgcccaaagtggggaaggacaagggattctgtgaagcttgagccttcctcgctgtgagtcccaggcccgcttttggtt

SEQ ID NO: 596707 - DNA, 538 bp, Homo sapiens
cgcccccccccgcacgtgcaaaagcaccgattttccgcacattttccttggggaacaggccgccttccttttcagcttggtatgtctattagacatacgttccctattagatgaacacttcaacattctccttccatgcagacatatgctcactttctttgaagaagctacggctcaagttacaacctgcacgtgttgagcttgtgtttctcaagcccaagtcatcacaagagcggctgagagctgttatgaatgatttcgcagcttttgtacagtggtgctgcaaggctgtcaataattagtggtgctcccacgaggagcggtcacaaacctgttagtacaaggcatgctctgtaagcttaaaacatcttcattaaacagcctctcaccttttgttgagactgtaaatatttcatgaagtacgaaagcgtccccccctgtaaatcatgctcgttggtgtagacccaacaccctgtctaaaattcatgaattcctttaaacggcaagcctcactaaaaagcgcctgtattaattgaaa

SEQ ID NO: 596708 - DNA, 754 bp, Homo sapiens
ggatcaacccggacgcgagtgctggcagagtgcccctgggttggtgagaccagatgcaaaaaagttggtactgctaagtctgatctgagatctaatgacttcagacatgatggaagcttagcaagagatttcgaactatccaatgatgactgctatggaagacccattgaagttaacaacggagtagggaaatctcaggctaagaacaacaagaaggctccccctgtcgagatctgttattccaacagcagcaaagcgaatgatctttagtgcaagagcagtgtttcctttctgcttctgtgcttcaagttatatatggtctatatatttatgataaatcttttcgcattgtagcaaaataaaattccatttacatggtgacctactcctttcataattgccgaatctgtgagaagcttttgaaattttcatagcaacattgcatttggatgccatttgattgtaataaaatctgtggcaccttgaattttgaatggcaggatgatcatgttatatctgtgctcgtagtaacagagtgtatatatgtatagtgaacatagtgcttagtaacaaatgaaggcacaagcatggctaacatgaatagtatccatacaattctcttcaggagtgtaaaactgcagatactacagattattctgataaataaatgatatgccggcggaatctggtatggcaccattccaagttggtgatttacaagtctttctggtaacttcaaagaaggcactaatcg

SEQ ID NO: 596709 - DNA, 336 bp, Homo sapiens
gcagtatccactctcttcaccagtactggaatgtagtagctcaatcatagctccctgctaactcaaattcctaggctctagtgatcttcccacctcagcctcccaagtagctgggaatacagatatgtaccagcataatccgcctaattttagtatattgagtagagatggggtttcgccatgtcaggccaggctggtctccaactcctcggtctccagtgatagcactcgcctcaggctcccaaatggtagtctgtattgatctctcatccatttctaacttctaaatttcttaaatttagctagtttgtacttgagtcttaatatttccataac

SEQ ID NO: 596710 - DNA, 427 bp, Homo sapiens
cctcgtgcacttgggtaagggatagttaacccacatgtaaagttacgtaacaggctgggtgcggtggctcatgtctgtaatcccagcattttgggaggccgaggcaggaggatcccttgagcccaggactttgagaccagcttaggcaacatagtgagacctcgtagctacaaaacattttttaaaatgtttttaaacattaaaaattagccaagcttggtggcttgggcctatagtcccagctactcaggaggctaaggcaggaggatggcttgagccaggaggttgaagctgcagcagccatgatcatgccactgcactccagtatgggcaacagagtgagaccctgtttccaaaaaaataaggaataaaataaagttatataacaaagctgatatttgtagtgttttctaggtacagagtgctt

SEQ ID NO: 596711 - DNA, 647 bp, Homo sapiens
  misc_feature (458)..(458): n is a, c, g, or t
ctgccgcggttgttctcatggtagaccagggttcttttatctgccgtccgcgcttgccgttctcctacctaagtgcgtgccggcatcgcgatggaagattcgatggacatggacatgatccccctgaggccccagaactactcttattcggatgtgtgacactaaagggccgagcgaaagagttatcacttttcaaggtggtataatgtatgaaaatgagcaccagtttatctttaggaacggtcagtttaggggctgttgcaaaggagtgaggttgcacatcgttgaagcagaggcaatgtacttacgaaggcagatccatattgatatagtaaacacctggcaagcttttgacacatatgttctgtcatcgaggccaaacgtggttttaccctctgtgtggcttgagagaaatgaatacacacacgagtggtcttaaggttgaagtgtggttcagnggccagggcatatgaagtggacaggactttagtatgctgtggaaggattgatgctagagtcatgaatgaatggaacgaggaggaggattgtgagaatgcttaatgtatatactggaagaggcggtgtgcccctggaggtggttagcaaggttcctctgtaacattaggtgaattgtgctgattgaagag

SEQ ID NO: 596712 - DNA, 111 bp, Homo sapiens
  misc_feature (15)..(15): n is a, c, g, or t
cagtgatgatcacantcttcaggggtttatcccggctgtctgtcttggtgctctccaccttccgcacacctccatgccctctagaactttgccaaacaccactgacaacgg

SEQ ID NO: 596713 - DNA, 734 bp, Homo sapiens
  misc_feature (734)..(734): n is a, c, g, or t
gcaccagggcagcagaagtcttttccacatagcactccaggcagagaccaccaatcgatcagagatgttgtgtaggtgcaaacccatttatgaagccatagacatttgccctctggagtggcctaaccccagagggtgaacaggcagccagagagatccagtaaggaggaaaccaagatggatcgttgagctttcaagtactcacaagaactcattgtatgagtgctaacaaaatctggatgtggtgatgcagttagccatggaatccaagtttggagggctagtccccgaatcatgatttctgcactttctaggtattgctttgctgggcattttcttccctatggcaatgaggtttcctcaggagcatgagccacacagagagggctggcatcttcacacagttctgagcatcgtcagtcaatcctctaactaaacactggtgtcagcaagacccgttaaccagagctcatcccacccctagaactgttaacaagacaatgacatacagtgcagggtgttaaatcttctaaggcagaatccttgtctttagcgaatggccatgaatcaactcaggatatgccaggatgttttaagatggccatatatttatttatgagtgaatgaccatttcggtatttctgcccgttacctttatggattttatgagattcggataacatttattaattgcccatactggtttccattcactggagctttggttgacattn

SEQ ID NO: 596714 - DNA, 943 bp, Homo sapiens
  misc_feature (26)..(26): n is a, c, g, or t
  misc_feature (64)..(64): n is a, c, g, or t
  misc_feature (76)..(76): n is a, c, g, or t
  misc_feature (153)..(153): n is a, c, g, or t
  misc_feature (162)..(162): n is a, c, g, or t
  misc_feature (190)..(190): n is a, c, g, or t
  misc_feature (201)..(202): n is a, c, g, or t
  misc_feature (207)..(207): n is a, c, g, or t
  misc_feature (213)..(213): n is a, c, g, or t
  misc_feature (237)..(237): n is a, c, g, or t
  misc_feature (244)..(244): n is a, c, g, or t
  misc_feature (259)..(259): n is a, c, g, or t
  misc_feature (297)..(297): n is a, c, g, or t
  misc_feature (313)..(313): n is a, c, g, or t
  misc_feature (318)..(318): n is a, c, g, or t
  misc_feature (322)..(322): n is a, c, g, or t
  misc_feature (330)..(330): n is a, c, g, or t
  misc_feature (333)..(333): n is a, c, g, or t
  misc_feature (339)..(339): n is a, c, g, or t
  misc_feature (384)..(384): n is a, c, g, or t
  misc_feature (390)..(390): n is a, c, g, or t
  misc_feature (394)..(395): n is a, c, g, or t
  misc_feature (534)..(534): n is a, c, g, or t
  misc_feature (547)..(547): n is a, c, g, or t
  misc_feature (554)..(554): n is a, c, g, or t
  misc_feature (575)..(575): n is a, c, g, or t
  misc_feature (583)..(584): n is a, c, g, or t
  misc_feature (592)..(592): n is a, c, g, or t
  misc_feature (597)..(597): n is a, c, g, or t
  misc_feature (599)..(599): n is a, c, g, or t
  misc_feature (602)..(602): n is a, c, g, or t
  misc_feature (616)..(616): n is a, c, g, or t
  misc_feature (724)..(724): n is a, c, g, or t
  misc_feature (863)..(863): n is a, c, g, or t
  misc_feature (871)..(871): n is a, c, g, or t
  misc_feature (935)..(935): n is a, c, g, or t
ttagggggatatgatgtatgagaggnaattccaataacataatgtacaaggatgttgtcacatncagaagagcaanaatctacgtattgggggctattgctgtggggaggcgggcctggtcttcatactcatcttcctcattgtgttccatgnccccttccncttcatccatactacaccatcatctgtnccatgttttgnnatgtnccaggngtgctgtgcaccccagtggtgtcngcggttngggttgggtgcgtgngatcttttataccaccatccaccaccgtcttctttagngcactgttttctgggntctgntgtnggccggcngtnattgtntctgtgatacgtgctggggagcatgccgttgtgaatggtcatggncctgtnttgnnccatcagctgggatgctccatccatgagggcattaccggctgttcctctgtatttgttcactgagatctggtatttgttggcttcattctgtacagtgaatcctccatagtgtgcctttactttgtctcctttccagtnctccgtttctgtnaggagtnctgtgggtcccatcctggtangctggctnnttttatcntttcngngcnaatgttcgcctggnaggccacagtaattcttcccatctgtgttggttgcaacatttccaaatccctgtttatatggatcccatttcctgccaaagtcaacactaccgtcttgacggttctgnatcactgtccatcctccattttctgtattcatgtcacagtatactctatacggtttgacagaactgtcaggttgaatgagatacatttcagatgtttcacctcctttcctgatattttcctcacattctttgccagacnccacaggnatattgccactgacagtgcatggggtgcgacaatattccatttgcgctgagacatcagattctnacttttgt

SEQ ID NO: 596715 - DNA, 265 bp, Homo sapiens
agaggtctgctactagtattcagaataggcattgacttagtggtcgaaatattatgcttcgttgtttggatgtgtgtagtatgggcattaaaattagacgaaaacccaaggcccgacatcgaagccccaaagcaacacacctcttctgaaacatgcaaaagaactgcccacccagaaatattcaacatcgagtctgtgcagacagaagagaccgacggccccacccactccctctgtaaactctggggctggcggtcctccaggg

SEQ ID NO: 596716 - DNA, 229 bp, Homo sapiens
tagttccacagaatactagcattcacactggaacgggggtaagaaccaaattattttctactaaacagggctcctaatgtatttactgcttgcaataatggttacacttttatgctctgtagcattattttaaaccattatgctatagtactattttgaagatctgagctgttatttccatttgtttttacccctgtgactaatttattacggttttagctttttagac

SEQ ID NO: 596717 - DNA, 784 bp, Homo sapiens
cggacgcgtgggctcggctcacatgtaagctctgcctcccgggttcacgccattctcctgcctcagcgtcctgagtacgctgggatccacaggtgcccgccaccacgcctgctacaactgcgctacgcaataactgtttggctacttcttgactgcacgactgacgagacgcactgagctaccacgtaaccaactagtctaaccaggtgaaacaacaggtgttgagggcttgaacatcaataacaccttcagcattcgcgtcggctaaagcacgatcttcatagcagacctttgactcacaggcaataccccaacttcaaccgtacaatagttgcttaacgtactattgtctaccttgctgaatacgacataacctgggactacccgaaccactacgacacacacagctcacacgccactcggcaacactaccgggcaacacccaacgcacaaccaaacatagaccccgcggctcgcaatcaacacacgcagacacgcacccacgaacacagctgaggaacctagacgaccctgacactgcacccaaacctagacaacacactcccgacagcattagggacagttcaccaagcgacgctgcacacacaattacctgcacttagcattacacttaggaaatacatatgggcacatacttaacaacttctgggcaccttattgcaatacttaaaggttgtcccctggtgcttacgcacaactatcaccaaatgtagccaatcaccgttactcaatctctggccccagacaacctggacactcctta

SEQ ID NO: 596718 - DNA, 172 bp, Homo sapiens
gctgccccaaaagctctgtgctctacctacttatgtatcttctcctccccctgaacccctggctatcactgatctttttactatctctctttttttttgcactttccagaatgtcatataatttgaatcatacagtatagacagcctcttcagactggcttccttcctttag

SEQ ID NO: 596719 - DNA, 1175 bp, Homo sapiens
  misc_feature (1175)..(1175): n is a, c, g, or t
acaaaagaagaataagacggggaagactatctcactaacagactttctgtctgaggatggcgtgcgtactggtcggagtgatagccacctaatgtattccagaaccaggtcacgcgtgcgagctgcactgaacatcggtatgtacctagcgacacggagtatgttatccgaccacgttgcgcacagatacacgatgacgatgtgtatagggcgccttccaagttgacgcgttccagtcgcttcccacttggctccatcgtggtctggctccgggaatcccagatattcgactcggaggcctgtcttcgccaaagtcgccaccctacactgcgttttctaggaaacctaccctatgatgttacagaagagtcaattaaggaattctttcgaggattaaatatcagtgcagtgcgtttaccacgtgaacccagcaatccagagaggtcgacaggtctcggttatgctgaatttgaggacctggattccctgctcagtgccctgagtctcaatgaagagtctctaggtaacaggagaattcgcagtggcacgttgctgatcaagcacaggataaacgacagggcatgatcgtacttttggccgtgactcacgaaatcgggattctgacaaaacagatacagactggagggctcgtctgctacagacagcttctgatgaactacccagcttagaagaggtgatgatagcctcggacgaccaagtatcgacgatccgtcatgaatcacgaccggcatcgggaatgcggcatcggggatgccactcggcgatggcacacgcccggggcatcttggacccggaaatgtgagcgccggaaaaggcaaatgaagaacgaacgcagcagagggaacctattgcaataaaacggccgccttaagtacccgccgggaatattggcccagcagctgactcagcagaacgcccatcttacggagcactgggcagaacacccagcgagcgtgaccggcaccactacagagaagacagtgaccgacagcgaagcaatagtcagtacgagccgagcaataccgacacgcggcagatcacgcctcatgggatcccaaacagagaatacactccagcggaataatcataccacaggaacagtagggggtcgcccaacagaactaaggcaaagctctcgatcgactatctacaan

SEQ ID NO: 596720 - DNA, 1142 bp, Homo sapiens
  misc_feature (398)..(398): n is a, c, g, or t
  misc_feature (1142)..(1142): n is a, c, g, or t
gttcctttcctgtgtcccagagcttcagtggtggagctggatgatccggatgctggcaggtgttggtgtctgtcagctgtgtgctgggaggcagactcagtgataggcgagcgtggaagggggcagtggtcagcgtgttgtagcaggcgcaacatggtgcggaggcgtcccttggatgcacttctgtccctctgtccatcagaatggctgtgcgccggaggtggcgtggattcgtgcacacatcgcgtgcagaggtgtgtctgccgtgccccaatgcctcatctggatgcttggtccctggtgtgagcttgagaagggggtatccctaggtttgaaggctgagggggctgaagctattcctgagtagacttcccctataaagacaccagcatgagatntatccgctgggaatgatgtaggacactacgaggtagtccgctgtgagtagggcttctggaatgggtggaagcaaagcttataagcgccccccctgttgttcagttaagggtaccgggccgtgtgagggctagcttgactaggagaggtgagctctggttgggcggtcctggatacccccgcgtccactatttgcgtggcccccttccgccgttctttgtcccagcaagttccctggtctccacggttaggatgtccgcatcacgttgtccctggcgtgggggatgggaggaccccgtggtagttgggtatggcgcgtccaagccaagagggtgtcctgacacccaactttccgcttaatggcatcgggcacgagcgaatatagggagcttcccaaggggaaggccgcatcagggtagaagtatgtgaaacccaattggagttaaggagtttgatcgtcgccaaggaacagttgtcgaggatgggtgcatgccccgaggcccccattggccccttaacggagcccccaatggtcaggtggggaccccagtaatatgctttggcatgaagatctgaggacattcctcgaggttccgaactgacaaaggctcgcctccgtgccccctggtaacgaaatacgcagggaataagggggacccgagagacaaaggggctcttgaagttcacaacctggacagcccggaaccacatacctagcacacggagacacatttggtggatttggn

SEQ ID NO: 596721 - DNA, 340 bp, Homo sapiens
atgtacacctgcatgagtctattcaagtgtaacttttacttagcctggagagactctatgtctatttgtgttgcagttccactttgatgccaatgactagctttaccaactcgttcttgattggaaactcccttggtgaaatcagaaccagataaggctgatcccttttcctttgaaggtcctgagattgtggactgtgacgggtgtactattgactggaagaaaggaaagaatgttactgtcaaaaccatcaagaaaaagcggaagcataagggtcgaggcactgttagaacaattacgaaacaagtacccaatgagtcctttttcaacttcttcaatc

SEQ ID NO: 596722 - DNA, 255 bp, Homo sapiens
gtgggggttttgccccccccccccccaaaaagggcctcttccttttccggggtgttttttgtggggggggggggcccccccccccccccgtttttttttggggggggggggggttggggggggccccctttttttttttttccccccccccccggggggttttttggcccccccccccccgggggggggaaaaaaattttaaagggtgggggggggaaaggttgggggttttggtccccccccccccccggggga

SEQ ID NO: 596723 - DNA, 1304 bp, Homo sapiens
tctcactgtcgtaggaatacgtagtatatcggctcacagcctcatagtccgtccctacatagtgcctagagaggaataatactagtcgcgtgttcatctatacgctactcatcagtacacgcgctcgaacaccgcactcccctcgtatacccacactacttgctggccgtattgcccagtacctacgctctttgagcccgacctgccgaaaggcagccgcgctgcggccctacgcccatacatagcttcctcacactcgtccaaggcacactactgcgcccctagcacctaacgctacactacacccctacacacccctacctcccaactgccttaacacacctacactcgctcccacacacacactctacctactacaacttaacccacactgaaccacctgcacactttcccacacacaccaaccaccactacccttctccgaactccaaccacaaacacacccccaccatgcccttcacagcactctatccccactctcaccactgcccctccttgcctccccaaacacaaacacaccccaaccccacaccacaccacaacaacacaccaccacaccaccacgcaagagcacaccccccccaccccaccccccccccaacaaacaccacctcccacacaccaccccccccccacagcgaacgcccccagacgcccaccaccaccaccaaccacgacccgcccgcaccaccagcgtcccacacccaacaccacccgtcccccacccctacaagccccagccaccacctagcggacaccaaccgcccaccaccaacagagaccgacgacagaaacacccacaactagccgacatcaccacaccaacccacccccgcggcacaccccaaccccagaccccgcgcccattcgccacaccccaacacaaccccccacaccccaccacacccacaccacgcagccgccactcccccacacaccgcggcaaaaccacaaccaaaccacgggcacaaccaccaacaagccgcgagacccccaaaaacttcccacaacattctactcacacccccaccaccaccaacgcacacacacacacacaccaaacaccaaaaaccacccacaaccaccacccacacaccccccccctccccccctcctccaccccaccccgcccacaacccacccacacccccacaccacccctcaccaccacccaacacccacaccacaaccacacaacaccccccacctacccacccccaccctaccccacactacacacccacacaacaccacaccaccacacccacccaccacaacaccac

SEQ ID NO: 596724 - DNA, 101 bp, Homo sapiens
agccgggtattcaagcttcactcaaagggcgggtattaccgggttattccccagaaatcaagggggattaaccgccagggaaaaaaacattgtggagccaa

SEQ ID NO: 596725 - DNA, 157 bp, Homo sapiens
  misc_feature (6)..(6): n is a, c, g, or t
acgtancagcacaggtatataaactttgatatagcttcagcaatccctagtagtattattttgaagtttcgatctcagctggctggctagatttcctaacttccagctaactctttgtaacttctttttgactgccctcatcctcgctttaagcttc

SEQ ID NO: 596726 - DNA, 224 bp, Homo sapiens
gcacgatcggagatttgatgccagcctggccaacattgcaacaacccgatttctactataaatactaaacatttattctgggacttctggcttaggacagctccctccagctactctggctgctgaggcacaagaatcatttgaacctaggaggtggcggttgctgtgagccaagatcatgccactccactccaggtctgggcgacagagcaagactctgactc

SEQ ID NO: 596727 - DNA, 939 bp, Homo sapiens
atgacacgaggaggcacagggagatgcgcggttttttccgccccccccttgacaagtgggggtgactaagctgtgcctaaagcgtgcaggaacgcagttctctaacagaacgcttgttaaaaaaggtggggtgaccaccacacgggtagggtaacaccacatatgggcgcaccagaacgggggggtaaaaagcccctccctggggtgcatcatttccccccggcagggtagtccgccttcaaagaacggtcctttgctcctcttgaaaggaacctatcggtgcggacttccccctggcggcgcaaacatagtctggcaaaacacacgttggtgcacagccccgcactaactctgtcccagtggaagacggtcgtttaccaagtggggcagaaaaggaccgtcggcgtgcaaaacagcgggggggcacattccaccccgggagctttgatgagctccacattaaaagattagaaagtacgcctcgctcacgggacgtagtctgacttgacctccaaggccgagtgagtgactggagtgtttctaccagtaataagacctctgtttgtaaaattgtgaagcaaccgatcaagcagcgtgccgcccctcattaattcaagccgtggggctcctcacacacaaggtgactcgttcctccccgcatcttcgctcctgattttcttgtctcaattcatggattttttcgaggcttgtatattgccattcacggtacatcatttttcgcttttacccccacaatccaagcaacaaccttgtacctctataatagatccttttctctagcatctgtcttgtatgcccactccccttcttttgaatcaaggcccgaagtcttcttcccttccttccgcgcaggaaagaatggatatcaagaaaaaaaaactcctgtgctccatcccaccgaggcaacaacaaaacaca

SEQ ID NO: 596728 - DNA, 343 bp, Homo sapiens
tgccagctattggcattcacggactcattctactttatatggtgtcaggcttccaatacgactcttatgtatcattcggcagctccacgccactcgcgcactcgatccatctcagtgcatttttgggttactccccatactcctttatcgattgactcttgtccattttttcggcacgttcccttcaccgtcagatttatcgcccctgactgcacatcaggaaagatccaggcatccactacccgcacgcctttcagtccccaaaccattccttccagattgtccaccgtacgctgatctccctcctgccccatgggcgctgtacaatttgcatcgttgtacg

SEQ ID NO: 596729 - DNA, 260 bp, Homo sapiens
gtaatcccagcactttgtgaagccaaggcgggagcatcgattgagcctagcagttcaagaccaaccttggcggcataagcgagaccctgtctctacaaaaattttaaaattagccaggtgtggtggtgtgcacctataatcttagctacttgggaagctgaggtgggaggattactcagcctaggaggttgaggttacagtgagctgggatcacaccactgcccttcagcctggggtgacagagcaggaccccgtctctt

SEQ ID NO: 596730 - DNA, 391 bp, Homo sapiens
tgacactaacagctataaccatgcactggccgtcgaataacactacactagatataaccatgcactggtgcgtcgtttaccacaaacaggtataccatgccacaggccgccgtattaatcgctcagacagaaatgagcatgccaggcgggatgtgacacagtaaggagacataccatgcttggcatgactgcgggcggagcatgctctgacatcgcgtagctagcaggccaggaatgctgctaaacatacgctcaaacataccttctaggacagggctgctgtcctacaaggtacaggcagagcccctgcaaggaagaatcacctggccccaaatgacagtagcgcccaggttgagagcacctgtcctggtgtgataaatggtgcaggggg

SEQ ID NO: 596731 - DNA, 161 bp, Homo sapiens
ctcagtcggctcatgatcaggtaggtggttatgcgaggtcttgatgtaccagtcgaaacgagaggttgcctattgacgtggtagcacttgagattctttcctgagactgccaattgaaccgggactgtcatcactgagacttcatctgggcgcggtacccg

SEQ ID NO: 596732 - DNA, 173 bp, Homo sapiens
ccagtctcatctctggaaagtactgatctctctctccccattctcatgcgtaaaatggggaactaacggcacgctcctccatggccatcagtacgggcacgtgagttaacgctgcagagtgccaggactgtgtgcagcacacaccacgtgtgcaggaagcgctgaatacttct

SEQ ID NO: 596733 - DNA, 508 bp, Homo sapiens
gaagtgctggcataacaggcgtgagccacgcgcgcgactacatttttgtgttatacgcagagacgtggtttcaccatgttggacaggttggtcccctgacctcaggtgatccacctgcctcggcctcccaaagtgctgggattacagacatgaaccactgtgcccggctgatatggtcgtctcttgtaagagcttcagcattacttaacaataacaaatgttctaagtaatggaagattatctgaaaagaaggatttaaactccatctgacttctcagttacatttcacgacatagcattttattctgatcgtggtgaatcatataattaccatttacaccatttttaagagtacagttcagtgacataaagtatattcactgtgacgtgtaaaccagcatcatgacctattttctaaaactttttctaacattccacactgaaactttgaagctgttaaatagtaactaaatatttcccccttgccttcattctctggtaatctcaa

SEQ ID NO: 596734 - DNA, 474 bp, Homo sapiens
gtcgacaatttggataattttgccacattatgttacttatcttttaagataattggttttatttattttcgagaggtttcaaatctatattttaaaaactctaaaaattgggacttcccttaactgatacacataaaatagctcttaataatattgtagtcataccccatttagacaaattcagttgggatagtgaattagtcatgatgaaagaaattattctatagtttttaattgctttcattcatagtgtctcttccaaggattcattaccttctaattcatccatctatccatacattcatccatctatctatccatccacctattttttcattcattcatgaaatatgtattaagtacctactatgtttcagggaatgtgcaagggaatgtctggatgggtgagaaggtgtcataaaagtgaataaatcatgagacttacgactctgggagacagtaagaaaaaatgtt

SEQ ID NO: 596735 - DNA, 555 bp, Homo sapiens
caaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttggaaatttggacttttgtatataaaagtacttttttttggcgggggcagtgggcagctctcatcctaaacaaatgtgttatttggtacctatgcaaagatttggtta

SEQ ID NO: 596736 - DNA, 791 bp, Homo sapiens
tcaccacccagcctaccgcccgacgtggtccttgccctcaccacccagtctagcgcccgagtggtcctttcctctcatcacccaggctagcgcaccgacgtggtcctgtgtcctgtcgatcgacacacaggcgctaggcgtctcggacgatggctccgtgtgtcctgttcgatcacgcacaggacgttgagctggcaggacgatggctgctgttgtcctgtcgaatggaccacagcgctgagcgtgactgaaggtggtctccgtaggcccgttgcatggaccagaatgacgcaggacgtggcgcacgaaaggacgagtcatacgtagggcataaggaccggtcgaccggagaccacttgagggggacgatggaagcgagcgcgccagaaagaccgcgcagcgaagttggccagcgacaggcagttaggggacgcgatcaccgtggacgggttactcacggataggtgggtccacgtgtgaattctgacgcgcgaaagcgggactgtgttgagaggaggggatcgaaaaccgctacagagacgtcccacggggagtgcgcctttcccagatgcaactaatacacaccccggcccaaggggcccttgttcgccccaggaagatgacggaaacccccaaggcgtgattcaccgaacagggccagtcgcccaggaaaaaggcacagacggcccaagtgggcagatgatgcccccgaataggagccggaaaacccccgttgggtacgatccacgaagggcgggacagccgcgccgcgggaaatggccacaggcgcg

SEQ ID NO: 596737 - DNA, 297 bp, Homo sapiens
tcgagctcggtaccgataagggggcaacaaacatgaaaaagtgatcatcactggtcattagagaaatgcaaatcaaagccacaatgagataccatctcacgccagttagaatggcgaccattaaaaagtcaggaaacaacagatgctggagaggatatggagaaataggaatgcttttacagtgttgatgggagtgtaaattagttcaaccattgtggaagacagtgtgatgattcctcaagaatctagaaccagaaataccatttgacccagcaatcccacttggcccttatcgag

SEQ ID NO: 596738 - DNA, 451 bp, Homo sapiens
caaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttgga

SEQ ID NO: 596739 - DNA, 1648 bp, Homo sapiens
agcggactccctccacatcccgcgccgccgccgacgactacctaccacctacctacctacacgacgaccgccagaactactacacaacctaccgagcagacacgcgaacagcaaggagcctacccagaaccacacaaaaacaacgacaacacagaaaagaacacaaaaagaaagaacaaacagacacacacaacaaacaaaacacaccacacaacaaaaagagaacacaccagcacacaacacacacccacaaccacgacccatgacaaccaaaagaagaccacacacaaacgcaagacacgaaagacaccaaagaaccaaaacaacaacaaacaaccacacaatacacagacacagaacaacagaacaaaacacacacaagaagaagacaacacacacacaaaaaaaacaaaaacacaaaaacacaagaaccacacacccaagacccacacgaaaagaacaagaaaaaaaaaaccaccacccaacacgacccacacccacaacacaaaccacaaaaaaaaaaaaaaacaacacaaccaccacaaaacaaaccaaaacaaaaaaacaaaacacaaaaaacaaaaacacaccaaaacaaaacaataaaagaaaaaacacaccaaaaaaaaccgagcacaacaaaaaaacaaaagaaagaccatgaaagaaaaaacacaccagcacaagcagaaaaacgcgagagaacaggaaaaaaaaaaaacaaaaccaaccaagcacagaaaacaccaggaaaaagaagcgacaaaccaaaaacaaaaagaaccaaagacaaccacgacaaccacacaacaaacaacaaaaaaaaacaaaaacagacacacaacaacacacacagacaaaaaaaaaaaacacacccacacaacaccacaaccaagacgcaaaaaacaaaaaaagaacaaaacaaaaaaacaaaacacacgcgagaaacaagacacccaagcatcaaaaacaaaaacaacagacacaaaaacacaaaaaaaacgaacaagaccagaaaagcagacaagaaccagaacaccaacgacaacaacgacgaagcaacagaaaaggagaacaccaacacaaacaacagcaccaaagaaagaacaaaacaaaaaagaaagaaaagaaaaaacaaacaacacaagctagaaacacacaaaaaacaagaaaaaccgacaagacaaaaaacaaaatacacaacacgaaaaacacaaagaacaaaagaaaacgaagaaaaaaacacaaaaaacacacacaaagagagcaaaaaaccgagaaacaagaccaacaacagcacagacacaaaggagaacaaaacacagaccaacaaaagcaaaacaaaaagagagacacaacaaaccaacggcagacagacaaacaggcgaaacgagaaaacacacaaaccacacaagacaacacgacagaaaccacaaacaacaaaacaacagcgagagaagaagaaaaaaacaggacaacaacgaaaaacaaaagaaaacagaaagaaaaacacaacaaaacgaaaacagaaacaacggagacaagcaccagaaacaaaacaaaacaagacacacaacgaaaacccacagaaagaacaagaaaaaaagacagaaagaagaaacaagaaacgcacaaaacgcacacaaac

SEQ ID NO: 596740 - DNA, 627 bp, Homo sapiens
  misc_feature (289)..(289): n is a, c, g, or t
cagtgcagcctggagagcctggaacctggagtcgcagtcggcgtgagacccctgttgtctgtgtgctggagtgtgggctggctgtgatcccgacctctgaccctgctgcctgggggtgggccatggcgtgagatcagcgacctggacctggcatgatctgatgcaggcttgcgtctgcttgcgagctcatcaagtgagagctgaatgtcaaggccctgtgctgctaagtgccatgatgagatcttggtagagtgatgagcaacgtgcagagggtggactcgccagtcanatggtgcggcgacatccatggacattctatgacctcaaagagctgttcagagtaggtggcgacgtccctgagaccaactacctcttcatgggggactttgtggaccgtggcttctatagcgtcgaaacgttcctcctgctgctggcccttacggttcgctatcctgatcgcatcacactgatccggggcaaccatgagcagtcgccagatcacgccggtctatggcttctacgatgagtgcctgctgcaagtccggctcggtgactgtgtggcgctacttgtgctgagatcttttgactacctcaggctgtcgccatcctcgatggcaagatcttctg

SEQ ID NO: 596741 - DNA, 184 bp, Homo sapiens
tgggctcagtcgatctgtcaggactgcctatttcaggacgaagattatgtattatatgtggctatatttactagagcacctgtgtgacctctttctaagccaggtactgtctggatgacttatgcggtgggggagtgtacaccaagaacttttcatctattatgaaggcgacttaaactgtgtc

SEQ ID NO: 596742 - DNA, 102 bp, Homo sapiens
caatataaggttaaaacttatataagtaacccttcccttatcttgtattttcaattttttttaaaactgcttttccaaatatgagactatgttaaagcccct

SEQ ID NO: 596743 - DNA, 423 bp, Homo sapiens
cggggcagccatgtttgccatgatttcgatgccgcgggctatccgtgcggcggtgacagctatgtctggacaacacccacgaacactggccatcggatttgagaggcttgtctcactcgagacatatacgaaagctgctgctcctgttcgacacagcgtggaccatgaggactatttgtgatgagaccttatagagtctacgacaggcggtctttgaagctattgagattatacattgcattgactggcattccagtagaaagttacataactctggagaatgtattcattggtcaacgctgactagctgaaattccagaaggctatggcccataacactgcgactattataagcatcccatagtaagatggattgccagaatttctatgaccgacctgcgtattacgaagactgccgccccc

SEQ ID NO: 596744 - DNA, 286 bp, Homo sapiens
aactgactcagcactaacattctagtttagtttttttctttcaagagcgtgtctcattacagattattgtgaaataactataaggacttgattttttacagtattgtcttttagacactacttgagaactaggtacaacatacatcatcagtcacagtacatttatatcttgaggctgcattttgagatgagaatatgtactgtgatgtgtactatcacctttgtgtttctcacttgtttgccatggcccagatagctggtcttggctttactttgctgatgtgtt

SEQ ID NO: 596745 - DNA, 636 bp, Homo sapiens
ttttgtagtattccattaaccttatttctcctttattttatttttattttcttcttttttactttttgttttttcacacatttattccagtttattatttagttggtaaaatctaacaccgccacaaatcctaacctgtgttgaatgggtcttaccttctgggaacaaaaacctgactcgtatcaactcctctggtcgtaggttgttcggggaaacggagccttaactttttctaagccttctgggtccaccctaatttcggagcctctatttattgaactttggggaaatgttccataaccctccctttgggaattttgggccccaaaccccaccaattggaggggggggaaatttttgggggggggggggggaaaaaccccggggccctccggggggcccaacaaaccaaaatttataaaaagttttttaagggtttggggattttttccccacaaacccctgtgggaaaaccccttcttttttttacccccccccctccgggggtttttttaaaaacacttttttttcccaccaaagaaattatctggttataaaaaagggaaattaatacccaccctcctctttttttttttttttatagggccccccttttttggggattatctccccccc

SEQ ID NO: 596746 - DNA, 168 bp, Homo sapiens
  misc_feature (27)..(27): n is a, c, g, or t
ttaaggagaacaaggacccactcgccncctccaatgtgtatccctgaggaatgttgtagaattccgggcagccccccaaactgattccatacagtgtagtaagttgaggaaggcctcatggcattgtcaatgtctccaatgaggctctgaagaccgggccagtaggcc

SEQ ID NO: 596747 - DNA, 152 bp, Homo sapiens
aagctaataccttggcctactggtgttcagttacctgaaccacatcgggaaccttaagttgtagtaaagacctcgggacatggttgcacaccggtgtataagacagtcttgggacacactagtaccagacctagacgttgagcccggtccgg

SEQ ID NO: 596748 - DNA, 371 bp, Homo sapiens
  misc_feature (194)..(194): n is a, c, g, or t
  misc_feature (277)..(277): n is a, c, g, or t
agagaaagaaatcacatatgcaaaatattaacaactgcatctcggtgaagaggatatgagactcaatttcttgtaagcttaaaaattttcaaaataagttggggaaagtaataatagagaaagtaaacagttcaagaaaaacaaacactattttatgcttattaaaaccagttccttccacctcactgtagttntgtgtttttaacttccagtgcttgcaaggcatgggggaagctggtaccagtgaattacccagtggcatgacccatgggctaanctggacagggccaagcatgcagcaaatgcttaatcaaacatggaaaccactttccatgctggcttgaggcggcattggccctggattctttttc

SEQ ID NO: 596749 - DNA, 180 bp, Homo sapiens
ccgggtacggggcaggcgcatcgttgtcactgacatacccttggagacgggacgctgcgagtgccttgacctggtgcagccctggagatcgtatcgtagcgctaggccccccacatgcgggtgcgccctaactatcgtagtcccaataggtagatagcgtagtgacacgatgctactata

SEQ ID NO: 596750 - DNA, 290 bp, Homo sapiens
  misc_feature (48)..(48): n is a, c, g, or t
  misc_feature (65)..(65): n is a, c, g, or t
  misc_feature (71)..(71): n is a, c, g, or t
  misc_feature (85)..(85): n is a, c, g, or t
  misc_feature (88)..(88): n is a, c, g, or t
  misc_feature (100)..(101): n is a, c, g, or t
  misc_feature (110)..(110): n is a, c, g, or t
  misc_feature (115)..(115): n is a, c, g, or t
  misc_feature (245)..(245): n is a, c, g, or t
  misc_feature (281)..(281): n is a, c, g, or t
ttgtgtcctggtatttttggtactcggacaccaggtcgttcatgttgntctcggcctcggtgaantccatnttgttcatgatctngcncgtgtaccagtnnaggaaggcnttgcnccggaacatggccgtgaactgctcggagatgcgcttgaacagctcctggatggccgtgctgttcccgatgaaggtggaggacattttgaggccgcggggcgggatgtcaaacacggccaccttcacgttnttggggatccactccacgaatagctgctgtttttgntctggatgg

SEQ ID NO: 596751 - DNA, 1444 bp, Homo sapiens
gccgacgttgccggacctccagcagcagtcggtcttctctacgcagaaccctgggagtagtgagactcacgaatccgaatcctcttcgtccctcacccttcttgtgagatttctttcttgatcttcacgctacgattcttcggtgctttggatgagaaaccttaccagtcaaatcacagatgggccaggcagacgattaccagaacaagaacagataccatcggctaccaatggaacatcgccgatgttatttcacttggagagatctgcaagcactccttgctcgtgtcaagcaaactctgactgctcggacggcaagtgcgttcttgcgacagtactggcagacacttgttgtcggcggctgactcgtgttccactaaaggggacttttggccgtgcgcattcagctcagtgttacaatgacgtacgaacactgcccggcagctggctggtagcagggagcaggactggcagaagggactatgctgggcccaagcgctcttgtacgactaatctaagcctggagcgtgacacgaagccccagagatggacacccggacggcacacagacgccacgagctgatgaaaaccagaatctcgcaggcggagagcatcggctacggggatcgacggaacaccaagaacaggccctttgggtcgcaggacaccgcagtctaacgtcaggcgtcccttccatttttgaagctatgagacgctatgcacgtttcaacacgcggcaggtaaatagatagagtacgaggactggatagcaaagaaaaccgcagggcacggttgataccctgcacataccttcgctccctaatgcggcatccggggccgcgaaagaaggcacatcgacacacacgaaaaggacggaggacatccacggggaagcgaaccccgcacacgacacagagggcacaagaacgagcggcccccaactgccaaagacagcggacaagcgagcggaatccgtccccacgacacaggcaaacaggaccgacaacgacgagaatgacacccaccaacagggcacacggcagcaacaggggcgtgcatagacccccagtgacaagaagacagacacaagagggagactacagcaccagcccgtgagaaacccggtgtagcaagcacagtgcgacacaggagcaagcgccgcacaaccaacgcaacgctaccaaccgaaacgactagtcagacactaaaaagggagcaaagcagccacgagcccccaacacagaaggaagagagacaagccgacacaagccagcaaggaggagccaaaaacctccagaggagcgcgggaacagcgccgaacacacagacagaaaggagccacaaacgagacacacacgagacgaagagcgtgcagcagcgaccaccgaacctgaacacagccacagcaggaagagaaccaagaactaggcagaagagcagcgct

SEQ ID NO: 596752 - DNA, 222 bp, Homo sapiens
  misc_feature (142)..(142): n is a, c, g, or t
tgttgtgactcgaaaagtgatgaggggatcaggctgggagagcggttctgagctgcagaagtcgtcgtgtgctgagcatgggctcaccttggagtcttcttgaaggcatagatacggtgataggacggttacagaggtactngccattcatgggttcaattgctgcatccgaagcatcaaatgaagcaaaattaatacaggcataacctttggagtttgctg

SEQ ID NO: 596753 - DNA, 1061 bp, Homo sapiens
  misc_feature (758)..(758): n is a, c, g, or t
ccgcttatgtcctggtcttgtaataataagcggtagagaggagagctccccctaatactgttcttccatgtgcagtgcccagttgttcatgtactagctataagatcacacggtccatttgagttcacatctcgtaaaggggtgtacaccgcagtgtgagtataagcttgacccttagagctgggcatgaccgagatgagttgcatgatgcagacttgggagtagggtaacccctgggatcccctctgctcggtaggagcgagctatattagattagatagaggcgaagaggactacagtcatcccagtttactaaatgatgcgagagccctctaattcatggcaaatctattacaatgaaacgtggagtatcctatacccttggataatatatatgcaaccactatgtgttatggaagcatcctgggtctatatatcacacccagtatgcttagacttgtaccagaccgtgtgtaggctctgtggcaaaccaagcccggcaaggtgtgagactcttttggttgtgggccccctactaagacgggcattgcgtaaggaatacgcactccgcgcgtagataatacacccattatgatgtggtaaaagcgacatgatccaccatggccgaaaccgagcgaacagcaccataccatgatgcgcattcggtatacaagatttacgtggccatggctgttcttgcgacaaccaagtgtgctctagaggcggcgttccccacaaaaagacgatgggggggctgngaggctggctacaacacgcacataacgacaatttccgtaggcagggcaccgcccaatataggcccgtgcggggtttgaaaatcgcccgtataaaaaataccgcgacagtgggggacccacagcaacgataaaatcttgctcggagcaatgacaaaacgcaaccgccggataaacaggcccatctggtatttggaggagacacacaaggggtcgacattgtgtcccacttggagacgctcggagagcatatccccctggaaggcctcttcctccgtagtgagctgttgcgccctcttttcgccg

SEQ ID NO: 596754 - DNA, 304 bp, Homo sapiens
gtgggtagtgtggtgccgaaagacaacttataaagtgaacatcccaatggacatgctgaccggtagataagaaatagttctttgtgtgtgaagccctttagcagaagacatctgttttctagcagcttctggccacttctgcatcttcagggtgtcctgggcagggagttgtgtcttccttatttcaatttgcagttagaaaagctgggagaatgcttctcaatgtgctgggcacctgtactgcatgaatatatgttttagtttatgtttatgcatttacagttccacacccgaacaggaggag

SEQ ID NO: 596755 - DNA, 279 bp, Homo sapiens
gagaggggactggagtagttattcccttcggcaggtactgatgagggttctttgttgaaaatgctcaacttgtcgtactttgtagagttagtaagtgtcatgagtggagaaaattaagtgaaagttatgaaaatctaaagtaatatcccattttacaaagggcactgctgtcacctttgatttacaagaaaaacttctggaagaactactacacgtgggggcaagacacgacggaggtatgacccaagacagtgaaatgaacccgcagttgaaagaccg

SEQ ID NO: 596756 - DNA, 285 bp, Homo sapiens
cagagatgatgccacggcactccagcctgggcgacagagcaagactccatctcaaaaaaaaaaaaaaaaaaggttgttgaattcgggcggggcttttaaatttccgggcccgggtgatttcggtacctctgtgggcaccggggttactgcccttcatagggctctgcaataaccctcttcctcaattatagcattgggccattgtctctaaattctctttaccaaggttttaagggggccgtgtaagagctttcaccatttggaacatgtacaccctgcgggtgg

SEQ ID NO: 596757 - DNA, 298 bp, Homo sapiens
ccgagcatcagttctgcgatcttcggattgcactgtcttgtggttcttcgttatggactctacacttgttgtgaacgaggatcaagccatcgaagaagttgacattgaaaaataaacctgtgttgtcatttatgatgagtatgactggggatttgaacatcaactcgtggagaaggatgacctccttctatccgtgcctcctcctctgtttcctgacatcttttgtgattcttctatctctcattttccttgtgtaaatccttccatggatgcatctgctttcgatcattcgtacaac

SEQ ID NO: 596758 - DNA, 1076 bp, Homo sapiens
catggctgactcctgtacgtagtcacggtcttgtgctctaaggaagaacagaacagcacgtgttcttattcagcatagtagaagtgacgttggtttcttgtaggactactttgaagtccatttggtaagtgttcccagtggagagcaagatgacataacaaatcgggctcccttatttctgggaacctattaggacaagtctcagtacacttagatctgtacaacaaggcatgaagctatgagcgctatgatgtgttagggcacgtttgcacaatccgaacaatatagtaacatgtcgaaactcgtggcatactattgttacagtaaacttatcaataacgagaactgcaatcaaactgaatactcgagttcagcattagtctccttctctaggtatgcgatctccatgttctctagaaatcgaggactggtgggggcgtgttcgaacacagaagcgggcgagtacagacgactccttaacaaggccgctatttacgtacatctcgcaacaggacttacgttctcagtgctcaaaacatggactgctctatgttttatgcaccttcgataaggccaggtgctcgtgtgctccccgtgtttgcaattaagattcctggaatgcagtgggatacttcgtagatgacacagattacaatcgcgttataatcgatggaatgttctccatatgagagagtggtatctttatccagagggtaacacaagaatcccaaagacgcggtattcaggccgagttagagaaaaggtggatcctagaagggacacctggtacatttctcccttgatcgttgaatcgtgggtattaagaatagccacgttattgccgaaacaacggcagggccccgaaggattgttccccctacacgtgaggcgacaccctaattgtgtacaacctcagggcataccttggtgtggacaaatttctgtggcatacaaaatgcacctgggtcctgggaggtgatccccaagaaaaagcacggctctttgggaaacacaaaagccggacatgtggagttggttgtaaagtcgcagatccctttgcctagttttaacaatca

SEQ ID NO: 596759 - DNA, 239 bp, Homo sapiens
cccaacatggcaggaaaaacatattaaatagccctattttgtaaaaactgaattttatccttgaccttttagcttcttgattaaaacttaacctcaaactgacacaccaccaccaccattcccatcctcgtgtgtgtgtgtgtataaaatcctaaaaggaaaatagtctctataaagtagtgcttaccctacacattttcagacaaatcctagaagttattgtatcctataatcaaaag

SEQ ID NO: 596760 - DNA, 361 bp, Homo sapiens
  misc_feature (261)..(261): n is a, c, g, or t
  misc_feature (304)..(304): n is a, c, g, or t
  misc_feature (319)..(319): n is a, c, g, or t
ccacccccaatccttccactctgcataaactttaaagcctcacttccaatgccttctccaagctagatgtgctaagaccttcttgatcttataccgccgtcatggactcctgagatgagggtgtgacatggcggactatcatattatttatttataatatgaaatatatctgggctttgtccctggttcctgacacatcccctaaaacccttgaatttcctgggttatacgtaatgggtctctttgtttacacctgatttnataataaggaggtgactcacgaccggggccctacataaccttnagattgggccattcnccacagacaccaattgattggaagattggaactttcattccc

SEQ ID NO: 596761 - DNA, 1229 bp, Homo sapiens
  misc_feature (268)..(268): n is a, c, g, or t
  misc_feature (623)..(623): n is a, c, g, or t
ggcggtgtgcgtgaactctctgaggaaccaaaccatcttgattattattctcagacgctgcgtgtcaccaagctgactagaatacctaaaaatccaggactgcttggagtgctcctggaggaccatacctaaggtcgccttcacagatatggcaatcggaaaggtcgtctgtgctgggggttaccacttcagatggccgtatagcgattcagtcattgagttggttgttgagacaaggccacacggacatggaaactttgttgcgcangtctcgagtccatggtgggtccacaaggactcttggcttgtagaggcgcattgcacgaggcgccttggagtcggccattttatttggacgcctggaccccctttggtggaaggcttttgggtccttgggcgcccccccttatgggtggggccaatgcctttctttacctcgcttactctcacgtcgttttctaatgtggcgagcccatattgcacagggccagtacagacaagcacaagaacactcgtgtaagggcgaatgcgttgctatgggccgtgaggccccttttctaacccatgtctcatccactcgtcattgggagtaagaattgccttgaagttgaaagcggggaacnaaaatccaagtcattgtcaagcccttagaggacggaacccttttacagcaaaatggccttggttggccatttagagaaatttggggaaacctttttggaacttcggtttggccttccccgatttttgaccccccaggcggaacagaggtttccgggccccccccccaaaggatgaaaggcggtttgggcacaaaacccgttttccacgaagggttgaccattggggacatttttaacccgcggaaggagggaaacaccttccgtttccgaatttcccaaggagggaaaaccctttttcgatttgagggaaaacccttgggaatacactttgagggatttacccatatgggggaaaaacaaagcacaaaggtgtgtccccccaaggggataccgattgtgtttaaccttttccaagtttttttccacaagggaaaaggcccccagtgtacaacaggcctaaggtgccattccgaaatgggcccccccagagtggaacgcctagaaagaggaaaaaaggtcggaaaacgaagggttacggcaacttgcggaattttgggaaaggccaaccaagggacagtggtgcacaggtaaaggccaaggggccgc

SEQ ID NO: 596762 - DNA, 212 bp, Homo sapiens
aggtttcaaatgccagtgaaatgtatacccagaaaaatgatggaaaggaaaaggaacatgaattacatctggatcagtcccttgaaatcagcaacacacttacaaatgagaaaatgaaaatagaagaggagccaatgacagggtagggagatgaccagtggtgcaatgatgggagatcatgaagtctgggaagcatattgacccagtgggaa

SEQ ID NO: 596763 - DNA, 430 bp, Homo sapiens
tttagagagttagtgtgagagagatagagagagagagagatagagagagatatagagagagagatcgagagcgccatagagagagatttagtgtgagtgtgtgtgtgcctcttcggtcacccccttttgttatattctttgattattctccttcttatgtttttacctttttttctctcttatacccttcttctttgtgccctattttcctactctttttgttactttattttctgttctcctgttgtcactgcttctttccctttttcttttcttttttttttgtcttttctatttttttcctttttcttttccttttctttctcttttctttccctctctttctttcttccctttttttctctttttttcttttctctttcttctctttctttttcttctcttgtctttttttttctcccttttctcg

SEQ ID NO: 596764 - DNA, 390 bp, Homo sapiens
  misc_feature (143)..(143): n is a, c, g, or t
  misc_feature (166)..(166): n is a, c, g, or t
  misc_feature (179)..(179): n is a, c, g, or t
  misc_feature (190)..(190): n is a, c, g, or t
cagtcctacggtgagtgcgggcgatctggtcctgactcgatcggtcagtgatctctgctcagctccgagtagtgggattacaggcaccaccaacatgctggtaattttgtattctagtagagatggggtttcaccatgttgancatgctagtctcgaactcttganctctagtgatgtngccacctcganctcccaaagtgctgggattataggaatgagttatgcacctgggccctctgagcttctttatgggcatcagataattgtattttattttaacagtagttttatttctctgattatagaggtatttatgtcaaaaaattggacttggacactactagtatgctacacttgttgatgacacaagtgagtcttttttcagtgag

SEQ ID NO: 596765 - DNA, 672 bp, Homo sapiens
gtatcccctgtctctaatcatgtttatgagcggcggctcatcgagaagtacattgcggagacatggtaccgaccccatcaagcaaccaggcctactctccgaggcagcagctgcatcgactatcaaagttgctcacccaatccggcccaagcctccctcagccaccagcatcccggccattctgaaagcttgcaggatgagtgggatgcagtcatgctgcacaggtttcactctgcgccagcagctgcagacaacccgccaagagctgtcacacgctctgtaccagcacgatgccgcgctgccgtgtcattgcccgtctcacgcaaggaagtcactgctgcccgagaagctctggctaccctgaaaccacaggctggcctcatttgtgcccccatggccttgttgcccaaaaggttttccccaaaagcgaaagtttgtttgctggggtgccgggtgagcccaatggattgagggtgagctggtgggaatgaccccagagagtctcagaagcttcaagacaaagccagctgtgctaaccacggagcgcaagacgagagggaagacttgtgcctgaggagctggtgaagccagaagagctcagcgaaataccggcaggttggcatcccacgggggggttgcacaggggccagcattccgtgggaatcctgggcc

SEQ ID NO: 596766 - DNA, 170 bp, Homo sapiens
tggtggtgctggtgggtctacatgattctctgcatcctgaggatcggctgggctcaggatgaacctcttgcctcatccctgtcgggctagtgcggggctgtcgggctagtcgggggtgtcgggctagtcgtggctgtcggggctagtcgggggggtaccgggctcgagtt

SEQ ID NO: 596767 - DNA, 461 bp, Homo sapiens
cagtgcttggacggaacccggcgctcgttccccaccccggccggccgacccatagaccagccctccgtcacacatcattcacctgcaacccatcgagacatgcacccaaaggccccctgcctgccgcgtccacgcgacctgagcaagccacacgccgcccgccctgccgcacttctccattaagatcggccagccaatagaccgaaccagccgatccaaccatcgcacagcgtgcagcccacgaaccgtatccaccacacgagaacctcaaacaagagaccacgacccactcaacccagcccacgactccaaacccttggagacatcgtaccgacacaatcccgatacagaatttataacccaatgtatcccacttcatccatttaacctacccttttcgaacccgcacgcactgcacttctgcgccttttcgaacccaaacatctctgacccaacactaa

SEQ ID NO: 596768 - DNA, 251 bp, Homo sapiens
tctagagcgatcccgttcgcagcaacaggattgaaagcatgcattggacttcagatgggcagcaacagagagggcctacccaggccaggacatggacaaggctaaggacagaactcggcaggatcatcagattagagcggagagggctagccctgaagcccggccctcccccagctccttggctgcaagccatcccgcttaaactgactcacaccacacacgtgataggtacatttcagaccacatgagtc

SEQ ID NO: 596769 - DNA, 621 bp, Homo sapiens
gatagccggtcacatattgctcacacgctccaccacccacacacctgtgtttctgtctcttcagagaacattccgggaaatcacgctcctccaggtgagtggcctgggccctccagtccaatccccttgcccaggtacagatctctccagacaggagagaaactggccttcttgggccccagagcacagcccctcctggccttccagccgcctccgactctctccccaggagtttggggaccatcccaacatcatcagcctccttgacgtgatccgggcagagaacgacagggacatttacctggtgtttgagtttatgggtgagtgaggccccggccagcgccccagccccacctctgttctgtcctgacgccgtctgcgggtccctctgcgtgtccctctgcgtgtccctctgcagctggcccacagtggcttgctccctcaccatgtaccctggactcagggacagacagctgactagtgtcagcctccagagccagcagcgacccctttcgtcccacctgccccaggctcctgctctgaccacagtttgcagttgcgttctcctttttcttctcattttatgaaacaaaggcaacatgaaataaagtgttaaaactc

SEQ ID NO: 596770 - DNA, 576 bp, Homo sapiens
cgactcaacagtaaggcccgcgggcgtcctggccgccatgtgcaccgtagtggaccctcgcattgtccggagatacctactcaggcggcagctcgggcagggggcctatggcattgtgtggaaggcagtggaccggaggactggtgaggtcgtggccatcaagaaaatctttgatgcttttagggataagacagatgcccagagaacattccgggaaatcacgctccccaggagtttggggaccatcccaacatcatcagcctccttgacgtgatccgggcagagaacgacagggacatttacctggtgtttgagtttatgggtgcccccccagcccccaccccgactgcgtgcgcaccctctctgcgacctgacctgaacgcagtcatccggaacgggcggcctgctgcaggacgtccacgtgcgctccatcttctaccagctcctgcgggccacccggttcctccactcggggcacgttgtgcaccgggaccagaagccgtccaatgtgctcctggatgccactgccagtgaagctgtgtgactttggcctggccgtccctgggcgacctccct

SEQ ID NO: 596771 - DNA, 178 bp, Homo sapiens
gaaaacacacccttacatatttcatctactcagtgaagaatgacaagaacaaatcacatctcaaggttgatagtggtgctcactaggacacgtggaattgagactaataacttggatgttaacacgtgtttacctgtcttttcacatgtacaaatcgttcttctgtgtatctttttct

SEQ ID NO: 596772 - DNA, 1722 bp, Homo sapiens
  misc_feature (370)..(370): n is a, c, g, or t
  misc_feature (1102)..(1102): n is a, c, g, or t
gatggaggagggtaggccggtacaagggcgccggtgcagccccagcagtctccaggcgggggcccgcggatggtgacggacggaggaaggcctgacgccggcaaggatgcggcgggagtgcctggcggacaacggacaatacgaacacggagctgtctgacacgaggactaaagcgagcgttcgaagatgaagcgtggacgatgctcgtggatacgagctatggggagacaggtataccatcgcctggtactcggatccgagtcgcatgggacggtacgattgctgcaaggggtcacgcatttgcaggtgtacgtatcattaactacatctttcctattgcatcgttcgcagtttgaccgcgaaaagtcncatacatgcaatacaattttgcattgtctggtctccacctagcgtaagtgggcctacataccttcgacagggggatagaatcgttacttgcaggaaaagcaattgagtcgctctcatgtggggcacagcatacgtcacaggccgctttgttgggcctgggctgaaactagttcaatcattcgctgtcttattggggccctattggatctcgattgaatgcgtggtggggaacgtcgctgaatgttggccatcgaaaggtgatctgggcagtaaggttgaggagcttgcctcacgatgaggcgaaagtttgggccaatcagttgcgagtgtcgatggagagtactagttcatgggctagttcttgggcgatggtgatcacaatgtaggctacacggaacgtggcaagggacgtacttggagtgaagaaagcaaaaagaatcgtgcttcccaaggcccgcgcgaaaggacctggtccttgcccattcgaaccttacatgtgagtgtgaccaacggtgaaccgcgatctggtccgcggccccttctatttgtagaccaatggtggtaacccgaaccatactggttcccggcatggccaattgccccgaggcggttggacggcaaggcggtggaattcggcaattgtgccacgacacaacgcaaggactagacgcattgagaaaacaaattgcttggagtccgaatggaggtggcgacatttggaactaggatcancacatgtgaccatttgattgtaccacacacccggtgtcacattggcacccgggtagtggaattgtgcagacctgagaggaaactggcacgagttggagcgaactaaacagcgttatcggccatgtaaaaggagacctgtcacgtaaatatgttcaggtcgccccatttaaccgatagtaaaatacgtcttaccacagtagtgcattagcgagtgaataagccccagcgaaagagctatttgcgtagaaggacgatgaaccactggtgcaacactaccgtcgaaaagatacggctccacatatagacaagcgaacgaacatgacgagtgactggaacgcttgggctatacaaaaagcccagatctacgacgaagactacttgaaagacacatgatgcgacataacagacgccacgacacgagtgtggggacacaaccagtatagcggcaccgacgccacgatctaactacatggcagacgcacgacgacgacagacgaacacatagcgacacgaacaacagccgagcatatagatgacgagcggacgaacacgtacgacatgacgacgctgacggaggagggcgaccagtgctgacagagtaacagagataaatgaggagg

SEQ ID NO: 596773 - DNA, 463 bp, Homo sapiens
  misc_feature (125)..(125): n is a, c, g, or t
  misc_feature (220)..(220): n is a, c, g, or t
  misc_feature (236)..(236): n is a, c, g, or t
  misc_feature (299)..(299): n is a, c, g, or t
  misc_feature (303)..(303): n is a, c, g, or t
ggcacgagcttaaaccatgtagtactttactagaaaaaagcagagtaagagaaactaacgttgccttagcttcagccattcaaaataggacagtttcttttttccattatgtaaaggaatccagnagtatatcgcaataacagggaataaattcttacaacaggaatatacaacaaacattttggaaatttttttcatctactggattttttatattaanacaggggattttttanggggaataatttattacaccacaaggtcaattttaatggtaaaccaaaaattgggggccaatnggtntaatttaccctttttttttctttaacttaaaaaaaaaaaaatttttttttttaaaccaaaggaaaaaaactcagcaaaaaaatggcaatttaatttttggcggggggggcaattccattttccattccccgccctttctggggtttgggattttttttta

SEQ ID NO: 596774 - DNA, 338 bp, Homo sapiens
aggaccctcactacgcctccacctctctctacagatgcgacgactgctgctgaagctcgcagctgtagcgctcattgcggggctacaagcgtccgcacaccgcctagcgcttcttgacatgtgccgagtgcgtgaataactccagcaagagcacacacctgagaggatacatcaggcgtgcacttcggtgagcggccattctcctgtgaggagttcgagcctcggttctaacagagtagtcatctggcggcgcatctagaccaccacgcccccgatcggaccttcgcttgacccgactgcggcggtctttcgcgctgtccccgctgtggtgtcttctc

SEQ ID NO: 596775 - DNA, 422 bp, Homo sapiens
gcaggggcaatgtgctgaaccatcagatcaggagcagatagaaagaggacctgtgggccatgcctttattgagctatgggggttacccgttaggctttcccatagaggttattgattggctaatttaaagacaacacacatgaagaggggagcttattcccatgactctggtgttgacattaggttttgtggtactagctgtgggtgtgctgagctgtagatcagtaagatgagaatcaagcagattaccttacaaatgaccacgtggggagaggaagatttaactgggccaggggtgagggcagggacctatgtcagtcctaaagtagatgctgaggcagcaactatgtgaaacacatttatgacacacatgctcattgcagatactagtaattgatgatagcattatttcaaaatgagac

SEQ ID NO: 596776 - DNA, 325 bp, Homo sapiens
gatcttcgcatcttcgtcccatcagtctggtggagtcaccttccaggaggtatgggagacaggtaataggtttttaaagtgtctttgtattctttcttgtgaccaatcagattccttctcccactttcaatgccttgagtgtcaagctttggatgaccgaccctatgtgggcggttgtgtggggagtgggtacttgtgagcctcggacacactgtaaagtgttcacagtgttaggcagcaccagctgggtgaggggcactggcagcaggtaaggggcctggcaaatggccctgcacagcacaacttgtgcctgatgggcagcaaa

SEQ ID NO: 596777 - DNA, 846 bp, Homo sapiens
  misc_feature (15)..(15): n is a, c, g, or t
  misc_feature (138)..(138): n is a, c, g, or t
  misc_feature (140)..(140): n is a, c, g, or t
  misc_feature (159)..(159): n is a, c, g, or t
  misc_feature (170)..(170): n is a, c, g, or t
  misc_feature (190)..(190): n is a, c, g, or t
  misc_feature (202)..(202): n is a, c, g, or t
  misc_feature (206)..(206): n is a, c, g, or t
  misc_feature (247)..(247): n is a, c, g, or t
  misc_feature (254)..(254): n is a, c, g, or t
  misc_feature (314)..(314): n is a, c, g, or t
  misc_feature (474)..(474): n is a, c, g, or t
  misc_feature (505)..(505): n is a, c, g, or t
  misc_feature (508)..(510): n is a, c, g, or t
  misc_feature (617)..(617): n is a, c, g, or t
  misc_feature (619)..(619): n is a, c, g, or t
  misc_feature (624)..(624): n is a, c, g, or t
  misc_feature (655)..(655): n is a, c, g, or t
  misc_feature (666)..(667): n is a, c, g, or t
  misc_feature (670)..(672): n is a, c, g, or t
  misc_feature (737)..(737): n is a, c, g, or t
  misc_feature (793)..(793): n is a, c, g, or t
caaatatcatcccantttaattcaattcttttatttatcccacccttccctacatcatccctttaactcataatatttttttattcttccatttttttctacttttcatcacactataccaactttttaatttttaananttattctattttccctcanccatccccaantttacacacattcatatcanccctacttttantcanccatcattccttactttcatttattacaattttcatttacntaaatcnaactttattttttatcctaattcctctcttcccattttattacccttttcaattttaaanaccatttttatttatttttttcattttttatcctctccacaaattttatccttttctccacatccatcccctttcatatttttatatatttcataaccaaatcttctcattaccctccatcattcaatattttttcatttttatcatttacttaaacaanacatttttttatcttttccttcactcagaancannntccttaagtaagctttaatttcattatttatttttttttaatattttttttttcccctcaaccatacaattataatcatcctccaccttaacttcccacccccagtnanttctncctcatcttctttactaaccccttgtagggncaaaactcctnnaannnacagccccaccctgagccagcttcacttgagggtatagtagtttgtgggcacaaagggcatcttnctgactacagccatctgctgcttccgccgcacctctaccagcagcattgtccctgnacgactgttctcgcagggcacataacccatcgccacattcttcttcagagagg

SEQ ID NO: 596778 - DNA, 140 bp, Homo sapiens
cacgaggttttcccatgtcctgtattttctgcagtcattatggtcactgtttagaggtcaccttcaaaggtggctgcaacttcatatttggtctccacgaccaccttggcagtgggtcctattattacgccatttcacac

SEQ ID NO: 596779 - DNA, 250 bp, Homo sapiens
  misc_feature (99)..(99): n is a, c, g, or t
  misc_feature (130)..(130): n is a, c, g, or t
gattctgcgtattaatgtgcttcataagatctatcatgctgcttcttatagtacttacaatatatgcaaggtcagtagaagtgtgcatgtatatatgcnttgatcattcaaatggctaagattgaaaggngaacgatacccagaatttcagtagtttgctagatgcagagtatttatctaccaaaagcctgagatttctttacatgaattaaaaagcttccattcgaaagggtaatagcgacagcaggca

SEQ ID NO: 596780 - DNA, 190 bp, Homo sapiens
tgcagcggcttcttctcctttagtcttgtggtgattcggagctggtgtctacggctgcgtctgacatgtggggcacgccggtatccgatcaggcgattaaaaagaaagcgagagttcaggcactctggcgataagctgccggagtccgcggcggcggaggaggcgcgcggcggaggcggctgcggcgagc

SEQ ID NO: 596781 - DNA, 168 bp, Homo sapiens
agtgtctggtcagctcgatatcagtcatcactgaacatatcactgtcgcattaagggggcagagctgagatacatctggtacagaagcttgggaggagcttgttcaactcaaaaacagatgggtgaacccgtggcccagagcccccagcagggccatctaaggtagag

SEQ ID NO: 596782 - DNA, 284 bp, Homo sapiens
  misc_feature (50)..(50): n is a, c, g, or t
  misc_feature (152)..(152): n is a, c, g, or t
  misc_feature (218)..(218): n is a, c, g, or t
ccgttccgagcccacacagtctgtgtcagctcaccagagcccccacccanactcacgacccattgttaattaagactgtctgcattatagggctaattaacaattagcataaacataattagccagggctgacatttaactcattacattgnttaaataattttcgggaattgccccagcggcattctgtcagctcgcaataaaggcgccactttggnatgtaaagtaaatgacatttgtgttgttgctgtcccaccgtgggagacggtcggccacatcccacc

SEQ ID NO: 596783 - DNA, 196 bp, Homo sapiens
acttagaggatcttccagaaggcacaaggaggtacgagaggaccttcgtctcctgaggatgacttggaaggagattgagcagaagtacgatgtggagaagagatcctgatcacggtgctgtctgcatgacagaggaggcagtgttgcaatcaaggccatggcaaaataactggctcccaggatgggggtggtggca

SEQ ID NO: 596784 - DNA, 328 bp, Homo sapiens
attacgaaccgagctggtaccctcggataaggccaagcgtgcatacgacgtcgcgtgttgatccgttcgagtgtcgggtcttccgtatcatatgtgaagcggaattcagcaacgtcgttggattgtgcacccactaatagggaacgtgagctgggttagaccgtcgtgagacaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgaacgcctctaagt

SEQ ID NO: 596785 - DNA, 287 bp, Homo sapiens
catcctcagacagcggaccccaaggtagcagagagaaaggacgagaggaactgaggtcaggcgaggaagtttactaacctgccggctgctccatcacagacagaggaggcagcaccaagcttatggaatgaggggtttatattgggggaggggagtttgagggagttctttggtatggctgcatcccggggttgtttgctggttaattttgccacatatcaccttgtggacgtttattacaggagggtgtaggtaaagtttgtttatgcttcctacgacctccccct

SEQ ID NO: 596786 - DNA, 643 bp, Homo sapiens
gtggtgtggaaacttaccggctgagccatggatacaccgttaaggcgcagccgacggctgggaggcctaaggcccgaatcccccgagagcctcacctcagtttctgcggacgagacgggcccttgtggagttcgatgtcgaacccagaagaaacgatgggagcccgggtctcctcctgagtgtgcagctgggctggcctggtggtcccccgaaatggccgcctgaatgacaatgcccagtgatcaccccgtctgcatgcatgtggtgcatgtgcttgtgagtcaccccaatgggcatgccatgatgccatgtgctgcagctgtccccccatgctgtcagcaatgacctacacctggatgtcgcctcaaatgacatgccagagtacatgtcctgaatccccacgatgtcagcctgaagccaagtgatggatggcaccaaagtgttctcagtgaccagggagtacttggcctcggagttgtgcccagaatacaggaggagctgaccccggggtgccccccagcatcagctaccgcctgtgtcccagtgatcaccagagccttaccccggtcaagcaagctcccggtcctggagccctctcagccactactggagctgacaccagggcacctggctccccccgggg

SEQ ID NO: 596787 - DNA, 2041 bp, Homo sapiens
gtcaggtcggcgctgctaacggagccgtgctggcatgtctgcgcatctgcaatggatggtactgtgcggagctgctccagcttgcaactgatcaatgtaggaatacggcagcactcgtacacgggactgcagccaccgaataacgttgagattgggcccggaattccttccgctatgacggactgattcaccgaaaagagctgtagggcgatgtagaccgagcagctcagaaggccatacggtgtctgtggtggtcagttaagcggagatccggccatgggaagacctgatcaactcctatgtgcggagccaccatcaaacaggagatgtgtcgcagctgacagcgtcagcagcgatcagacacatgatccgcatggaacaatgtaccgccccgagctgcagcatggcgagccatccgcagggccatgcgctcatcctgcagctaggcaatgaagccttgtgactggtgagatgaggcagcggacccgacctcttcaagagctcctgatgggcgctgtccccagagcaagtaaagtcagctggctttctcaagataactctgaacagatacaaagaaaaatatgacaaggagaacgatcccttgaggcacaactcccagcggatgagtctcaataagttattgtggaccagatgctagcatcatggaaccaggttggacatctacgaacgcgtcgcattgtttctttacaccaagcgaacgacaaagtcgtgggggagtcgcccaatacagtgaagctcacgtctttgacttgaaaatccctactgagtcgtggatattagacacttggaagcctcactcgaccaagaatctatactacctgtgagatatcaattcgatctgagcgagacaccgtgagccctcattatctcgcaagtagacatgtcgactactcagaggcatctccaactcacctatgcatttggacgaacgtaccatccacacgcacaagcggcgcccatggccgcggcaagaatgtgcagtgcacgagacgtgaacaatggccgagtgatacggtacacagtattaaggcccggacgaaccacatggctcaacacacctcgaataacatacgaacagaaagagacaaatgacatcacgcgaaactgagccgagactatgaagctagacgacgtcacacgaccgggcaacaacggagacaagacaacaagcaggctcgtagactccactcagaagactctacataattataataactatcatctatacaatcacctcgtcatacatcttcatccctccaccgctcaatccaactaaccacaatctcacaacaacaacccaccactaccactcgaccatcacaacaccggaacacacaatcatactaacacattacacgacctaactctataacacacatccacacacacacaccatctcaaccaatcgacagtactccccataccacaccatcaccactcacatcacccaaaatccaccaccatcaacctaacgctccccaactcgagcagggcgtgagagccaacagcgtctcataagctagtcaggtggcggacacggaccgacaagacaaccagatagcaaccagacggaagtagacacacaaaccagcaacccaggcacaagacgcagaagtgtacagacgagtaatggtcagctaacagatagcgcagttacggagcagctacctcgagcgcaggcgcagcgccgagcacacacgagcccccggagcagtgaacgccttgacgacagcacgcacctggaccgggacagcggcaacggaggtgaaggaggcgcgacacaccgaactcgcggcgaggagactagatgacgagcgacagagaagcagataggagcgcatgccacgctgcaccacgcaatgaagaatcgctagaagaacatgagtagagggactggagaatgctgcagcacgaagagtcagctagaggcgagcaggagccgagcgacgcacacacgtcactggacgcagaacgcaggggagaaacgcgagacatcgaccagacgcgccggagactaaca

SEQ ID NO: 596788 - DNA, 1461 bp, Homo sapiens
  misc_feature (246)..(246): n is a, c, g, or t
  misc_feature (900)..(900): n is a, c, g, or t
  misc_feature (1126)..(1126): n is a, c, g, or t
acggtgctccgtctgccccctcgtcgttgccttagtgaagttcgttttcttcgtatgtagtgttttgtcggtgtggggaacaccccgcggggctttttgcccccaccacggctgattgcacccccaccggctgctgtaggtttgttttcccaccacgctgtctcccttggcctcctctctgcgagggtttattgtcccccccccccttgcttcccttctcgagcaccttccccccaccagggggtngccctgtgcgggaatttatactacggcgccgcgcggctgccccccccttgggcggccccccatagttttaaaggggggtgttgttccccccccctttttcccgtgggaaattttggggtgggagaaaatagagagaccctttggtccccccccccgttgaggccgacccccccccccttggaattggcccgccccttctcttgggcgctgctctgtgctctgaaagatttcttcccaggaggggatttgctgctcacaactggttgttgcggcccccaagatgggcccccagagatgtggtgtgtgtgccacaccacccccctcggccccgggtggtctttataatacgcccaccattgtggggtgtgggacaacaacattgtttacagcttgccaccccttattagagttggacaccacttgtacccacgcccctctgtacacccacataaggtgacacaacgcgtgaaggagaacgtgtttctctcgggttttccctaaacttctctccacccactattccgcgagaggaaaaaagcttatagagacgccctctctcccaacgcttctctctcggttatatatagagagagacacctccactctatatttttcgcgcacacaatatatattagaatccacacctcttgtgtntacacaaacacacatcttataggggtttctctcgtgtgtcccacatggtgtctctctccgtcgagatatatgtgtgtatatatatgagaaagtgtgggcgttttcacgcggctcgtcgcgtgtggacacacacggagatgtcgctgtgcgcgagaataatagagatgatgcccccttatataccacacagcgctccagcgccacgcgtggtgacatgccacagccnctcgttaatatccccagcaccactcttgggagagagtctcggggttgggcggagagtataccacattggagcaccctctagaggagattgtagaacacacctctaccccagcacctcgggccaacacaccagtgagacctcttatttttctaccaaaacaccaaataaattggcttagatagtcgtggccgccaccaactgtggtttccagctacatttaggaggctgaggccgggaggatttatattgagcctgggaggtccaaactgccatgagctaagattgccacttctgccctccgggctgggagaccagagtaagaccctctcccttta

SEQ ID NO: 596789 - DNA, 441 bp, Homo sapiens
acctcgcttagtgctccttggccgcgctcagtggtcaatgaagctgagcggcaggtcatgggaattactccgcccggtacccaaagactatggtttatgggaagcagtacgacgggttatgggaataacgcaacctcatagtctggcggtagagtaaatagaacatactacgacagtgtttgatctctggtgaaccttgcactggtgcaagagattaacgaatacatgctcagtacaagcgctcgctgtcgtccgtcttgagcatggcctagaattcgaactctagcagagcagtaccaatgccctatgccattattcctaactatggtctccattgcgcactccaacagagtggaaccgaggtcctattccataatatggagatggcgtgttcatgcgggaaatggctgttctgtacactttccacagagcactcaacca

SEQ ID NO: 596790 - DNA, 158 bp, Homo sapiens
ggacggggcggagggcaggaggaggcatgttcacagcagtcccgagaaggtgggtagaggcgtgctgcggggtctgggtaggggaggctgtggtgtctgtgtgtccatccatctcaggctgcaggtagaagaggcttattcggcaggtttggcctcag

SEQ ID NO: 596791 - DNA, 399 bp, Homo sapiens
  misc_feature (110)..(110): n is a, c, g, or t
acatttgctctccaatgcaggagaggtgcgtccgtgaagagtgaagtgactgctgcgaggtgcttgcagcggcaaaaaaggctgaaatagacggcaggtttgaccggganttgagcggctaccgttttttgaaagtgtcgatggcgaagtagccggaaaacaggggctacttcagaccatccctagtacaccatgcccccagcgtttccttagctgcgattgacgggcatgcctggcggtagctcaataacagccatttatggatgaagaacgaggggaataaggcagatgaagatattcacgattggattcactaagacctccgcgcggtccttcttcaccaagttaagtgcttctggtgccaagcgccttgtcgatgttcgcctgaataatgtttcg

SEQ ID NO: 596792 - DNA, 190 bp, Homo sapiens
ccgtgttgagcggtctcctcagtgagtccagagacccagtgagtgagtctaatttaaaaccgtgggttcaagtcccaagctgggtttaggctgggtttgagtcccaacacatgggtgcgagtcccagtcagtgtcctggctgggttcaggccataagtgctgtcagtttcaaccagagctaggtctttcc

SEQ ID NO: 596793 - DNA, 975 bp, Homo sapiens
gtatgtgtgcatatagcagctactctgtagcagaggtgggtagagacacttaatagtatcatgtcgcatgcagactgtcagcatcggcctctgcaaaaaactgtacatgtctatgatttctgcacttagacgttaagtaggtcatgtgaactagtactgctatgttcacgttttaggtattactgagtttttattactctggcaaagatggctacttgcgtatcgttcttgaaagtcctctgatcgtctctcgtaatcgctccctccattcgccatttcaatgcttcgcctttcgcgtaatttatcgagcgagactaaatctctacaaatagcaagtgtcacatgagtttaatagtgaacgcgcgcaatatagaagacacaacaagagaataaacacaaagagaaagacaatctcctgctcggcgagtggccggaagtcgggcccacgtagaagagggttatcttaacaatacaatccgggggtctgggttgcgcgggagagagtccccacatggtcgaagtttaatgggtacatccactctgtggggcacaaagcgggacatgccgcgtctctcccatttgtgaagtcgaaactctcgaggggtgactcatccgaaggccataatgggttgtcccctgcgcgatttatctctggaaacgccatattaatatgaacaagatacacgcaagcccggtggtcgcgaaaacccgagagcacgtctcttaccagagacaacgagagacattgccaccggtagggcggtaaccgcctagttgggaggtcgcaagacatagcggggcagatttctgtaaattgctagacaggatatcgtatctacccacgaagacctccttgggaaatctcacccaattgatcggacccccccctagtactgtacggaggagaagacagcggctcccaggctcgagagccctccccggagccacagtcgggagccagcataattgcgatcc

SEQ ID NO: 596794 - DNA, 819 bp, Homo sapiens
gcacagactcccttccttctttctccggtccgactcccgagcaccagcgcgctctgagctgcccccaggatcccatcccaccgacgcaagcagaaccaataaggagggaggaagtaaggggaagaggagaggaaggggagccggaccgaggtaacccagcacagagaccggagcaagtggagatagatggaaagagcgggcgagacacagcaacaaagaagggaacaaacacgacaggaccgacaaaggacacaacaagaaaacacggaaacacacgaagaaaccagagaagcaacacacacaatagaagaacagcacgcacgggagagagagaggaagagagaaacgcacaacccagaagagaacgaacgacacacacgcagacgagaacacaaaaacaaaaaaaacagagaagaagacgaaagacagcagaagcagagacgaacacggagcaacaacagaagcacaacacaaggaacaaacgagcgacgacgggcgaaacaacgacacggccaccgcggcagacgacgggcgcacacagggacaaaagtgacaccgaaggaacggcgtcgaaagggacgaggggacgcacagcggacgaacgggacgagagcacagagacggaaaggagcaagaagaactaaagaaaaccagcacaacgacgctgagcaagcagaagcacaaagcaaaggacgataacagacgggacagacgcgtggacacacacacagaaccgagacgtagccagaaacaggacccagcgaaggcacacgacgaggaccacgacgcagagagagaccgcagacgccaggcagcacg

SEQ ID NO: 596795 - DNA, 380 bp, Homo sapiens
ggcatgtgcagacttaaaaattacacaggggaatgtaggcacgatctgtttaagaaatactggactaaatggtctctaatctgtgattgtagattaaagaataatctacaatctacaccgtgttggccaggcacggtcgtcgcgcctgtggttccagcactttgggaggctgaggtgtgtggatcgcatgaggtcaggagttcgagaccagcctcaccgatgtggcggaaccccctctctactgaaggtgcggaaagttggctgggtgtggtggtgcatgtctgtggtcccggctgctcggggggctggggcatgggaattgcttgggcctgggaggtggaggttgcggtgggccgggatcacgccactgcactccagcc

SEQ ID NO: 596796 - DNA, 833 bp, Homo sapiens
  misc_feature (39)..(39): n is a, c, g, or t
  misc_feature (574)..(574): n is a, c, g, or t
ggatacggcctcgtcgttgaggtcggagtaaaggtgagnctgcttcacatcttctagctagaaagtagagcagctgacggaatggagttccaaacgctcaatcttacgaatgaatggtgataaggtccgaaaatttataaaggcaccacctcgaaactattccatgattggtatgttcactgctcttcagcctcaacggcagtgttctgtgtgcaggcaagctaatgaagaatatcacatactggcgaactcctggagctattcatctgctttttggagcaggctcttcttcagtatggtggactatgatgaggggacagacgtttttcagcaggtcagcatgaactctgctcctacattcatgcattttcctccaagaggcagacctactaaagctgatacttctgacctcccaaagaattggatttgcagctgagccactagcatagtggattgctgacacaacggatggtcatattcagggtttttagaccacccaactactgtgtaaccattatgcttccggccctggtaactgttggttaggatggaggttatgctgtattaagcgaangaccaacggtgaatgttgatgtataacatcaccggggcgggccattgctcatctacgcctcggctatcgctatgactttgtgacctgatctggatccgaacccggggagcgtgtggtgcccttttacagcccacaacttgagctacggtgccagcatcagtggaagatcccattatcattttgaacacaaataacacatacttgggtccgtggtgcgagtgtcccaggggtaggggtttgttaatcaggggagattgcg

SEQ ID NO: 596797 - DNA, 715 bp, Homo sapiens
ctgtagggaatttataaggtcagccatgacaattatacaccacaggtcattgtattcatcattagccaagtgtcaaggaaaaatgagctaatatgttaccaacgccatgatgttttttactaaagtaccaagtggacattgttgtcctttgaagaagaaggtgcctcaaaatggcaggattcttagtaacatgtcatactctatacaggctttaggtattgacttcagaatatatctgatgcccagcaaaaagtaaaataaaaggagctagagagtatgccctcagatagtgtggggccaggaagggaaaagtcacctgataaaacgaacttctgtagatactgtcatttaaaactgtgagaaaagcaacatgaaaagatgcctgaagctctccatcctgaggaaagattagcacttctgatgaaaatcacagtctgtcaaaggtattaaagagaaaactttagacagatagataaaaacctttgaggaaacgttgaactaatgtacactgagaaagaaccatataacttacttatagactgtataatttacatgatccgtctcttactacgaactgaggctaacacgatggtaaaattggttcccaaatcaagccagttatgtcattaaatacttgtctttcagaattacttatttaattattccatttaagttcatatacatataatctacagtttagatacttggacatata

SEQ ID NO: 596798 - DNA, 696 bp, Homo sapiens
tgccttttaaggataaggtataaccatacatttttggtggaagtgtgtctgggagtgaagttaaagtctgtttatcctgtaagtggggaggagggtcagctaagagaagtgggagggccagagctttgtggttctgatttactaaattaatgaagtagtttcaaacaacgcggtcatgtatagctctccatttgggagcctggctacattcttgtactatgaaagcgcaaaaagatcctcagatgaattagaacgaaagaggtaggggactcacgcggatactagttcttttaccttctgcttggtaacttagattaaactgagcagttgtgtttctgtcacaaatgttttccttatgacactggtttcgacatgtacatacatgtgtttgaaaatctgcgttgtagatgcagagagaagctataggaaagcccagtaccacccctggtgctgttctgacgagacatcgttcatacaggcacagcacatcggcatgatgaacagtggtggaataaaaagctgtggctggatacttgctttaggaacagctcgtgaaccttgcgagtgcatattctcacacatattcatcaactatatgtccaagagcttgtgagcctaatctgtaggagctagaactctgattgaccgagaaggcgtatgggttaaggttgggctacgatgtcctatgtgctctga

SEQ ID NO: 596799 - DNA, 316 bp, Homo sapiens
tcccccttccccccattgatggaagaatgttccagattctaaattgaggacttcattattaatggcattactgtgttatgattaacaaatttcctgtaaggtacacactacatactaaggtcggccatcattcctgtcatttttctgttttttttttgtaaccaagcttaaaatgaacctttgtgtttgaaagtaataacaagctcagactatgatggtcgtagtacattattcatttacaaagtatacctattcatcttgttccgaagctagattttaaactggaatatcagctttatcccctacaatgggaccc

SEQ ID NO: 596800 - DNA, 589 bp, Homo sapiens
ggtggtcccagcggttcagctgaggtagtggacagtgctgatagtgccggaatgtataccggctgtatggatctgcgtgatgagtgaggatggatcctgcgtgatggcaggattgtcctagaattagtgtctcccatttgatgactgatcgcaagagcagaggatggaggaacaagtctggtcctcggctgccaagatcccagtcacaattatcaccgggtatttacgtgtgctggtgaagactaacatttctgaactatattttgcacagagcaagcgagtagtaaagagagtagcggtcattgttacagtgaatttggggaaggaagtgcgctggagaaatccttagcgtgtcagccaaggtggagagctctatgaagagtggcgtggaactgtagaaagtggttgcctctgcatgtgcagtgaaggcacagtgtgcttagagctattgagaagttagatgcaaaagaaggggaaagtttgattacatactgttagagaccagtggattagcagagcctggtgacagtggtttctatgtttagggtcgatgctgattaagggagtgatatgtatcaggatggtatca

SEQ ID NO: 596801 - DNA, 400 bp, Homo sapiens
  misc_feature (12)..(12): n is a, c, g, or t
gtggaatgaccngcctctctgccgtttctgccaacgtgttggtgctataagctgcttcaaataccagtttgtctgtagtgtgtactcacctaatcacttgttatccagtgcctgttctaggtttatggacttaactatttctgtgatgtttcatttttagccatgttaactcctaacacatattctcttatgtctcagtaaagtttcatttgataagttgttgagattctgttatttgataatattcttcggctgtccatccagcatcttaatcactttaaaactgtgattgttatttgcaactctgttctttggaaagaataaaagcattttttttcacttgctaacatgctcacaaatgtgagagaagagtcattaaaagctttacttactgggaaaa

SEQ ID NO: 596802 - DNA, 481 bp, Homo sapiens
atctggcccctggtgtggtggcatgagaacacagccctaaaaagttcctcctatggaaagagggggtcatctgggcacagtggttcatgcctgtaatcccagcgcttggccaggccaaggcagagggatcctttcagcccaggaatttgagatcagccggggcaacatagcaagatcccatctatacaaaaaaaaaaattagccaggtatgggggtgcactcctgtagtcctagctactcaggaggctctctggtgcccagagttcgaggctgcagtgagccatgatcatgccactgcactccagcctaggtgacagagcaagacattatctttaaaaaaaacgaaaacgaacagggtgtggtcagcggggcacaggggttcacaccggtaaacccagcatccttggaggccacggtaggaggatagctggaggctagaagttggggaccagccaggacaccatagcaagaccttgtctcc

SEQ ID NO: 596803 - DNA, 2231 bp, Homo sapiens
agccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttgggttgtagtttaccttcctggaaagctcattatctttgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaactattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttgaaaaactccaaccttgtcttatttaacttgggggaaggggattctccaatgtcttttccaggataaagaaggaaattaaaataccatgaaaaaatggacatggcagtagaaaggaaacattctgatcagaccttgggaaaagctggtgccgagagagggagaggccaggtgtccccccacccaactggcactgattctcagccccttcctcttacttctgttggcttcaaggagacctgcccttgatgtgtgttgctgctgaagcaccctcccagccagtgagttggacatatgcagcaggcactttgatgtccaggaagtacactggtacatgacaggagcaagggtcagggaggggaggggaaaggtttctacaatgcagatgttttcaaaattctccaacaatcatgactctaaatggtatgatttagggctgggtgcagtgactcacacctgtaatctcagcactttgggaggccaaggcgggaggatcacttgataccagaagttcaagaccagtctggcaacgtggagagaccaccatctaatttcaaaagagacccccccgcccccccggctaatttttaaaaaattagcaatgtacctgtagtcccagctacttaggaagctgagataggagaatcgcctgagtccaagagcttgaggctacagcgagccaagattgcaacactgcatttcagcctgggtgacagagcaaggccctgtctctctaaaaaagaaaaaaaaggtattgtttagttcacatggccatcagtagaactacatttcatatgatgagaagaaaataattatttattttacacttgagtcagggagactgacaaaggataggtatggaaaatggcttgctattttcatggccaccctgtcctgcaatgcggggggtgggaggggggacattccaatgacttactgctgcatgacaaagcaccaaaacatagtggcttaaatagaaatatattgtctctcatg

SEQ ID NO: 596804 - DNA, 359 bp, Homo sapiens
  misc_feature (231)..(231): n is a, c, g, or t
gtacaggctcagatgttgggatacttggtccctagttgttggttctttcttcgcttctcttctcacaggcttttcccccaataggatcagaacctttaaacctgtcctggtgcctgcttcttggagggcttggaatacttaaccttgcaggcccagcgctcactggagcagctagtaacactgtttgtattttcaacacttgtttcatttgcctcatcttttttctttatntactgaaatgattaaaagccaatcccagaagccatgccttagtgctttacacacagcatacacattattcacagagcccttatttgcatatttgcccttatttgcatatttgcctaccatgtcgacgc

SEQ ID NO: 596805 - DNA, 1239 bp, Homo sapiens
agccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttgggttgtagtttaccttcctggaaagctcattatctttgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaactattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttga

SEQ ID NO: 596806 - DNA, 1235 bp, Homo sapiens
  misc_feature (1223)..(1223): n is a, c, g, or t
ggagagagagaactagtctcgagtattgtttatttttttatttttttaaaaacaggagtgcttaatggccgcgagtggagtgttgggaaggattgccccccggctcctgccttcgggctcacctgaggcgggggcgcaagttagaggccactggtgggagaaacacaacctccacatctcccaggaagaggctctcatcatggctggctcttacggttctacgcacagcctttctaagctggggggctctggggccgcctcctatatagggtagatgtctgcacacccgttgtccggtggtctcccggccgagaaggcggaaccatgggcttgctggggcccccaaatgagcggcggagtggacaagcaggtgccggggaagagaaaaccccaaagcacaaggggcccctctgccaaagctctctgtaaacagacctcctcacgggtccctctggggcctacagtacaaatccctgaagaaaacatggggggtcttctgccccgaaagagggccgagggttgtccaccgagctctgtgttagaaacccagttgtcccctaccctttttgcaagaagcgaggttcaccatggggggcctagaaaggcccaaaactctgcagggcccagctcgggggagacccacaaaaatagcccgggggcttctatcacagttacaaaaaatggtgcaaaatggggaagcccaatggtgggcacacgtgcgcaaaaggggtcaatgtgccccaggggggcaagagggccctcccccaagagaacataaacagagggaccagagcacacagacacacaaagggtcgagacagcatcagaccacaaggacagctggaggcataagcaaagattacaaacagaagaagaagcaccacaccccacacaaaagggaggtggagagcaacaccaacgcgaagcgacacccgagcccacagaacagagggaaagaaggacaacaaagagcaagaaaaaaaacatgggagaagaaggaagagagacaactaaacgaagatgagaggcagaaggagggaaaccaaaaaagatgaagcaggcgcggaaagcacggcacaggagccaagaggacccagccacaaagcagtaggagtaagatagagacgcagcaataggagaagaacaaccaaatcaataaggagggccagaatataacagtaccaccgcatagagagaaattaactaatatcaaccgtaatgcntacccccccacg

SEQ ID NO: 596807 - DNA, 376 bp, Homo sapiens
tatacttcttttgggagggcacgtaaaggagtcttcctttctctttcattccttccatcttgagaagaagtcctgctctgttgccccaggatggagtgcagtggcgaaaactcagctcactacaaactaccacctcctgggttcaagtgattctcctggctcagactcctgagtagctaggtttatatgcaggcaccaccaaaaccagctagtttttgtatttttagtagagataagggtttcaacatgttggtcaggctggtctcgaactcctgaacttaggcgatccaactgcctcgtgctcccaaagtgctcggattacaggcgtgagacaacacgcccagcgaaacaatggtttttaaggcataggtcatca

SEQ ID NO: 596808 - DNA, 104 bp, Homo sapiens
ccggtatgtcttacgggaactcctctttgcctatttttaaatggagctgtttgggttttttggttttgagttgtaggagctacttcagtctccgcaggaaggta

SEQ ID NO: 596809 - DNA, 477 bp, Homo sapiens
aggaagatcggcaggaacgtagaagcacgaacgaagaagcggaacgatcaccgcaagattcacctaccagcgggcgtaggacctctgaccagcggcgcggatatgtgcctacgagcaggctcgattgcagatgtacagtgcagagccagacggcggccggcgtggaacgcgggggcctcgctggctggaagcagcacttcccgggctagaagcgcctgcgcaaaggccaacgaacggaggcgtcctgccgcatcggagaatgccggaagtcggtcgaagacgccagcctagcgggaccatgactcatcgtacccgagatggtgggcagcatggtgggcgtaacaacggcaagactttcaacccagggtggagataaagccacgagatgaatcggccagtacactgggcgagttctcgagtcacgctacaagccgcgtaaagcatggccggcccggatcagggcacgcagctcatccc

SEQ ID NO: 596810 - DNA, 327 bp, Homo sapiens
gacaacgggcccgcacgtttcccagcgagcgttcctgtcgaagggtcaggacaccgatgcggcgtaaatcgagtcgatagaggcacgcagagtctgatcgaactcctgctgcgactgtgcgacgtttagcccctcggccaaagcacgagaggagctcgcgatgagtcccctgttgcgggccagcttcttgttggcctcctcacgggagtacccaccagacagggcgacaacgcgcaggaccttcggatccgcaatgaggtcggcatacaggtcttcggaactcgggatcgtcagcttcaacatgattttggcatcgagcggcggaga

SEQ ID NO: 596811 - DNA, 201 bp, Homo sapiens
cccgtattaacgagaagaaggatggattgacagcactgtagaaatgcagtataggggtccagaaaggaagcagtcactggcatgtggggacttaaatctgcaaaggctgtgatccaggtaggtgtgcggatgggcagttttgtgacgctcaaggagcagatgggcactccagaaggacggacgctccagaaagggcccaga

SEQ ID NO: 596812 - DNA, 715 bp, Homo sapiens
tatgtctcgatcgttagcacggtctggtcttcagctacccgccttcgtctccgagttgggaagtgtatctggaagtattcgtcgtctttgatttttggggaagagtttgaagaagaattggtactagttttaccttaagtgtttgggcagaattcttctggtctcttgatgttttcattgccttgctgagcatagatcccaggtacttatgagcaaaattctactcagtctgacaactctgcttagaattatgaatgtgattaaatgcagtggtcactctacctttctaaggtagttcagctcaagttacagcgatccagtcctgatagagctttgaaacctcaagtctattatataacgtaatgaaaaattggcttggtgaggtggttcacacctataatcccagcactttgggaggctgaggtgggtggatcacttgagttcggagttcaagaccaggctgggcaacatggcaaaaccccacttctaccaaaaaaaaaaaaaaaaaaaaaaaatatatatatatatatatatatacacacacacacacacaaaaaaaaaaaattagctagtcatgatgacatgcgcctgtagtcccagctactcaggaagctgaggtgcaaggattgcctgagcccaggaggtggaggtttcagtgaaccaagatcacaccaccatattccagtctgggtgacagaaggaggccctgtctcaa

SEQ ID NO: 596813 - DNA, 481 bp, Homo sapiens
gattggttttaaagaggccttctacccctgctcagatgtcaaaatgtttgggttggcgcttaatccacatgtcagctgcaagctcttatttaccaaagaatagaattgttaattctattgtcaaaatattagtaacagtttagtcgtaagactcctcttggctcagggtctccaaaattaagaaaataacagaacaacatgtttatttctcacttcctatttttgtgtacatgttaaaatgtctataatattagtaatttaactcacagtgtgagtattcttggtcaggaacaactgctctaggtattccgaaattccatctttgcatcaaatttaacgttattatgttatttatgtagagacaaagtctggctatgttacccaggctggtcttgaactcctgggctcaggtgatcctcccctatcagtctcctgagtagctgggactatgggtgcataccaccacatctgacttattatt

SEQ ID NO: 596814 - DNA, 116 bp, Homo sapiens
agatgttattgagaaggggagaaagcttgacgtcactgacctgcttgcttgatcctgtggtccggatccagagaaagtgaaggcttccataattaccatcacacctttccctttga

SEQ ID NO: 596815 - DNA, 512 bp, Homo sapiens
ctgcacgagctcagccccggaagagaaggtgctcttgtgccataagacacatactgacattgcgttgaagggtggagagcttgacctctcccacatgcgcgatgcccatacagcccagccaggatcctttccgtggttctcaggaatgacaacagaactaactttggttggattttttagttcaaagaagagtttgtgccctgttacctctgctcgtttgtgatgaccgtgagctggatcattcagtgattctcagtgggggttgggggagttgggtggatgtgcgagtgccatcccctcacaatgcgtatttctcaagaatacactggggtggggtaagggggacaaacacgggtctaggtcagatgctgttctggaacaggaaggatgtttaagtatcggattgacccagatgatgacagacagggagacattgactgggtactttagctactgctgccccattcccacctccttttcctttcgccataggggcctaggaagtcaagcca

SEQ ID NO: 596816 - DNA, 705 bp, Homo sapiens
  misc_feature (508)..(508): n is a, c, g, or t
tcccgccgtgcgccaccagaatgtccctgtcttgaggtctaatggcggacgccagtttgtgcggagttggtggtggctaaagtttggaatgggatgtgtagcatctccgttgtggattatccacaccatctcctttctcgctgcaggctattttgtggacctccgatacgtgtgtggttgttaacccaaggccgtggaggtctcgtggggtggcctcaggtttccctgtgcagccatgtgtttccgtgtacaacttataaccctttgtgcaagaaagagccacctgtggacatctcagggctttgtgccaatctcatgtggacacaccttattctctgtgagaacccaaaaaaacaaacacaagagaacatgtggatgtgatatctcccggtggcgagaagaaactcttgagagaccctgtggctattcggcccagagaaaaccccacaaacactgttggtcaaaatggtataacatatacccctatagctctcagctgtgtgtgganacaagtaataaatccggagtggtacactcgcggggtctccactctcgagtggggccctatatataagcgcccgtagaaccagggtgtgctgccccccaaaagagaccttactatgtgtggtacattgtgcgcaagtgtgcaccctcgtgagtctcagaaatgttggggcaaaattctggggcaatatacccaagccc

SEQ ID NO: 596817 - DNA, 246 bp, Homo sapiens
ttgcaagggacagaaaaagagtcctctccaaatcctgggaaagctccctggcttggcactaggggtgtgcagtaagccagaggtggtgatataggtggacaagagacaatgctccacaccccttgaactctctggtatgaaggagaaactttttttaatctctaatttttaatgtataacagatttatatttttatgttatgataaataactaaaaatgaaataacaaagaagacattcaaagtgc

SEQ ID NO: 596818 - DNA, 322 bp, Homo sapiens
ctttcttacctgatgaagaaacttccaacacaggataccccagactaatgggcaccaacggcaaaggtattaaatgcatagcaggcatcgcctagtaagcaaacaggcccctcagcgttgaacaggtcaaagtagctcccaccaccgctcatgaagttcgcattcagatcattgctacctccctgagccatactgatgccactgaaatcgaaactgaatgtgtgggcctagctttaccagtgataggccatcatgaggctgcaagtgtacgagacagctttgggccactagtgaccaacgtcccaggcgaccgaggttcccg

SEQ ID NO: 596819 - DNA, 129 bp, Homo sapiens
ggcatggagagggagtgggctctatagcgaatttagtaaaaagaggctgtcagtttgatagctgccaagaagcagcaagtaggccttgatttgtagaatgcatttttaatgtgtcgttctactttgcag

SEQ ID NO: 596820 - DNA, 1468 bp, Homo sapiens
  misc_feature (217)..(217): n is a, c, g, or t
  misc_feature (1063)..(1063): n is a, c, g, or t
atcgtgtgtcgtcgttggagtttgttcgatatgtgtatgtggtagtacataagagcaagatacaggagataggaagcaggagggcaggacagagggagcagcaggaggtaggagagaccactactcagcggtggactgggtactagcttgctttctcggtgtgtccgctattttttggcgcgcccagctgtttattagctcgtcacgcgtcctccgntccttggggcacgcccttcttgcgtgtttattgacaggaagagccgttggataaatgcccccgtgggagagggccgcccctctcttgttgtttcccgtagtttgtgccgcaggttgtcctatggagtctcgcgcacagaagtttctgcgcacacttgtgtgcgagctccccacgggatttatgtaagggggtcctccttcctgtgggtgcccacctccggggaagaccacctttgtttgagagggaggcaaccttctctccccgcgcccacctgtataggtggtgggaggttgtccgccgggaaacacagcgtctgtgttgggggttgcttagggacgtaaagtcagctcgcgggggagcacccagcgggagagtgtgtcgttttggagaagaatggtttataagcgggaatacaacccaacacgtgaagacggtgttgatggtttttctgctgggtggagagtttgttataaccacgcgaaggagcaacacatatataaacaggggggggtcaattataggctcgcccctgtggtgttgccttggcgtggtgtcttctggtttgttcttgctgcacagttcggcacaagaatttcgggctcgtcccacgcaggttttgtccacaatgaggtggggacccacacaacgaggaggagtaatcgcctggtatgagagctgttttttattttgggcctcatggttgacccaaaggctggcttgttgagaatgcttggtggtgtctacattcccttggagcacagtaacgcaccgtgtttagataaataacacatgcttttaatgacgatataatgacccacaatatgctcttgagattacctatggtgncccacaagggttccaatttccacggggatataactcggacaccacctcataccactttgtggcttttgctgttttttcttatggtggcttataagtataagaggcccactgcctcttgcacagtcatgccactcgttggtaacttaggcacttttattcttggctcacaaattcgttgaagaatggtggcttgtttcactggtgttttgtaattgtgtctaaagcacggtttacctgatagaccccatgccttgtgtagctagatttttcctgggaaagtccatcttttagggattgtttttcagatcttccataaattttttcctttaaatttcctaaaacaaaagtaaaaaatatacttcgagcattcatctcggggcgagaagagtaggagcgcccgggtag

SEQ ID NO: 596821 - DNA, 113 bp, Homo sapiens
taggagggctccaagacttgagtttcaacattgtaaaaaattttgggtctgggataaaattgtttactcttttggaacaaaaaaaaccttggacaaaggcccatatttcttat

SEQ ID NO: 596822 - DNA, 314 bp, Homo sapiens
attacagtaagtttccccagagctcataaagctggtcctctttcactttcaaaaaaaaaacagggtgggataagcaccagaagacacaggaacaggcccagtccctgcgacccaaatcagtgaggggaaaaacgactttttaaccaactgcccagggatagggatagccatctggaaaagtattaagttagactcatatgcacaaaatcccaaatgcagcagagagaaaagcataaaaaaagaaccctggccgcgcgtggtggctcacacctgtgatcccagcactttgggaggtcaaggcgggtggatcacaa

SEQ ID NO: 596823 - DNA, 518 bp, Homo sapiens
tggcttactgcggagtggacaatgttattcgatgcttacttatactacgcattatttcttctcatagggtgatatcttggtcctgttggatgtgaggagtacagttatatgtttgggattttttaggtagtgggtgttgagcttgaacgctttcttaattggtggctgcttttaggcctactatgggtgttaaattttttactctctctacaaggttttttcctagtgtccaaagagctgttcctctttggactaacagttaaatttacgaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttag

SEQ ID NO: 596824 - DNA, 937 bp, Homo sapiens
  misc_feature (1)..(1): n is a, c, g, or t
ngttcccgccaatgaaacacacaaagaacaaaacgaaaaaaatgccgcacatgtccatcccatttgtgttcaaagtataacccctccttttatagactctctccattgcataatgccgtttgttaataagcctgtcttataagacttcccttgcgttgtccctgctacatgtttcccccccagtaggttttttctccagattgcccgtccctgtggcgcattcattacctatgcccgactttcaaccactattcttatggtggcggcctttgccccgcccttactggtggcgtcttgccgccttaacgccttggaaatttctctggcgctccaccatgccgtctgttaacccgccttttactttgaaataaaccacttttaggcttccctctcccgttataaccaatggtatgccaccatcaacaattttacagcgtccggctaaatgtcttcattcacaaacaggctgatccaaaaagcatttcgggttaataaaagaagtacttgtacgcacacattattattgtacgaacacccacacactctgtgggtaacactcctcgacaattctcactcacacccacgtgctattttagcccccgtgtaatctatcccccaatctgggtgaagaacatgtccaccgggcgcgtggtatttttgattggcgagatgacagcctgcgggaagaccctttaaagcctccttatggtcggttttataacccccgtcccctaacatcaagtggagatatctgtggacctctttaggtgcagaaacccggaacgtttgtgttctaagggatttagtaaaacaacaagagtggagcacgagatacgactaagtgaaggacgagggggaaaaaaacaagacagggtttatatgtagcccccttgagaggagaaatgatataaatggttcttgtctccccaacaaaaca

SEQ ID NO: 596825 - DNA, 329 bp, Homo sapiens
atccaacacttgggaagccgaggcaggcagatcacttgaacccaggagttagagaacagcctgggcaacatggtgaaacctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagcttacgtttcccagttaatattttagcttcagcgtgtc

SEQ ID NO: 596826 - DNA, 298 bp, Homo sapiens
ttcccttcctccagcccctgaaaacactaccatctactttcaatctgtatggatttgtctgttctggacatatcacataaatagactcaaacaatatatggcttttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtga

SEQ ID NO: 596827 - DNA, 105 bp, Homo sapiens
tgtctgcgaaacctcagcctgcaagggatcgtgttaggaggggtcgggacgaaatcaggctctcgaagcttcataaaactcaatgtgagggatgcaatgtgacaa

SEQ ID NO: 596828 - DNA, 584 bp, Homo sapiens
agcgaggtgaggtttgagggaggagacgtgaggcaactgtggcaggaaaaaaaaaaaaaaaaaaaaaaccccgggggaaaagggggccggggttccccagggacaaaagtgatttcccaattcaagccccgtgcgtcggggcccccgagtggacactgtggcgaacccgtgtttagaagcccaaggggtgtgcgccttcgcgggcccatttgggggttgcccccaaaagggggcagaagagtgcccaataaggggaaggggtgaagcacaacctgggggccaagagaaaaaaaaacacaagcgaggcccgtcacaaagaacaggggggacccggggggtcccccgcgagcgggggtctcgaacattgttgtcgtcgcggcgagctcaggcccccctgtgaacctgggggggccccccatgtgtggacgccgtggggggggaaaccccctttgtgttgtcgagatgcgccccatatggtttgcctggcttttctgtgggcccccggtttagggggtttacgccccgacggatatggccctgtccgtagatgtgcgcacccaatttataagagagcgcagacaagg

SEQ ID NO: 596829 - DNA, 435 bp, Homo sapiens
  misc_feature (34)..(35): n is a, c, g, or t
atgggaaaatatgaactgctttcttttattcccnnctttcattcctccccccccaagcaaatcccaacattttttttcaggggggtggcttttatcctgttaaccctggaatatctttaaatgatggccaggcagatgaaacccggtccctggggggtttgcttcctttcctttgagctgtttttttggggatggatatggggaaatgttatgcccccctgataaaaaattttttttggccctttttcaagaaagatatcttatggctgggtttaataggatatttaatggctggggccttgttgatgctcccctttgataaaaaagggtcctataatttttttgaaagtttttaattttttttgaatttttttggtcctgtttgtagggttttgtgggggtctgggcccaaaaaataaagcctttttaatttta

SEQ ID NO: 596830 - DNA, 638 bp, Homo sapiens
ctgccccttgggtcttatcactcttgtaaatagttgcgcacctctaccccaattttgtatcaagcccccctgtagccacatatcctcgttgtcatttcccccccccgcaggaagccgctacacatatctaatcaagtgacaataatgtatatcaaaccatgtttcccccgtttacacgtgcttaatctcctgatcaagaggccccccttaatacacctgtattgaccaacaacaaggctcatctaatgcccactgatctgtccacccacaataagttttctccccaacctcgctcagactaatgttttatagtattattcttcggatttttcgtgaaacaccatctttcttagacaggcttaccaggttgtccgcacgtgactgggatataggcccccagctcttgtccgcgaaaacgtgtgtcccccctaaaaacatgactggaggtccgtgtctgcacgaacaatttggtggagattgttgtacaaggttcaccgcaccagcatgacgcaggtgtgttgaggggtattcccgtttttataaactaattccaacaggtattcccgggctgggtcatttcgaccccatttcccaaaaaacaatttataaaaaaaaacaaataaaccgcccacataaca

SEQ ID NO: 596831 - DNA, 119 bp, Homo sapiens
gagctccaggaagggcactgagcgctgctggcgcgaggcctcggccatccgcaggcgccagggaaagtcttctggggcgttcctgtacaatacacccttttttcttttgttttttaaaa

SEQ ID NO: 596832 - DNA, 348 bp, Homo sapiens
ggtcgacatggattttaaaatagtttttctagttatgtgaaaaatagtcaaaacaatcctaagcaaaatgaacaaaactagaaacatcatgctacctgacttccaactatactacagtactacagtaaccaaaacagcatggtgctggtgcaggagcagtcacatggacaaatggaacagaatagagaacccagaaataagactgcacccctacaaccatcttatttttgacaaatctgacaccaacaaacaacagggaaaggattccttatttagtaaatgtttttgggcaaactggctagccatatgcagaaaaatgaaactggaccccttctttacactgtatac

SEQ ID NO: 596833 - DNA, 81 bp, Homo sapiens
tctttattcatcaatagtatccgaaaaggaagaatcaggagttacaaaaacaagttaaatgcaatatagaaattaaagtga

SEQ ID NO: 596834 - DNA, 108 bp, Homo sapiens
gtatgagtgtatagatggtagaaagtcatagggctggatgaggtcacttagggcgtggccttgtctagagacatgggcccagacctggagcgcccactgcaaggagat

SEQ ID NO: 596835 - DNA, 451 bp, Homo sapiens
ttcacaaccccacgatcactaattctctttcctggctctgtagctcttcgttttctccttcctcagcctcctcttcttcctcctctgagcaccactgagttgtgacactatgactggtagtccagcgcaaacattctggatctacatctacaggtcgcaaattcagcttaagctttgccatgtgatccctggacttagttattcccggtcggataatcacaaattggtcactacggaagtcccgcattcgtacgttgtggagtgtgcaactgatgtcttgagggcagattccagtcgacttgcttaacttctttttgctaatctgcttttcattttggtaatgtaggcactccaatcttacacttttcccatatgccatgtacgaaaaacgagccaaatcagatgccggtttctctggagaccctgattggccttcacgctttggtgatcg

SEQ ID NO: 596836 - DNA, 371 bp, Homo sapiens
aaccgggccagtacctttttatggaggtatggccatggggttaaatcaaggccttggccttggcgggccattcagggaaaccatcccattaaacctttattaaggaccaatttaattaatccggtggaggaaggttccgggccactattaatttcaggagggctaattaatcctgaacctaattaaattcggagccttaattttaatcggaattttaccttttttcagataaaccattaattaagcggccaggtcaaaccagacctttggttgggtggccggattaacctgagggaaccaccatttcggtttccatataataaggcccgggtcccagcccttaaattggcattaaccatttgggaattaaa

SEQ ID NO: 596837 - DNA, 291 bp, Homo sapiens
cccccccctttttcttttttccccccaccttagccaaggaggattttgggcccctaatttttggggttttttttaaatccccaagggaaaaagaacccctttccgattttttttttggtttggttttgccgagggtttttttaacaaaaccccttttttccccccccgaaatttgttggcccggccgaaaccggggggttttgacctttttttttccggtcctttaaaaccgccaaacccctttggtttctgggccccactggctttaaaaaaatttccctgtttttttga

SEQ ID NO: 596838 - DNA, 870 bp, Homo sapiens
gtttccgatgcggggtcttcagacgctgtggaccaacccagaggggagacctccgtgagttactgcgtgcgcaagtatggtgaagattgtgtacaggaagattagtccggcacagctagtctctgtgggcacagggaacaggaatgtctccatgcccagcgcccacctgtgtcttagaaagcatgggatactcaactgataattccatctactcgagttttttgccgcgctaatagtttcaagagctcttcatccagccagtcatgaatcaatacttatacccaatgagagcctcacacattcaaggatgtaactaagcactacaggcctcacagaaacgagagatcgccagtcttggaagcttgttacaggtaccacattggggagataaaaggggtttgtgaacatgagagatgaccagaaaagcaccacgcagagaaggcaaagttacggtgtcctgttgtctcagttaactaagtcacgacctcaaataaactgtctttggctcgtacatacgagttcattctatcaaccattgtggtctggcttccacttccgttcacttcacccaaacatggctcagccaaaggaagcccgtgatctgtaggccatcactttaattgatcgttgtctacaacagtgatgcctggttgttaagccctccttacaacattcttctctcttggtttttatagctccatctctcctgcttcggtaacttgataatgcatacatgatttttctatggtgtaatttcataaaccaattaatacacaagataacaatgacgtgtatagcaaaccaccgtgttgtatagagaaaatggatgttgggatgcctctcatatgtaagttagttctatttaaacat

SEQ ID NO: 596839 - DNA, 891 bp, Homo sapiens
tgggacaggaatgtaaaattaatgggtgagtattaaaaggggggcagccactttggaacccctcatgattgcacgggcccgccacttgtccaaagggccccaacggggaatgtacttaaccccacaccgccactctgtgaatcgacgcccgctttccaacgcccacctagtgtcctctcaaattcactcacgcattgaacttgtgtagaacgccccactctcttttgaaatggtgagactcctctcatgtgctgcgccacagaaaccttgaactttgcgccctgccgcagcggcccctcaactccacactgcctcccttgtactcgcacgcatttgcgtcgccagtgaccttgagcccactagcattaaccttctgcgccccacttgttgaccctctgtgccacattgtcgccctgtgtgcgctctctccaaatgtgcacacctctccgcaatttgccccttgattcttgcggaccccctgctcatgcccccctatgcacactgagacaaacactcttctgtccgacttcgcggattcacctgtagcacacgtgtctgtgacacgcctgaaccccggtttctggaacgccatcttttgccacacacttttataccaatgtcacttactgtgcgccccaacttctctgcggcaagcctcccagtggctcttcacgaagtgcacatgtctgctccaatacttcctcttgcagcccccttgttgctccctctaagcgcgcacactcctcccactttttgcccttttttccgccccatggtcctaactcgccaactcttggcctccagggaccccctcggtcaaaccaccacttgccgtccgcttgtccttacaacccgccacacggccgggcagcgccttgctccctgggactg

SEQ ID NO: 596840 - DNA, 622 bp, Homo sapiens
ggcagtatcgaccactcccccgatggctcagacacggaggacccgtcctggagcgttatactcaaggccacaaagctgcgatcacctccttggagctcagaccccacggcacagcaacttcggcagaggaaaattctcagaatttaaagctcatacagctcccgttcgaagtgtagacttttcagctgatggccagtttctagctacagcttctgaagacaaatccataaaagtatggagcatagtatacgccagcgctttcctgtattccttgtatcgacatacacactgggtacgctgtgccaaggacctgtctttactgtctcatatttcaaaaggtggagagctatttgcatcaggaggtgcagacacacaggtctaattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagacacaacagaaaccagtggtaggactctgccagaccagggtgaagaggcctgtggatatttctagaaaccttccttaatgtgaccgaaatgtttg

SEQ ID NO: 596841 - DNA, 97 bp, Homo sapiens
gggccccccgggttttggggggtggctggctggcggggccccttcccaccccccccccccccccccggatgttccattaaaacttctggggcgggga

SEQ ID NO: 596842 - DNA, 177 bp, Homo sapiens
  misc_feature (165)..(165): n is a, c, g, or t
cgtgcatgtaaaagcatcctgccagttaagaaaacaacaacaaaactctagagaagaaatgaaagcccagtttcatttctggagaggaaagaaaactcatgtgtggcatgagtttatattcaagcaaggtgcagcattattaacctatttcactacgtaataatngacacacattat

SEQ ID NO: 596843 - DNA, 343 bp, Homo sapiens
tactaaatgagtttatatgagaatatgcctatcatataggaatatgaaagcagcatagcttgctacagtgacgagccataatattgagaagcagaaatggcaaaagtaattatgagtcatatttagacttatgtagtgccgtttaaaattcccctagataattaccattcatattttattaactaggtataacatcaactgtggtcgtcagagtaaatatttcaccgtaaagataaacatgggcaatatattaaactctagctctgtttacttgcctataaagtgaggctgcacttaaaatatatttgattctttgttcgtaatacatgggaacaacaactag

SEQ ID NO: 596844 - DNA, 228 bp, Homo sapiens
attttagagggataattagagacagtaaaaggggccattttaactgttgtctgatttaacatattaacacggttcaggtcagcacattagtttgtctttatatcagcatgtcagcacacaacagtttctccatgcttgtttctgtttcacagtgcacaaatttcccttgcagcattgcaaagaccaccctgttccacccactgtcagcccacttccatttgtgtgcca

SEQ ID NO: 596845 - DNA, 1161 bp, Homo sapiens
aaagtgtaggaagatactgattagaagaagtctagatatagatgaaatagtcttagtggtggctcgactcgaattccaaagattcagcaactggttaacagagtctaacaatggcaaggaaccatcccgtggcataaaccgcagatgaagctgtagcgtatggtgctgctgtccaggctggtgtgctctctggttgactcaaggatcctgtgtgacctggtactgcttgactgactgtccccttacgcttggtcttgatgtctgtgggcggtgtcttgaccgtcttctgatttccaatggaagcacagtggtgccgtaccatgaagtctcgagatcttgtctatgctgctgtctgatttgtcggtctgtgctgttgtcgggtcgtcggggtgctcttgttctggtgttgttgcactcgcctccgtgtgtgtgcgcgcctccgtccgcccccttcgcgcgtcctctgtggccctcgtctcgttcgtcccttccctggcctccttctgtggcggtcccgcgctgtctctcgtcaggtcatcccgtgtgatgtatgtccgcctgtgtgcgtggctttcgtctgtcgggtgttggctgtttctcgctgctgaagcgtgtctgggtctctcctggtgctgtgttgcttgccgctcgctgcttctcgctccctcgcgcactttggctccctgccctctgtcgtggagtctcctttgatgtgatttcgttcccgcccctccctgggtctctgttgactcgcttgcctaccgcccgcctggcccacccccccctccccctccttctgcggagtgcgccgcgcctgccgttcccccctcggtggcgtcttgttttttcggtctgttgcgtctctttctacctcctccctccgcccggccttctcgcccctccttctcgttcacctggcttccttgcttcccgtctgcaccttctccgtgcggcgccccctcgtcgtctgcactcccgtctgctccaccccttgttctctctcggttcgtttgctgcccccttcgtttgctgactccttcgttcgcccttctctcccctccccacacctggtgtgcctggtgccctcttggcttgctggcccttctcgtttgctatctcctctctgacccgcttggccatccccgtcctgctacctcggtt

SEQ ID NO: 596846 - DNA, 328 bp, Homo sapiens
cccggggggggggccgggtttttcccttttaaaaatttttttgagggggggcccccccccccgcaaaaggcggttccaaaaaaattttttgtttcaagcccccaaagggaggaaaaagggggggcccccctaaggtttttttttgggttttctttaaaaaaaattgggtttcctggtttttttttttaatgggaggggttcaaaacccttttgtttttttgccccctcccccccgttttgtagggcaatttttttttttaaacccccgggggccggggttttttggtggggggtttttttgggttttttttaaaccccttttgtttta

SEQ ID NO: 596847 - DNA, 191 bp, Homo sapiens
  misc_feature (140)..(140): n is a, c, g, or t
ttacaggattatagacttggtctgtacttgtggaatttaaatagatggcagagaagtacaaaggaaagcaagaaaaagcagaaagtttttatcttatctgtaaattaaatatgattttttattccttttacatctaaccnattcaaaaacttatggctgtaattagggtttcggaaacccttaattaggtg

SEQ ID NO: 596848 - DNA, 347 bp, Homo sapiens
taatatctatataaaggaaggattgtacactgcccgacgtccctactgacgtcatccaagacggcacaaggcaagatcaacgaaaacgttcccatactagtccagcggaggtccgtatgttagccaatctaagtgcatccatccgtgatacagaacgccgaaggagtacggatagattgcgaaaaatcaggagcaaaattttagtcagaaaactattactacataaagccatataagaatgtgtattagttgtttcctttaagggaaaaggaaatcaaactgttggttttctatttattcagaagaaaaaataaaggaaagtgtttggaaaatatttctgatattaa

SEQ ID NO: 596849 - DNA, 338 bp, Homo sapiens
  misc_feature (14)..(14): n is a, c, g, or t
  misc_feature (111)..(111): n is a, c, g, or t
  misc_feature (135)..(135): n is a, c, g, or t
  misc_feature (243)..(243): n is a, c, g, or t
  misc_feature (331)..(331): n is a, c, g, or t
tatatatgaagtanagtacaatgaagtacaataaaacagtgtatgccctgtagtattatcctgactggatgtttacctatctacagaaacatctgaattataccatttganctttgctttaaattaagttggtgncttaacccacttaggtctggttgccttcctctctatacaaatcggccctctatgtctgtgggttctgcatctgtgggttcaaccaattgtggatcgaaaacatatagnaaaaataaaatgtgtggttgcacctgtactgaacatggtagactttttttttcttgtaattattccctaaacaataaagaataactanaatatat

SEQ ID NO: 596850 - DNA, 310 bp, Homo sapiens
gctggctaagacagtgttgtagcgtagtgagccagtgcagctgtggacgcgtgtagatgcttcaacgatagcctgagcttgtggtgctgtcagggaagagtagtcgtagtagagtggagcctgggctagctgtggaaccgttgtagcattcttgaccaacaggataaaggctgtggctactgcccaggggacagtgcctagtagtacagttgaacctagagctagtctagaggggaagttagttggatatcctagactaggagcctagacggtaggtggtagctagggcaggtgaacagtagtatcccta

SEQ ID NO: 596851 - DNA, 1960 bp, Homo sapiens
  misc_feature (1)..(1): n is a, c, g, or t
  misc_feature (131)..(131): n is a, c, g, or t
ntctgtgtgctatcgattcttttcgctgtcgctcgttctatctgtgatgatgcgcacttgctgatcttccgtctcatctgattactcttctgtgttctgtcttctttagttctcatatgtattctcttgtnatcattgatcttctttcggtctgctctgagtcttgtttgttctctttgtatgcttcttgtgctcttgtgatgtctttctttgatccttgtagcgagtacgcgtcttcggcgctcgctgtgtgtacggcgtctgctgcatatcgtcgtgtctctctctcgacttagttcctcttcgacgcacgtatgttgctatatctactgttcgtgtttgcgatgtagtgtgctctcgtttctgtctcctgtctctcatggtcagcttgcgtccgcttcgttctcttgtgtcgtattcttctctcattggttcatgtttcgtttgtcgactcgactggagtctgttgcttctctcgtgcgtgtttcctctcctgtgtttgtttctctgttccattgttttttgtgtttttgttgttgtgtgcttctcgttgtccgctggattcttgttttgtttggtcgttttgtgcttgtgtcgtttgtgttttctgtttctcctctgttgttgtgtgtgtttgtgttgtttctggtgttcgtgctgtcgtgtgtgttgtgtcttctcccgtttttgttgtgtgtggcgctgtgtgttgtgtcgtgttccgtttgtttttgtttttgtttcttgttcgtgttcttgtttcttggcgatcttgctcgtcctcgcttatctggtgcacacacttttgtgtgaccacgtcccgtggtcctccctcgcatgccgcacgtcgctgcgttttggtgtagagagggtgccgccccccctctgggggtgttagatccgcacccctcgtcttttgtgtagcacccccccgctgggtggtgttattgccccgtccccagtcttcttgggggtaggtaccgtagttgcccgcctcgtgggaccggcggtggttcgtgcccccacacgccaacagctggtgcacaccagctcgccctcgtaggtgttgatgaggtgaatgttcttctcccgcaccttttgaggagctggagcgtgtgatgatagatcacagtatatgagatagatggatgggtggacaactctcatatttctcctcaccgccgggtgcttatatagtagatatatagggcttcccaccagaggagtaaagggggggagaccttcttgtggtcacagcagctgcgcccgtgcttgtagaggtgaaggatgtcccctcctcttggatgatggggcccccaccccgcttttaatacttcctcacctaagctctctcccgcgcttgtgaagatatttgcctgtatatggttccctcgttatgcccccacgcgcacttgtgggtcccccccgtctgtgctctgtgtggcgcgcactctcgcgccgcgtagattgtgtacaccctctcatcgctctctgtgtcgccctcctgtggcgctctttgtgagaacacgctcgtgcgagagtgggctccagcgcggagagaatttttggtgagagagagtctccacgcgagactctccacgcgagcagcgcttataaaagacacatacataataaaaacacaaaagagatggtaccctcgagttgtcttccccacttattgaagaggagattgggtggcgcccgcgggaaactcctataaataataccactgagccaccttcctcacatttctggggaaggaaaaggaggactatgagcacagctggtgtgctcaccccctccctagtcaccctccacttaaccaccacgaactaatgtagcggcctggccctagcctctggccgagacctgttcctggccgaactgtggataaccgcctggagggtccggaactgttaccttctttccccttggccattaataaatttaagttaatccc

SEQ ID NO: 596852 - DNA, 893 bp, Homo sapiens
ggcgcaggctggtcctgagcagccgagctcggggtgcggtgcctgccttgcagctcccctcgggatcgcgcagccccatctttgtcctggcctccgcgctttgttctcggtgcccggggccttgtgccaagccatggaccaggcctgccgatgcagaccccactgcctgcgtgctgggccgtcagtccttcgccctccctcgccctgcctagcccaccactgagctgcggacagggcctatgcacacccccattgggttgtccccggtagcagagagcccaggaggtgtgaaaggcacagtggaggcgcgagaaaagtagagatgtgatcatgcgagcctgtgatgggggatattgacatcgagcattgatgtgtggggaagacataacagatggattggaacaaatgtgttgtgaaagacatggaacacaccttgtcggagtgacacaaataaataccacgagatgtggcattacggattgttgatgaagctcggtgatacggtcgcgtgaatggtcccagaaaaaggcaggcaaagggaccaagagtaccatgagtattacttgccattggctacttggtcgtgcttgttcccacgcccatccaaagcagcgacgctggcaatatcacttaggcactacagtacgttgatgtttcatctcatataccggggcttgcgtttgccaccaacaaaggacatgcccataattccacctggacgcacattgcgacacgtgcacgaacagcagtgacacccaaaccttggcccagattgaacacattgaaatggtaatgtggagcgcactctaacctgctcaaacttggtgcccacagtgaccctcaccatcctcatcgacacaagccacatgggccacattacatcctgcctcagg

SEQ ID NO: 596853 - DNA, 231 bp, Homo sapiens
ttctagagtatccccggctgccccgcaagacgggagggaggctggaggctggaggctggaggtctggaggctggagagatggaggagaggagcggagcagtcctcttgataaagggacatgcgaatttgcttacaaatgcagcatcatttccgggcagtgctgggtcgcaatcttcagatctgctggtcaccaatttaaagtgacgccagtttgcgtcttgcgggggtctg

SEQ ID NO: 596854 - DNA, 566 bp, Homo sapiens
  misc_feature (6)..(6): n is a, c, g, or t
  misc_feature (13)..(13): n is a, c, g, or t
  misc_feature (152)..(152): n is a, c, g, or t
  misc_feature (154)..(154): n is a, c, g, or t
  misc_feature (482)..(482): n is a, c, g, or t
tctaanacctcanacaactaaactgtgaaacattcttatttagttagatgggaacattttgctagcccattagaagcacacagaattatccttgtcctcctaatattgactttcaggaataaaggtggggggcgtgatcattcacaatacangngataggtagatatcttctggtttcccattgcaggtgatttgaaaagatgaaggtttaaatattggtaaaaggtgcaggtttttaaatgtgttcctttttcttctgtgaatatttagggcaatcggctcgctaatagaatatgtactagaggggggcgggagggaaattcctctgacttgccaaagaaaaagaagggaaccacaggggatatgctagcattttagctggccaaagggagggacgtggggaaaagggtttccattctgggaaaagcccaaaccgaatacgggcaggattcaactccaggggtttgggcttattccttttnaataatacttttaagcattctttggggggaaataaattcttaaatctccctagttttataaatttttttggaaacttaaagaga

SEQ ID NO: 596855 - DNA, 958 bp, Homo sapiens
gttcggtgtgtcagccccttgtggaacggagatactcgcaggagtggtgataactggtatcatagataccatgaaagttactcatagtgactggttgtcccgcttgcctctaggtgttttcttgctggcctatctagtagacttagctttcgtatgatctagtccggccaggtgtgcgctcggcctcgtggttccgtactaggtgtatgctcgtggactcgtgtgggggtcatcctcaagggtcgagtctcgaacgatggctggcaacttggaccagacctcgggatcctcccggcagtctcttcgcctcaagtatctggctcatgatccagatttgcaggtgtctatgatcggtatcgatggctcggttgtagatgtcgcgtgctggacgaaatatatcaatgcataatctttgtaggaccgcaaggttagtatattttatacctgattgtgcccaagtttcatagttatcaagatggttctcacactcaataggcagttggttaacatgtcttctgtctgttgggaagactggtgtcttggaaatttggctgttcatgatgactgttgacatctgtggtcttgtgggacaggtttgagtaacaagtctaccaaggtgaataagtgctggattcaatggtgtattggactgtcccattaagtccctatctcgtcgcccagggtgtacagtatttggtcatgcaggggtctagtcgtggtactgagaaatagttaactgaggattgttggaattgacaggtgtggtggacagtggaaccagatattggagaaatgagacgattccgatcagtaggcctatcgaagcagggtaataacttcaatggactgtgaacaaaatgttgtttggattaggggcattgggaaaagtagtataggaggcagaataagaggggttagagaattaataacccattggggagaaggtgagacacttagc

SEQ ID NO: 596856 - DNA, 473 bp, Homo sapiens
taaattaatatctatggctgctgaacaatttacagtttttgtacatatgcatgtactggctgggaaaaatctgtatgatggagtgggtgatgcagtcaggtaccaagaaaggcccctcacgtggtgtgtaggtccccctttcccagcaggcaggggctcctgcaagagggggctctgtcagcttctgtgtaacatcacaggcctcgtgctctgctgtggatgtcaggaaagagtaagtggggctacaggacccatctaggtctcccgtccttgggtatagaggtcacagtgattccccaaaattacctctgcctgtggcatcccccatgagaatccatcatgaagagctgactgtgtgtgcggccatggtgggtgcctctcctggagcacatgggtaggacgcagtgtgcagtgcgcaattctgggcccctcttgcccctgaagctcctaagccatccctaacggggattctc

SEQ ID NO: 596857 - DNA, 347 bp, Homo sapiens
agtcatcctctgttgcctttaagatttcagcatggtgaaggaaaagtagcagaagactgaatgcatactcagttttcaagctctggatttaatctttccatagctggaattgcctcctcctcaaaagccttatttgttcatttaattggggcaacatgaaataatgatgtatcattgacagagaacagggggcttaggttctcatcttggtcctagtgattactctatgcataacctcaacttctttatctgtacattgggaacaataattcttactccatttgttgtgttgaaactgaattatataattcataaattaaaacaccaaattctgataaatgctaaaa

SEQ ID NO: 596858 - DNA, 1303 bp, Homo sapiens
  misc_feature (405)..(405): n is a, c, g, or t
agcggatctgacggcgcggttaccatggcggcggcatttgaagcctcgggatgccttagcagtagttgtgcgactgctatgccggctgagcatgtgcgccgtgcaggtcccggcccagatgccaagacccgggcctgtgaggatcctgcgagaaccgctcaggatctcaacagcccagcgtacccgaacgggggattgtgctgttggcggcagccgcgcctgactttcgagctcaccgtgcttgctttcagagggctcgggtgcctggaaggggggctgctgggcgagtcggctttcgacgaagtgccccgtctgccgggttgccagctctaaggtccattcccctgctggggggccggcttggcgggtagctccgacttttgagattacgtagcacagcgtaanactcgtggcgcagccggtgcgcaacagaagccttgtcgtgtttcctccaagcaagtaggcttttgggacagtcctcctttgtttcctctggaacgagacctttaccgttacccccaagaatttttgacgtcattggggcttctttaccaaaaggaagcaacacgttgggcggtggattaacacgaaattaccaatttcgtggatttaacttgacacgacccaaatggggtaattaaaaacactttgggaccaggtgcgtttaaggcaagttgtttcaatgggtctgatatactttcagtgcagtgggaaccccgcgactattagtacaccacaatgaccaaagaaacgccaaagaaccggttttacaacaacaaaccgggttggattcgagttaaattatcggcgcattcgttggagggaagtcatccccttgatggccacgaaaaattttcacagggcaaaaacgttcacattaaggaaggccttttgggaccgttaactttttgggagacctcccaagaggagacagagcgtaatttaccccggcgccatacatttatgaaagtcccgttttggaaattcgaacgagggctgagggaaagtttagagggcagttatgtcaacaggacacccaggcaacaaggcgggcccagggctattccccaacgatgaaaagcgccagaacatatacaacatttgtggcagacaatttgatcagtatgacatatttcccccgttgtggcccatgttggtcccacaagtgaacaaggtgcactcggacctctgcttgtggcgcacatagggctatacattcccaaggcgacgaaaaccgttgacgttagccccggaaacacatttctcgggacgccctaaaggtgggcctttttggagccggcca

SEQ ID NO: 596859 - DNA, 939 bp, Homo sapiens
ggcccggaagtccggtccgcgacagcgccggtgtggtggtagaggagatgcgtgagctgttgggctttgccctcatcgcaggtgcgattgttgatctgatcagtgtgaggtggacatgggcagtgtgtagcgtgcagtccgggagtactaacagggggcgtcaatccaaaagttgagtgtgtcgttggaagggagtgcgtgaatcctcgatatggttgcgaaaatagtacgaggaatatgaggagaaaaattccgtgaaagaaatcgaaggacaggaagactttttgtgaatgtaggcaggtggacttgttcgcaataatatttcattgggtcaagtgttgctatttgtgtgaaagaaggatgactgggtgactttgggttcactataccattaattgtgcatagtgtggggtttcgtgttgggaagttgtaggtagccaagtgtatggtgaaaagattcacaataattgtttggaagagtcgagttgtttccttgagatgggaattttgcgtttgtcagtggaattttaaattatttgatttcccaggggaggaataggtttgttctcaccaaagttgttgaatacctcacggttacgtgggaggaattttggagttcgggtgggcatttgtgtatacacgacattgagggggcgtgacagaaatctttggaggaggatttcttgtggcaagaaaaaaaggtgtctgcgggctaggttggagatatccagtgggtgggatcttagtatttgcacaagtggagacaatgtccaggtggagagttcactaagagatgaaagggcgggagaagtccgataataggggggagtagttggacacatggcagtattgggcaggtgtttaaataagttccaatagttgggtgggaaattggaccgggggaacctttgggttctgttattgagaataaagcgtaaa

SEQ ID NO: 596860 - DNA, 400 bp, Homo sapiens
acaccctttgaacttcagctgtccttgacgagttaggtagtcagcaacgcatcgatccccgcagttaaactgtcccatacttcaagatttctactgctcgcccgggggcggcgtacgtgcagaccagccgagaacgaccatgagcctttcgaaagccgccatcgcttcatttgacgtcgacgcccagaagagcttcacgcccttgtgtcccaacgagttgcctgtgtccggtgtcgacggcattggtgccgaactcaattacatggcctgtctcggccggccaccggatcgggcggctaggacgcccagaccccccaggcaccctgggttgtttgctcagcccagctagatgctgaaacccaccgtcctgggaccgcgacacattgcaccacgacccagg

SEQ ID NO: 596861 - DNA, 358 bp, Homo sapiens
  misc_feature (81)..(81): n is a, c, g, or t
ttgtctgagatgaagctcactccatcaccaggctggagtgccgtggcacaacctcagtcactgcaacctccgcctcaagcnattctcatgcctcagccttccgagcagctgggactacaggtgcacaccaccatgcccagttaatttttttgtatttttagtagagatggggtttcaccatgttggccaggctggtctcaaagtcctgatctcagatgatctgcctgcctcggcctcccaaagtgctgggagaattctacttttttttttttgagacgggtctcactcttacccaggctggatgcagtggcgtcatcacggttcctgcagctcaagcgatctcctatctcagcctcac

SEQ ID NO: 596862 - DNA, 1231 bp, Homo sapiens
ccggtcgacacttcctggcctctggcttgtccttcctcctctgcctctgttgggcccttccccccggtgccttttcctcgaatcctttctctccattggtcgctgtcctcgtctttgggctgtgttttttcttgccttggctcaccgatgcccgttccctgtgtcctctgtgggacttcatgtgggaattgttgtctttgtgcatgttcgttccctcttatctcccgtctatggcgccttgtgtgtgcttttttgctgccgctctgtgtggtctcggcagatttaggcttcagctgggtatacgcagggtacctgtggcgttgttcctcgcgcgtgtgccatccccgttcccttgtggggccctcccatattcaatcatcccttttgatgcaattccccgtgttctgggaactttccatgtagtgggcaactaatgggtcggcgaacgatggagtgaaggtttcgaaggaaccatgctctccccgtcgttggtatgatgcctctctatggccctccttgggaaggtcagcaacagagggagggatgtggattactgtcgccggctgatttgtatgcactgtggtttggtgtacgcccgggtgcctcggtttgccaaacttttgcggcttctgcctgttgtcgaccttcttgggtgcaacgtcaactcgtcccttcttctggggcaatcgtcctgcctagcaaatggaccaagattatctttcagaggtcacctgaaagacatgtgattacattgcacctgcttttagtaatggtaggattgttcttcccagggacctcccgtatcaccctatctctgcttctttagaggtccctggagccaccaggtcaggctgaggggcagggagccggctgtgcccagtatgcctcctggaccctccagttctgccacaggtctgcctgatgccctgtccactgcctacacatgacagacaagttaccccctcatgggggatggggacctacctggctcctctagccagcacccagcgttacccctgccatctccatgcctgggccctccaggctcaagagtctcagctggccgagagtccaggccttgcctcccccgaccgagcatggagggggcagcccaggcacagcctgctgggagcccttgtgtgtctggtcacacttgtgaggcagtcactgccaaaggcaagcctcaatggccccaatacaccataactggagcgggcctgtgcacgcttgg

SEQ ID NO: 596863 - DNA, 382 bp, Homo sapiens
tgagacagagttttgctcttgtcgtccagactacagtgcaatggcgtgatcgtggctcactgcaacctccacctctcaggttcaagcaattctcctgcctcagcctcctgagtagctgggattacaggcgcctgccaccacgcccagctaatttttgtatttttagtagagacagggtttcgccacgttggccaggctagtctcaaactcctaaccttaggtgatctgcccacctcagcctcccaaagtactgggattacaggcgtgagccaccgcgcctggcccaaaatgttaattttataccttgcaaaaaggttaatttatcctcaatggaaacatatgattatattagtttcccccaacatctctggtcgacgcggcc

SEQ ID NO: 596864 - DNA, 1004 bp, Homo sapiens
  misc_feature (228)..(228): n is a, c, g, or t
  misc_feature (861)..(861): n is a, c, g, or t
gggatggtgtgcattcagagcatttgggttgggggcttcctgttccctcagccccagtcgagaggaaagagaatctgggccactgccagaaagagagtcaagcaaacctggaagggcaaatctgagagtgggaatggccaaaggccgaggcccagatttagtattctacttagcagctgccttctgggtagcagtgatgtattcctattatcctcgcctgtctgctgnctgtgctctcttccctaaagtgtacaagtgttgtgcaggaccacctccgcctacttctccaccatccctagcatgccatgccctgttcccatgatcaacctgccatgttggatgtcatgtgcagtgcactcctggagccaagagggaatgggcagggtagagagggtatgtccatgtagcctggatgctccatggtgtgcttcatgcctcccttctcccagctcagtgtgtgccctgagtggctcccttggaacatgtgcctcaaatctgacccaagggcagcatggggaagagatggttgcaggcaaaatgcactttatagagattttctattgctgggaaggtgtgtttctcccacaatttgtttgtgaatattcacttgttttataaatgtctgacctgtcttgaagaaaaaaaaaaaaaaaaaaggggggggggggttaagagttatccttggggggggccaggtttgggttacccggtttatttgtcaattgggcctaattggggggtttaaagttagggtgggggggtttaaatggttggtggggaatggtgttgggtattggggggcctcatgtgggggttaatggccatcctaggggttagtgatggataaattattggattggnacagtggtgtgggtggagtggtggtgttgatagggtgttttatagagtctagtggttgagtaggatgaggtgagtgtgttttatgtgtgttagaattgttagtatagagattgatggtttgtgtgtagtgtatgtttagtgta

SEQ ID NO: 596865 - DNA, 256 bp, Homo sapiens
cactttctgcatatgaggatatgacctacatcctcttgcttaatgtgtgaactaacccatctgcctctgttccctcctgttcatagatgggggctcactgagtgctaatgagactacccaggtagggaccagccacacacaggacttcacgtggatccagttctctttggtcccgactcatatgtaaacaactacctataaataatactcatatacttgtaaggttgtccagttcaaaagactggcccctgtataa

SEQ ID NO: 596866 - DNA, 190 bp, Homo sapiens
ccgtttaggcgcatggactgtattagtccgtctggtcgtccaggagccatgtcatcggtcttacgcgaccaccaacgtggtatagacaaattcgcaacggaccatggacagcctcacccatcaccgccgagaacttcctcggcatagcccttgtcatcaatcgctcgcaggatggtcctgcctttgtgtt

SEQ ID NO: 596867 - DNA, 135 bp, Homo sapiens
tctaacccacaggttactgcgccgaccacacacacacacacacacatagcacacacacaacctaatcatgtaatgatagagcatctggcacacgcatgacaatataaacatgaaataaatgggcctgtgggcttg

SEQ ID NO: 596868 - DNA, 436 bp, Homo sapiens
attgtgggttacaaccagcattaaaaaaaaaaaaagggacaacagagtgcaacataagggatatggttctggtgaagctttctttcaattattcacaaatatattgggtatgtacggggttacaaaataaagcatttctatggaacagggtcaaaaaaatttttggaagttacggtagttgatcttaacacggtcagccaccaaagtcatcggctttaggggataagggaaagaccattcttcacttttaacccaaagggcataaaactaaattggaagtcggtataagggccttaagatatatacagaagtaaaacattttggtctcctaaagtaaaattctggaaacgggaaaaaatcctatttccctcacttagtggaagcttttaaatatcagatggctggagggcaaaagccaatactggaggcgggacga

SEQ ID NO: 596869 - DNA, 1552 bp, Homo sapiens
  misc_feature (524)..(524): n is a, c, g, or t
  misc_feature (541)..(541): n is a, c, g, or t
gtgaccaacatggaaggcgcccaggtcctaattcgggaaacgtgcaccttgactaatacggtttgctgtggcatactgaagagcaggctatggcgggcggaggcgccagtcggatgtcttcatgcaaggaatcgttcttctgtggacataaggcctcacttaccgactccgtccgggatgctcttctagaagcccggtgttttcgaggtggcatgtgcatccacgggctcgtccgaatacaagcaagcagatggaagaactggacaccgaggacccctactggaagggaagaactgtcacacgttgatacgtccctgtgaggactgaccagtacacacgacggggtgcatgcgcacgaatgcgctgtttttcgccagtggcccaacgcggaaagtgtccttttcattacaacctcgggtggacaatgagatatcagatcctggtgaccgctgacgcatgttggctgtgaatgcaactcgaagtgaggactcgacaatatcatgcttgggtaggcccaaatcggnatagtccgaaggaattncaaaggggtatcccagggccggaagccaaaggtaccagccggctaaaagaaggtgggtctgcgagtggtgcacgtagattccgagaagtccataggaagaggagtggccatactggttttgcaaccctggaccacgcaagtatgttgagaaagatcacgtgggtcccttccagggcagggacctcaaacgcgatcgctcactaagcggggcccagctagggcgcgggaaggaactctctagggtgtaaagcgcaaaaggggcccgtggcgttctgtgtggcttcggcacacgtggcccgtggggctagagcgttatcagggggcccataaccgcatacccaattttccggaatttatggtcccccttgaaggacacgggttgccatgtgggaggccttccacgaagttccttgctcggggcattgcgaaaaggaaagaattagctccttaccacataccaccgaggggcctttgttggggacattccgtgccagtagaacaagccctggcgacaagttggtctcccctgtcgtttccgatctttgaacccgttctgtggcccaggccctttgtggttatggaacgccccggaaagcccaaagggagatatggtcccagtgcaatggccctggggtggttgcgcagtgccacgcaagaaggcgtgtgctcggacaaacggcggtagaccggtcaccacccgaaggcgggggacccccaatgggcgcaagacaccaggccaccgcgtttcacgtgggaagctgggaacaggtcccaggggtggtgaactagacccggacgaggagcacagggctgtacgtgcacctcgaccaacaacagtgcggcgggtttcggggccgcaacacacgcggggaacagaagatgcaaccgacgtagagggacgacgggtgcccccctaaagagcaggacgcagacacaagaacgcgcgcaaagtcacgcctaagcggatgctgacgcacaaggaagaagacaagtaggcaggcgacagacgac

SEQ ID NO: 596870 - DNA, 470 bp, Homo sapiens
ttgtccccatgtcctgtaaagtatctctgtctcccagtggaggacctgaatttgaaggccagcaggagcctccttttctgtccccagccttgatagggccaccaggtacaaccaggtctaagagggaggaccagggtccatgtcgtcccagcaacccccactgtcactgttcctggccccaggtcctgcccctacccagggtccccacctccacggcccatctcattttctgttctcatttcacagagttgtacaaggagagaactcagcatgggagggttggttctttggttttgtttgtttgtttgtttgtttgtttaatttaataatttgtaaagtgatgttcctcttcctttttacagttttcagctcatatttaacctctgtttggaaaacgatccttgtaactgtacattttttttttttgcctcctaataatgacaacaataaattaccaattttgtgttaaa

SEQ ID NO: 596871 - DNA, 127 bp, Homo sapiens
  misc_feature (67)..(67): n is a, c, g, or t
  misc_feature (82)..(82): n is a, c, g, or t
  misc_feature (108)..(108): n is a, c, g, or t
aaattgctaatgtattctccccccttcccccaacgccatgacatggccctgtgtgtgtagatgttcncccacgcgtgtgtcnccggtgttctcacttcttcagttccntcatccttgggacggggta

SEQ ID NO: 596872 - DNA, 189 bp, Homo sapiens
atgaacgcagttctgcactgggcagcctgacactgctctgcatgaactcacattggagtagctgctgctatcggagtggctgcagatccagatgagctaataagagggcgacctatcactggaacattgattcatcgtggcacaagtgtagatcgtgtaccgaagcagatcactggctatgcgcatagg

SEQ ID NO: 596873 - DNA, 185 bp, Homo sapiens
gagaatacggagttcagcagggtgctcactgttgtcgacggaacttgtacaggcaggcatgcaccgtagtggtgaatacacgtcgaccaggctccatcttaacgatctgagagacgtcattcacggtgctcacgtgtcgacggaactatgtacagggaggcatgcaccgcagtggtgaagtacac

SEQ ID NO: 596874 - DNA, 112 bp, Homo sapiens
gtaaaagcacagaggggacctggggtgcatcagctttctgtagggtctgggaccctgccggatggctgcctcccccatccccaacacagcttggagcacttcgcaccgtcta

SEQ ID NO: 596875 - DNA, 353 bp, Homo sapiens
ttacactcacttgctcctatgacctctatatgactgcaatgacttgcatgtacatacgtgctataactttggcgcttccatcaagagtctatcggcaaatgtgttagtgagctggaggacgactggtggcagagttttcactgagaaagcactgacgataaggcaaatcattgatgaatttgattacatcctcaaaaacctaaagacggaaatatcattcgactcagcaatcccattactaggtatatacccaaaggaatataaatcatcctattacaaagacacatgcacgtgtatgtcattgcaaaactatccacaatagcaaagacatggaatcaacctaaatgcccatc

SEQ ID NO: 596876 - DNA, 586 bp, Homo sapiens
tgagacagggtctcattctgtcatccaggctggagtgtagtggtgtgatcttcttggctcactgtaacctccacctcctgggtccaagtgattctcgtgcctaagcctcccaagtagctggaattacagacatgtgccatcatgcccagctaatatttgtattttagtagagatggggtttcaccatgttggccaggatggtcttgatctcctaacctcgtgatccacccagctcggcctcctaaagtgctgggattacagtcgcgagccaccgcaaacagcagacacccttgtatctttccagctgtctttgatggtagctttaagcttcataattccatcagggatacactactggttttttacttactctttggctaaggcagagaagctctaagaacttccacttggttcttcctttcaatgaagttcttactacacacacagtcaaatgaggcttacagatactagaaatatcatggccagacataccttcaagaatggagtgaagaatcatagtatgggttcaaagtgaaactgggcatgatggactgtgtaatgtatattgtgctcagttcaaaatcta

SEQ ID NO: 596877 - DNA, 379 bp, Homo sapiens
tatttaaggtacagatggtcctcagttacaatggttcgacttacaatatttggactttataaatggtgcaaaagtcatacgtactcactagaaacagtactttgatttttgaatttttatcttttcctaggctattggtatgtggtagtatactctcttgtgatgctgggcagctcccagtcagccacacgatgacaggggtaaacaaccacgagatgatcaacactttattataaaataggcttcatgttattttgttcaaccgtaggctactgtaagtatgctgagtacatttacagaggctagtctaagctatgatgttcagtagactaggtgtattaatgcatttttaacttaatagtattttcaactattgctt

SEQ ID NO: 596878 - DNA, 141 bp, Homo sapiens
tacatgactgtcaccgctcagctgctcctcacgctcgggactgtcgctgctcttcttcttctccgccggcaggtgcgggcagcgctcctcctcctcctccaccctggcctctaggtcatggcagtctctcttctaattcct

SEQ ID NO: 596879 - DNA, 2380 bp, Homo sapiens
  misc_feature (2192)..(2192): n is a, c, g, or t
  misc_feature (2195)..(2195): n is a, c, g, or t
  misc_feature (2211)..(2211): n is a, c, g, or t
  misc_feature (2218)..(2219): n is a, c, g, or t
  misc_feature (2242)..(2242): n is a, c, g, or t
  misc_feature (2254)..(2254): n is a, c, g, or t
tttttggggtctttgctcatgaactataatatgactaagctgtgcatacatagtttatgcaaccgaaataggttgggcagcacatactatacttttcattaatacttttaacaattgtagtatataaagaagggagtgaccgaaaacggtcgggaccgaaaacggtgtatataaaagatgtgagaaacacaccacaataccatggcgcgctttgaggatccaacacggcgaccctacaagctacctgatctgtgcacggaactgaacacttcactgcaagacatagaaataacctgtgtatattgcaagacagtattggaacttacagaggtgcctgcggtgccagaaaccgttgaatccagcagaaaaacttagacaccttaatgaaaaacgacgattccacaacatagctgggcactatagaggccagtgccattcgtgctgcaaccgagcacgacaggaaagactccaacgacgcagagaaacacaagtataatattaagtatgcatggacctaaggcaacattgcaagacattgtattgcatttagagccccaaaatgaaattccggttgaccttctatgtcacgagcaattaagcgactcagaggaagaaaacgatgaaatagatggagttaatcatcaacatttaccagcccgacgagctgaaccacaacgtcacacaatgttgtgtatgtgttgtaagtgtgaagccagaattaagctagtagtagaaagctcagcagacgaccttcgagcattccagcagctgtttctgaacaccctgtcctttgtgtgtccgtggtgtgcatcccagcagtaagcaacaatggctgatccagaaggtacagacggggagggcacgggttgtaacggctggttttatgtacaagctattgtagacaaaaaaacaggagatgtaatatctgatgacgaggacgaaaatgcaacagacacagggtcggatatggtagattttattgatacacaaggaacattttgtgaacaggcagagctagagacagcacaggcatgttccatgcgcaggaggtccacaatgatgcacaagtgttgcatgttttaaaacgaaagtttgcaggaggcagcaaagaaaacagtccattaggggagcggctggaggtggatacagagttaagtccacggttacaagaaatatctttaaatagtgggcagaaaaaggcaaaaaggcggctgtttacaatatcagatagtggctatggctgttctgaagtggaagcaacacagaatcaggtaactacaaatggcgaacatggcggcaatgtatgtagtggcggcagtacggaggctatagacaacgggggcacagagggcaacaacagcagtgtagacggtacaagtgacaatagcaatatagaaaatgtaaatccacaatgtaccatagcacaattaaaagacttgttaaaagtaaacaataaacaaggagctatgttagcagtatttaaagacacatatgggctatcatttacagatttagttagaaattttaaaagtgataaaaccacgtgtacagactgggttacagctatatttggagtaaacccaacaatagcagaaggatttaaaacactaatacagccatttatattatatgcccatattcaatgtctagactgtaaatggggagtattaatattagccctgttgcgttacaaatgtggtaagagtagactaacagttgccaaaggtttaagtacgttgttacacgtacctgaaacgtgtatgttaattcaaccaccaaaattgcgaagtagtgttgcagcactatattggtatagaacaggaatatcaaatattagtgaagtaatgggagacacacctgagtggatacaaagacttactattatacaacatggaatagatgatagcaatttgattggtcagaaatggtacaatgggcatttgataatgagctgacagatgaaagcgatatggcatttgaatatgcttattagcagacagcaacagcaatgcagctgcctttttaaaaaagcaattgccaagctaaatatttaaaagattgtgccacaatgctgcaaacattataggcgagcccaaaaacgacaaatgaatatgtcacagtggatacgatttagatgttcaaaaatagatgaagggggagattggagaccaatagtgcaatttctgcgatancancaaatagagtttatancattttnnggagccttaaaatcatttttaanaggaacccccanaaaaaatcgttagtatttgtggaccagcaatacaggaaactcatatttggaatgagttttatacactttatacaagagcagtaatatcattgtgattccactaatcattttgggtggaccgtaaac

SEQ ID NO: 596880 - DNA, 421 bp, Homo sapiens
tgatggagacgccatcctcttggcccagatggggaactgagccgcaagcagtggctcggcagccactaaggccgaggtttagaaaagtaccactcttgccaagaaggaatgtgagggaaaggccaggaggctgggcgatgctggtggtgtgactttgagctggcgtcgtggtttgtggcgtcctcagaccaagcagcggcagcacggcacaaaggttggggcatggcttcttcacacccagctcctccactcacatgtgctgcaaccccgggcaagccgcttgcctccctgaacctcagttttctcatccataaaatgaggtttaggatcataagactgccttggctgggcgtagtggctcacgcctgtaatcccagccattcgggagtttgaggcaggagaatggcgtgaacccgggagg

SEQ ID NO: 596881 - DNA, 1112 bp, Homo sapiens
tttttggggtctttgctcatgaactataatatgactaagctgtgcatacatagtttatgcaaccgaaataggttgggcagcacatactatacttttcattaatacttttaacaattgtagtatataaagaagggagtgaccgaaaacggtcgggaccgaaaacggtgtatataaaagatgtgagaaacacaccacaataccatggcgcgctttgaggatccaacacggcgaccctacaagctacctgatctgtgcacggaactgaacacttcactgcaagacatagaaataacctgtgtatattgcaagacagtattggaacttacagaggtgcctgcggtgccagaaaccgttgaatccagcagaaaaacttagacaccttaatgaaaaacgacgattccacaacatagctgggcactatagaggccagtgccattcgtgctgcaaccgagcacgacaggaaagactccaacgacgcagagaaacacaagtataatattaagtatgcatggacctaaggcaacattgcaagacattgtattgcatttagagccccaaaatgaaattccggttgaccttctatgtcacgagcaattaagcgactcagaggaagaaaacgatgaaatagatggagttaatcatcaacatttaccagcccgacgagctgaaccacaacgtcacacaatgttgtgtatgtgttgtaagtgtgaagccagaattaagctagtagtagaaagctcagcagacgaccttcgagcattccagcagctgtttctgaacaccctgtcctttgtgtgtccgtggtgtgcatcccagcagtaagcaacaatggctgatccagaagtttccagatgaggaaactgacgggtaccaagcttaatgacttgacgaagctcatagagattagcaggtagtacaatattgacggtggactcctaattcgcggagtctacccgggccacgggtggaaatgaaggcggacagagctccgtgaatggttgcacggccgagtctatccaaagagaataccccaagaacacgcaagacatggagccacgaccaagacaacgtcaggaaactccacccacacacacacagcgacacgcgcacag

SEQ ID NO: 596882 - DNA, 490 bp, Homo sapiens
gcgaattcactagtgattatccccggttcctgggtacagtggctcatgcctgtaatcccagcactttgggaaggccgaggcggacggatcacgaggtcaagagattgagaccaccctggctaacacggtgaaaccccatctctactaaaaatacaaaacattagccggacatggtggcagcaacctgtagtactagctactctggaggctgaggcaggagaatggcgtgaacccgggaggcagaggttgcagtgagctgagatcacaccactgcactccagcctgggcgacagagagagactccctctcaaaaaacgaaacaatgttcttggctgggcgcagcagctcacacctgtaatcccagcagtacgggaagttgaggcgggtggattgcttgagcccaggaattcaagaccagccagggcaacacagcataagccccacacctcttcgaaaaaacacaaaattagccggtcattgtggcacaccc

SEQ ID NO: 596883 - DNA, 2561 bp, Homo sapiens
  misc_feature (342)..(342): n is a, c, g, or t
  misc_feature (345)..(345): n is a, c, g, or t
  misc_feature (360)..(360): n is a, c, g, or t
  misc_feature (424)..(424): n is a, c, g, or t
  misc_feature (486)..(486): n is a, c, g, or t
  misc_feature (498)..(498): n is a, c, g, or t
  misc_feature (512)..(512): n is a, c, g, or t
  misc_feature (2373)..(2373): n is a, c, g, or t
  misc_feature (2376)..(2376): n is a, c, g, or t
  misc_feature (2392)..(2392): n is a, c, g, or t
  misc_feature (2399)..(2400): n is a, c, g, or t
  misc_feature (2423)..(2423): n is a, c, g, or t
  misc_feature (2435)..(2435): n is a, c, g, or t
tttttggggtctttgctcatgaactataatatgactaagctgtgcatacatagtttatgcaaccgaaataggttgggcagcacatactatacttttcattaatacttttaacaattgtagtatataaagaagggagtgaccgaaaacggtcgggaccgaaaacggtgtatataaaagatgtgagaaacacaccacaataccatggcgcgctttgaggatccaacacggcgaccctacaagctacctgatctgtgcacggaactgaacacttcactgcaagacatagaaataacctgtgtatattgcaagacagtattggaacttacagaggtatttgaattngcntttaaagatttattngtggtgtatagagacagtataccgcatgctgcatgccataaatgtatagattctattctagaantagagaattaagacattattcagactctgtgtatggagacacattggaaaaactaactaacnctgggttatacnatttattaataagntgcctgcggtgccagaaaccgttgaatccagcagaaaaacttagacaccttaatgaaaaacgacgattccacaacatagctgggcactatagaggccagtgccattcgtgctgcaaccgagcacgacaggaaagactccaacgacgcagagaaacacaagtataatattaagtatgcatggacctaaggcaacattgcaagacattgtattgcatttagagccccaaaatgaaattccggttgaccttctatgtcacgagcaattaagcgactcagaggaagaaaacgatgaaatagatggagttaatcatcaacatttaccagcccgacgagctgaaccacaacgtcacacaatgttgtgtatgtgttgtaagtgtgaagccagaattaagctagtagtagaaagctcagcagacgaccttcgagcattccagcagctgtttctgaacaccctgtcctttgtgtgtccgtggtgtgcatcccagcagtaagcaacaatggctgatccagaaggtacagacggggagggcacgggttgtaacggctggttttatgtacaagctattgtagacaaaaaaacaggagatgtaatatctgatgacgaggacgaaaatgcaacagacacagggtcggatatggtagattttattgatacacaaggaacattttgtgaacaggcagagctagagacagcacaggcatgttccatgcgcaggaggtccacaatgatgcacaagtgttgcatgttttaaaacgaaagtttgcaggaggcagcaaagaaaacagtccattaggggagcggctggaggtggatacagagttaagtccacggttacaagaaatatctttaaatagtgggcagaaaaaggcaaaaaggcggctgtttacaatatcagatagtggctatggctgttctgaagtggaagcaacacagaatcaggtaactacaaatggcgaacatggcggcaatgtatgtagtggcggcagtacggaggctatagacaacgggggcacagagggcaacaacagcagtgtagacggtacaagtgacaatagcaatatagaaaatgtaaatccacaatgtaccatagcacaattaaaagacttgttaaaagtaaacaataaacaaggagctatgttagcagtatttaaagacacatatgggctatcatttacagatttagttagaaattttaaaagtgataaaaccacgtgtacagactgggttacagctatatttggagtaaacccaacaatagcagaaggatttaaaacactaatacagccatttatattatatgcccatattcaatgtctagactgtaaatggggagtattaatattagccctgttgcgttacaaatgtggtaagagtagactaacagttgccaaaggtttaagtacgttgttacacgtacctgaaacgtgtatgttaattcaaccaccaaaattgcgaagtagtgttgcagcactatattggtatagaacaggaatatcaaatattagtgaagtaatgggagacacacctgagtggatacaaagacttactattatacaacatggaatagatgatagcaatttgattggtcagaaatggtacaatgggcatttgataatgagctgacagatgaaagcgatatggcatttgaatatgcttattagcagacagcaacagcaatgcagctgcctttttaaaaaagcaattgccaagctaaatatttaaaagattgtgccacaatgctgcaaacattataggcgagcccaaaaacgacaaatgaatatgtcacagtggatacgatttagatgttcaaaaatagatgaagggggagattggagaccaatagtgcaatttctgcgatancancaaatagagtttatancattttnnggagccttaaaatcatttttaanaggaacccccanaaaaaatcgttagtatttgtggaccagcaatacaggaaactcatatttggaatgagttttatacactttatacaagagcagtaatatcattgtgattccactaatcattttgggtggaccgtaaac

SEQ ID NO: 596884 - DNA, 217 bp, Homo sapiens
tcagtatcatctccctggaccctgggcagtactgcccccttttcacgcctctcccattggtccctggcctcctctgccccatccacgctgagttagccttccccgtcctcgagccccatgtctcgccataggtaaccttgagagactgggcacgattccatgtgcacgctgctgcacttgagacggggctcgaacttccatttccccacattccacc

SEQ ID NO: 596885 - DNA, 135 bp, Homo sapiens
gtagtcatctagatgatcccttttatatcagcaacgcacctacccttcgcctgcttaggagggacccacctagggcccatctcagtaaagggcacagaactagcttctgggtgtgctgccttctcaaaagggaaa

SEQ ID NO: 596886 - DNA, 1289 bp, Homo sapiens
gggccacccttttagggcaccgctttgtgttttatgcgagtggtgtttcttatcttgctgggggcctatgttcgaaggggccttgtttttcactagccccgcgcgccccctgagggtttccacgcttttacgtcttttttccggcggggtgttctcttgaaaaagggtgtgtccccgcaccttgtgggtgtagagaacgcgggtatataaaagtgtggtttttaagaggcatttttggccctgcaagagttgtggtgacacacggggtgtgttctcgggggggtgttcccacggaattgccgacttgtgccctgctgtgctttttggggggtttttatgtgtgtgtgttccccctctgccgtgcgcccttgtgtccgctgcgctgttaccgcccccgtgtttgtcgcccctgtgggaaccacagggtcccctttgtggaaataaaaattttccccccgaagggggaaatttctctggtagccgccaatacccctaaagccccgcgggtgttgtttcctcaaattccatagccggggattaacttttagtgtatgtttatatagagacatggtctcgggacacttactcgcttgaacacgttaaagattgtgtgggggctttgagaacgatcttgtaaatttgtgggggccaccccgtaaaagggtgtgaatcccccccgagagggctgtaatctttgccccaaaatccaacgcggcaacacacggagtatttgtgggtaatataaaagacccccggtgtttctcagcgactgtggggacatctttttctatagaaaatatataggggggtttagagaataggggtgttggacacgcttatatatttgttaacacccaatatttcgcggagaagagaagagattgtgtatatttttcacacagcactgttttgtgggttttgtggcttctcctttgtccaccaagttctttgttaacgctttgtggaattgttacactaaataaaagattctccctcctggagttaatatttttttttgtgctcatactctggggaatatatggaaatcttcgcgggcctttaactcggtaacaccccacagttgtgcccaaagaggtgtgaattcacctctttaagcccggaacactggtgtaatttgcacgccctctttccagccacggtggagtggttctcttttttaaaaacacttcgtttaacggggaaccccttgaatattttgagagggggaagttaaatataaaaaggtataggttttttttttttttttaagaaaaccattaacctttcca

SEQ ID NO: 596887 - DNA, 120 bp, Homo sapiens
tgccagaacagaagtgcagcatgctgcacaccaactcaagggtgacctcctccaacaagatggacaggatggagctgccgtacatgtccaccaccttctggcactctttcgacagggact

SEQ ID NO: 596888 - DNA, 179 bp, Homo sapiens
gcacctcttgttgtggacatcacttacgctttctcatagtgcatgtcacttatgctttcttggtgccctcccagatgacccccccttttggccattacaaaaaggttcaccccgcaaggggcaggcaagggttgtctacttacttagaccttcaagtgtggtgttcagagacaaagcca

SEQ ID NO: 596889 - DNA, 181 bp, Homo sapiens
  misc_feature (117)..(117): n is a, c, g, or t
  misc_feature (146)..(146): n is a, c, g, or t
  misc_feature (163)..(163): n is a, c, g, or t
aagtcaaggttgcccccaggcggtccttcctggtgctttggaatatgttattccactgccctctgggactccattgtttctgatgagaagtcagctgttaatcttattggggtttcnttacttcgacccccaccacttctgggagnggagcagcttctcggantacgtgcagtgcgtcctg

SEQ ID NO: 596890 - DNA, 191 bp, Homo sapiens
ccggggggtttttgttcacccgggccccccgtcttccccccggtccccccatttataggcataaaatccccggtttgccacccccccttccccccccccttttggtccattggggtaaaaaatgtaaaccaaaaaaattttatgacccacctggggggtgtgaaagagagaagaaaacctggaattcttta

SEQ ID NO: 596891 - DNA, 844 bp, Homo sapiens
ctccagtgcgcggcgtctgtggcagagccgggctgcgagcggcgcgcagcacgcaggggaaaacgagctgagcggaggccaaagtcagccgggagacagctgcggctctgctgaagcagcaccgaactagaggggctggggccacgcagcgccattgacaagcaatgcgcggaagcaaacagaaacaacacacgagcgacagcaccagcaccaaggcatgacatcgactcttgcactgccttggctgccagaacatagcaacgcgagcctggtgctgccaacacgaacagcgcagccctccaaaacgctcaacaagcgcgcaaaaccgacaaacacagagcacacaccacaaagcaggactcctgcactgcacaccatgactatcctgcaaacgaacctggcacaccaatcgctcttccggaagcctcaaggccactcacaacggctgaccagagcacaactgtcgcccgtgaaccccaacacgaaaacacatgcacgacggacattcaccctccccaagcacttaccacccagcacggcacaggaacaggaacgcggccaacacacgcagacgcttccctgactggactccttgactcgcccacaccaccttggcccggcattacccgccctcccagacactccaacacaagacctggcaaaacccggtacaggctggaacactgtacctcctggcgaagtctgctgacttaattggattcattcttgaaccagatctttaccgtaacactaagccctacacggggcaaggctccacagcattccaccttacaaagcgcggaatgagggcccgaacgacggacagagggatttcccgccacgc

SEQ ID NO: 596892 - DNA, 263 bp, Homo sapiens
agagacccccctcgtactgcgctgccacagtctcatcccatttccagctctgtattaaccaccaagctgcatcggatggggcaagacctaagctcattaatttccaggtggaggaaatggaggaggggcacgtcccttcattctagggaggagcatggaaaggaggccaacagctggatccttcttgcccaggaagcctggtgcatacctttcccccgagcatgggataggcctgggtttttcaaggccaagggccctcaggg

SEQ ID NO: 596893 - DNA, 295 bp, Homo sapiens
  misc_feature (5)..(5): n is a, c, g, or t
  misc_feature (114)..(114): n is a, c, g, or t
tctcnaccaccacaaatgagactctgggccatagtttcccttcattgacctctctggatgtgtcttaagggacttcacggagggtttcaagcttccaccaaagtgtgccctganctccatggataccatctctttagagcaaaggaccaggggcggacaatggcataagccccaggtttgacgaccgctagctgtgagtgagggaggaggctgggcttcctggagcctccgccacgaccccaatagggccctccttgtctgcccctctgaaactagcgcagcctctgcactgatt

SEQ ID NO: 596894 - DNA, 414 bp, Homo sapiens
  misc_feature (184)..(184): n is a, c, g, or t
tgccacgatctcgatcttggttcactttacgctccacctcccaggttcatgccattccgctgcctcagcctcccaagtaactgggacttcaggagcctgccacaacgcctggctaatttttagtattttcagtagagatggggtttcaccatgttagccaggatggtctcgatctcctgacctnatgatccacccgcctcggcctcccaaagcgctgggattataggcgtgagccaccgtgcccggccaaggcttaataatttcttgtccaacccttgtgatactctcattctcccagaaagtctaacagttaaagatagaaattttttcagtgtctccacatcgtaaataatattggtatacctcatgatctcctagtttctgcacataatttgctgacttcagtaccctgag

SEQ ID NO: 596895 - DNA, 130 bp, Homo sapiens
gtgagaacaaggtgggagggaggatggtgcgtcatttaacattaaattgccatctctctacagtatgtggctgaacatcatggaccttcctccactctgccccgtagagctcccactgttagcaaaactg

SEQ ID NO: 596896 - DNA, 296 bp, Homo sapiens
aaatagtcataattagtgtgtttctcattgagaaatatactgggataaatggccgggtgcagtggctcatgcctgtactcccagcacttcgggaggtggaggcaggtggatcacctgaggtcatgagctcgagaccagcctggccaacatggtgaaactccatctctactaacaatacaaaaattagctaggcatggtggcacatgactgcatgactgtaatcccagctactcaggaggctgagaactagaaagagatacgtgggacacccgacaactgccgaaaggccgatctga

SEQ ID NO: 596897 - DNA, 919 bp, Homo sapiens
tttatgtaattaattaaatcagggatatagatttgatctgtaatttgggtataattctaatctttgctgaaatcacattcaagtataatgaggcaactttatgcaaatgtacttgttgtgacaacaataacattttcctttttttttttttttttggaaaagtctcgtttctgtcacccaggttggggtgcttggtggtgtgaccttggctcactggcaacctctgcctcccggtgttcaagcaaattctactggcctcagtcttcctgatgtatgttggtgttaattcacaccacctatgcccagctattttttggttcttttctagtagagacagggtttcacctattattgggccaggctgtggtttcgaactcctgacctcgtgatctgcccgcctcggcctcccaaagtggtgggattacgggcttgacccagcgcacccggcaacaataacttttaataggctttgtctcattctaatgattattataccttctacctagggggcacttggtcctatttttatttttaatttaatttatccatttttttggagacagagtctcactctgtcaccaagttggcttgcgtggcccaatctcagctcactgcaacctccgctccaggtgagtgatctccagctcagcctcccgagtagctgggactccaggccgtaccaccatcccagattttttggctttagtcacacagggtttccccctgtcggttcgagtgtctccatctcctgactcgtgtccgcacttggccccaagtgcgggttaccggttagccccactgcgcattttcgcttcttctgttggccctgtttggcccttaaagaacttccctggtcctcccactttttggtcgttaccggtttcaaaagggcctcgcgcccttgctctttagcgcgaga

SEQ ID NO: 596898 - DNA, 219 bp, Homo sapiens
  misc_feature (6)..(6): n is a, c, g, or t
atctancaaatataacttacccacgcaagcgttttcacatagctatcttgtagaaatggactcagatctgtatcataagcaagttgttcggggtcttctggggagaggatccacttctgtagggaatgaccggctatcacaatcacttgccatgctcgctgtgctagattaccatgtcttgtgttaatcattcctaccaggtttcttttgtcagaagca

SEQ ID NO: 596899 - DNA, 2027 bp, Homo sapiens
gacgcagcctacacctacttctacaagggcaccaaatactggaaattcgacaatgagctgcctgctggatggatgccctgtgctaccccaatgtccatccatgcgtggacttcatgtgtgctgccagtgatgcactgtgtgagccagtgcccccgcactggccctgactgtgtgacctgtgccgcccattcaacctcccactggcggcgtgacatgaatgaccctgtgggactgggcacagactgtcacggatgtgtgcttgacacggtcgtggtgtgggacttgcgcggaacttggcgagcaacatatctgctgtgcgcccagtagtggactccaacccacaactgtgacacgttatctctggcccatagactacgaccgcttgggaacagagcttgcaaagaacttgctccacgtgaacgccgcttgtggccacggcgtcacctggctgcagaccggctgcgctggcacttgagcctgacttcgcgcatggcgtcagcgtgcccttcgcccttgtctcttgccctctacttgcccgcctacgccctgacgcgacgccatccgacccactaccggcacgctcgctgcgccttcgccctcgcgactgcccacgccgcccaccagccgcgcattgccgtaccctacagtctcgctctcacctagtaccttcactcaccacctaggcaaaacacgacggcacctcctgccctcggcacacagaacgaaacggcttgccgcgaatccagtggaagaccgagaactcccacacggcaaaaccgctacccattcgcgagtaaagcaccgcgcgatcgaccaatccacgccggagctagcagaggtgcaccattgtataggtacatcagtccttcgcacagccaacttgaagactattccaccaaggcgggagtgaacattcagccacatatcaatagcagacacacaacaaacaagagactaacgcagtagagactataccacctacttaactgtaccaggcacccacaattcctaataccactactagaacacccaactgtcgatcacattggaacacatcaccgtgaaatacactacttccacaatttacagcagttccagcacacttgtgattcaccagatgccgacatggccttacacgcgcgaagcacacgtgactacatcgcacggagcctaacctatatcggtcaccataagcactacaatcagaatacgtaaccactcaccatacaatgactatccgaactcagacggtgtccccaccaactccgaccactatcgtgccacaacactcgactcctcatatcctacaagaacacgttaatagcctaacaaacctcgacttgactcacctaacaatacaacagacaatagtagtccacatttaacgataaccctcgcaatctcatcacataccctcctactcttctagcccacaacacccacatccccaatacctaccccatcagcacacactcaccctccctacatcttcacatccacacactccagctccacctcccaccacctcctaccccaccgactgagacagcctgcacaccgctacccataacacgccacacactatccagtcacagcgccgtgtccccgccgacacccacatcccttctccaccgactacacctaccacgcgcaacttccagacagccataccacagacgcggaactgcaccccgcacacggacagcataataaaccattaccaccccacatacatactccaacactacagctcgaactctccacctacagactacaagccacacaacacactccagtcaccaacgctcactacacacaacatcatatcacgcttctcccagtcaccatctccctcagactctacaacatcgatcacaaacctaacatttcaataagaacaccaaataacatactatcttagcacatccgtccaaaaacttcacaactaccatacaaccctcacatccaccacacactcatcatactccccacctccaacacacaaaccaagccaccacaccacaata

SEQ ID NO: 596900 - DNA, 515 bp, Homo sapiens
ctacgactctgcccacatttaggtctgtactctcccattacacataggttcgtctcagcatgcaagagttgtcctttgaaaaaaaaaaacaaaaaaaaagaacaaagggcgggacgatccataaaagacaatagggacgcggctcgtaatacaacccgattgatagagagtgaaatagaaagaataatcaagcctctagaattcttttcgaatcatctagcagcgagggataccacgccggtagtccagaggacattgaactaatcattacgagatgacaacacaagtataatatacaacttaaaaaaacgagactaaaagcacaaacgcatcagcccggaacgaacacctaccgcctgcagaacaacgagacgtagagaacccacatacaagacgcgataaacagatagcaaataagaaagctgacaaaccaatagcagcaacagatacgatacattactcaataatccgagaagatcaccatcgagacagagattgatagaactcgagtacaa

SEQ ID NO: 596901 - DNA, 484 bp, Homo sapiens
tgggctctaaagggggtaaagggggtgctatagggtaaataggggccctatttcaaaaatttaaggggaataattctaggagatgggttgaaatggggtgttggctccaaaaatttaaagcattgaccggtagtataccccgggtcgtgtagcggtgaaagtggttgggttaagacgtccgggaatggcatctgttttaaagcctaatggtggggacagctcatgagtgcaagacgtctggtgatgtaattattatacgaaggggggcttcaactcgggagtactactcgatggtcaacgtcaaggagtcgcaggtcgccgggttctaggaataaggggggaagtatgtaggagttgacaaataagtccgccgaagtcggggtactcgtaggttcagctaccatggggggccaatggattcggagggacgggagggcatcgtagacctcgtcgggatgtaaaggatgcgaagggatgtggaggg

SEQ ID NO: 596902 - DNA, 1044 bp, Homo sapiens
agcggggtggtttcgcagagtgggtatcgaattcgcggtggccggtacctgggaggtccggtatacggcgcggtggtgatggcgaaaaccagtgcttgtgcaggactgggtgtatcgcgtgagtggcacctacccgagggtagacaatccgggaaggaaccagggtacacgtgcgccgggaattggtgcgcgagacaagaagtgagaccaggatgttgcgcctcgtgatactgccatcacatgcgtagcagacaatgagcgtcctgtaggcctaagtgagcgtccaaggcacaggcaagagcctgacccggcaacatctcgacaggacgtgatcatgtgctcaatgccgaaatatgagcaaagtgggatgttggaaggatcgcgtccaatggacgggattgcagtgctcagaatcgagggtggattgaggcatggagtcgtgtcgtagcatagagcatagaatgaatcatcggaacatttgtttatcattggcagaggcagatagtagaagcaaaaatcgggggagagcatagggaatttaaggttgggagcagtgccaggaatacctgtatcggcaaatttgccctgtgccaggtagtcccctatcagtgggaggcaagagaggctctctttgcgtcagagtcacacaccccaattggggccggcattctggttgggatcggaacatttaaagggctggttctgttggcgccgttccgcccaatttcccagtgatgcgcatggtttcatttccgcatgggcacgaattgtaaccttacccggtggggggacctatcccccggacgtgggtttccagcgaatgttggcctgggcgcggtgtgccagtcttaatatcgccggtacagaggtatgttggtcgccttgtcaagcaatggacgtgtccgttgttgaggccatggatggaaaaaccgccttacgttggtgtatgtatctccgcaagtgggttggttctcacaagattggagggttccctatgtgggggtttgcccccggccttgtcggtaccttctcggaatagggaat

SEQ ID NO: 596903 - DNA, 321 bp, Homo sapiens
actacatacttccggaccagatctaagggaccatacagagtattctgctctgaacaccaggtccaggcattgaggcagaatgagatccgaggagcgaatgctgccctgcatacgaccccttgagcttcagcagctgagggtgagacagccttgccggcctaaacttgagggcctatgcctccggaacactgcggagccatgccaacggagggtgcctgacccatgccgcctgagagtggctagcccatgccgcccgaggcttgcagagccatgctaccagagggtggctgacccatgccctttgagagctgctctagaacg

SEQ ID NO: 596904 - DNA, 273 bp, Homo sapiens
ggtgtaatgtggagaaaacgtaagcaacggtctctgtgtctaataagtttaaggaaaggtgctgtgcctcaatgtgcatgtaggccaggtttatatttgactttacacaaacatctcagtgcagtaaagagcagtattgccgccagcatgtctcacctccagccataaggcggttttctcctatctcagtaaatagaatgtacaatcaggttttacagcgagacgttccattgccaggacgagcaggagacagatgccttctccacatctcct

SEQ ID NO: 596905 - DNA, 93 bp, Homo sapiens
ttcaagcttcttaaccgatgtacggcggacatggttgtggttacatctggtgttattttctgttccacaagttaaataaatcataaaacttga

SEQ ID NO: 596906 - DNA, 191 bp, Homo sapiens
cagaccctgtgtgaagggcttgcagctattaataaacatacatcaggagatacagaggaagctttgtgtatgctggtggcaaatccagcaagtacagcttgaagcagtgagttgcaggcaattggaagaggatcaacctctgtctgtcccctgctcacgtgtcattgggagcctccagagcagaaggagtg

SEQ ID NO: 596907 - DNA, 372 bp, Homo sapiens
tgcgcgaaagtctgcaatcgggagagggcaaagagcgcggaatattttgcaataagtgacaagacaatacccgagtcaccggtgtgtatggctataatcctctaaatgggcttcagaattccttggtgagttcacaatggctgataaccagagtgagacgaccttcatatgggacttgatattctctaatgctcgttccaggtctgaaaatcgtttcaggtttcattcaaggagagccatgtcctcaagcggaaaaatgatcatccaattaacactgtcttcatgtggttttataagagattagcatctgcaatatcaaactattatttaccaaaacagaccataatctgcagacctgtgttacgtctaggt

SEQ ID NO: 596908 - DNA, 732 bp, Homo sapiens
gacatgaaacggatggtttcttgcagcttccactaaacttaaaaaacccatgaaacatctattattgctactattgtgtgtttatcgtagttaacgtcccagacggtgtcaactgacgaatagagcgagggttgttcttcgatgctagcccagtgagatctatccgaccccgtatgaaccacagcacatgagtagtaagcaggctcgcctagactctgcaggccgtgcctccacgcgcgcgcatcaagtgggaaggtggcttgatctgggctcgtccaatgcctaaaagctagctggccactcaaaagagaaagctagacatagaaataagtcccctggatgctggtaggctgtgcttgcagcgtctgatcccagagcctggggtggctgttggtgttccttagcaggtactgcttcacgtttggctaagagcgctttcggtagcaatcagggaacaggtccagaatcaagacaaatgaggttgtttggaatagctcgtataaaaattatagcagaatgttcggaaattgctagtttataccccagggaaggcatccatccatttccttcccttgtttccaggataaccaattgcttacttctcgccgttgaagaaaaggatccctagcttgggtaataaaaagtaggggcaaggaacagcgcaaggttagaacagaattgattgacagcattgttaaatccaaaatgacagtaccttcacctcctagaaac

SEQ ID NO: 596909 - DNA, 134 bp, Homo sapiens
  misc_feature (95)..(95): n is a, c, g, or t
tgatctaaggatccccccgatagccgaaggtgtctaagatcttctcccaatcagagatttccttcggctctgaggcaacccctcggagcctgtgntagtgtctgtcgatctgtctgtcgggctacaggggcgaa

SEQ ID NO: 596910 - DNA, 172 bp, Homo sapiens
ttttaaaccccttgaattggttagtttttttttagggaagtgggaaaggcggagtggggggaagtataggaaaaaggatttttagcaaaatccttttttagggctattagtcggggtttcccagtgagccctcccgatgcccttttcaaataaatgtttatgttgtccccca

SEQ ID NO: 596911 - DNA, 726 bp, Homo sapiens
acctctgatcctcacatctatccgcattctacccatctcctcctccctctcatattccctggacccccggaatttttgaaattgaaagatcaaatcataaagaaatgagtgttaaataggttctagccattttgacaaacgttgtggaaagtatttggggaaaaatagtattcctgatagaaatttttgagttgcaccgtgaagacgataggattttttaaaggcaataataataataatagttacctacttaaagagcccttactatgtgtcagggagctggtcatatctcctttataagaatattatgagactgtctatgaaaatagtgaaatctctgaaagtattggcattaggcataaaactacaaaatgatattctttgaaagcattgttttaacaaattgacattcttggtatttttaagtagctttaatatgcctggctggtggacatttaaagctctatgcaattaccaaaaagggtatatgttataaagaacacaattgggggactaacacacaatgggtggtaattctttcgtaaatattaactaggcataaaattggattataaaaaccataaatactttaagggcccaaaatatgcttcatttttttaaagtttgaaattacaaattctttactcccgcaaccgggcagccgaacatgggccttattacccatccgtcattacggcgggaggctctactcccagatgtctgggc

SEQ ID NO: 596912 - DNA, 1058 bp, Homo sapiens
  misc_feature (48)..(48): n is a, c, g, or t
  misc_feature (110)..(110): n is a, c, g, or t
  misc_feature (217)..(218): n is a, c, g, or t
  misc_feature (220)..(220): n is a, c, g, or t
  misc_feature (235)..(235): n is a, c, g, or t
  misc_feature (240)..(240): n is a, c, g, or t
  misc_feature (265)..(265): n is a, c, g, or t
  misc_feature (267)..(267): n is a, c, g, or t
  misc_feature (307)..(307): n is a, c, g, or t
  misc_feature (312)..(313): n is a, c, g, or t
  misc_feature (321)..(321): n is a, c, g, or t
  misc_feature (324)..(324): n is a, c, g, or t
  misc_feature (333)..(333): n is a, c, g, or t
  misc_feature (348)..(348): n is a, c, g, or t
  misc_feature (363)..(363): n is a, c, g, or t
  misc_feature (378)..(378): n is a, c, g, or t
  misc_feature (385)..(385): n is a, c, g, or t
  misc_feature (404)..(405): n is a, c, g, or t
  misc_feature (419)..(419): n is a, c, g, or t
  misc_feature (425)..(425): n is a, c, g, or t
  misc_feature (427)..(427): n is a, c, g, or t
  misc_feature (442)..(442): n is a, c, g, or t
  misc_feature (451)..(451): n is a, c, g, or t
  misc_feature (456)..(456): n is a, c, g, or t
  misc_feature (466)..(466): n is a, c, g, or t
  misc_feature (470)..(471): n is a, c, g, or t
  misc_feature (481)..(481): n is a, c, g, or t
  misc_feature (484)..(484): n is a, c, g, or t
  misc_feature (724)..(724): n is a, c, g, or t
tgggttgagcacagggtactttatggatggtccttgacaaggtgcggntcccttaggccccttccccttcttcagggggctctactgtggcaacgtgtgaggaggggagnattcaggtgtgggtgggggactgagttgtggcagggacctccccagcagtgagggtctctctcttcctctttgtgctcttgcgtggggcgtgggtggctccaggggnntnttatactctcctttnggagngccatgtgtgtgggccatgtgaggntnccaccaccctgtgtttgctgttacccaaattctcgttgtntcatnnaccagganaantggagcttntgacaaaaggtggtncgtttggagggcaangtgcccgagcccccnaggcgtntcaaaagggtggaagaganngtgggtgtgttcgncgtgtntntgaaaagtctcaganagggagaanccacncgtggtgtgncctnnagtgtgttangcncccgagagtattgcccccccttgaagagcagtggggacaccctcttccgcgagtagacgcgcaccgtgatgatatacaaacacaaacccctctctgcctgtttgagatgtgttcttacacacttccgatgataatctttgtgcgaacgacgggttttttatctctctattatgacaacgcgcggggacgagggttcttacaaagggttttccaccagcctcaagttgcttggtaaccganccgtttgtgttggggcaccgaaggagtgggggaagaaacacaagcgtgcgaaacaaagggggctcaccaatgtggtccaccaaatgagtggtagaaggtgcctgttttcccccgcggtgatctaccacaggactacttcagaggggggactaatattagaacaccttttttggcgcccccaaacagagaggactcctttcgtgtggacgtaagtgggcgccccacgagggattttatagtaaagccggtccacaggggagcaacgtaagaaagtggtcttctcagtaggggcaaaaaaggtcccccccccgggagggggcgacaataatcttag

SEQ ID NO: 596913 - DNA, 261 bp, Homo sapiens
ttcgtcaaaacaacggcggtagttgtttgtagggctcatgtaggtaaaggagtggcaatttctagatcaaataataagaaggtatagctactaagaagaattttatggagaaagggacgcgtgccggggatatagtggtcgaagccgcactcttaaggggtggatttttctatttcgcctttgagttgttggtagtctaaatgtaacaattattagtaataaggctaggagggtgttgatttgccgttgttcttcgacgaa

SEQ ID NO: 596914 - DNA, 200 bp, Homo sapiens
gtcaatggcacgtatgctgtactcgcacgagaaactcgtaggtcaatatatcgagctactgcaaaggccccaacgttagtaggcccctacgggctactacaacccttcgctgacgccataaaactcttcactagagagcccctggaaaccggcacatgtaccatcagcctctacatcaacgcctccgggccattcaaggc

SEQ ID NO: 596915 - DNA, 654 bp, Homo sapiens
catggcccatcctactatggagcgtatcttctttgccctatggatgacccatgtcggcgaaaccaccgccaaagcactggcgcactccttcggggacttagcaatcattcgggcaactcccctggcccttatccacatgcgtcccggatattggaggcgaagtggcacgtgccatcggccactttatggaccagcccgccaaccaacaggccattgatgacctagtgaagcgtggcgtgcgtatcaccgatacccatacccccacatctacattgcgtgatcaactcaccctggctagcatcttggaacacttggacattccaaaaatcactccactgcgtgctgtccagttagccgccctcgctcccacattgcccttattgggttggagccgcccttgattcactccttcagggcgggagtgtcccagcctgctgcacaatcattgcccgaatggttccaatctcctgataacatctccttagcccgccgactcaagcactgctgtgacgtactgttggcacaactgccatccgccgatcgtgcccacattccccattcagggccaaagcgtcgtactgaccggcaaatagcgtcatgaccgggaaccgcgcactgatagaatttggagcaaatgtggaggtgcaaaaacag

SEQ ID NO: 596916 - DNA, 921 bp, Homo sapiens
ctgtgtgtccatatagcgtcagtaacaagctggttagtacgttccggtagagttaccagcgctgtgaacgctataggggttgtctcatagcagcgaagatcatagttgatagcgaaacattgtagtactggcgccgatttcccttgtatgttgtgggcctgacgtgtcaaaccgcttggggggggctccattcccccgccccgggggatgtcgcgactaaattaccggtgtgagggccgcagttgctccccttcggatgtgcaccgacgagatggtttgttcgtaaaaaccaaggtctgggtcttaacgccccactcgatcgtggcctggataaccaagcaccacagcgcgcacacgcgagagtcaacggttacccccgttgcccggtctccccccgaagtataaagcgccttttttgcctttcattggcagacccggccacggaggtttggtggtaacaaaaagttcagaccacatggatgtcgtccggaaatgttcattgtccccgaaacgccgatgagatcaatgctcgagcacccagatgtacatatccaaagtcgtgttcgatacagtacaaacaggccgccaacaaacttggcgtaaaacactcaaagtgatgtgaatgcactctgggacactaggctcgtacttctcccctaccccaatcgtcccgtaattttttaacgacgtcccaatcaaggtgtttatatatatgcacctaaaactttaatgaacgaagtattccccatagccacccacaacccaccatctgttaaaagaaaaaagagtaacttataaactttctaatgatgcacgctcatggaacttagtttccccttagcaaaacaaactcagccctaagtcccctttaaataaagaaatcggggccccccgataaaaaccccattccccaaaaataac

SEQ ID NO: 596917 - DNA, 327 bp, Homo sapiens
ctcgctcagcatgttgtgcaggcccgggcgctccgctgtgctgcgcggttgcccgccaagagataaagcggcgatggcccagccggcgttctcgggcgggagctggttgcgctcgaagtgcaatacgtagcggtgcgtgctgtccagcgcaatgccgttggtgtcggtcttggcggtggcaatgagcatgtcctgcggcaggtcggtgccgccgccgttccacgcgacgatggcgcgctgcgcatagtccagcccataggcaccgaccatgcgcgggatgaaccagccgttttgcgtgatgggcggctgcttcacggccagcgagag

SEQ ID NO: 596918 - DNA, 202 bp, Homo sapiens
cagctgtctatcaactcattctctaaggaattccatatagaactctggatattcttttggtctagagtgatcgtgtcatttagcatagtgtgcagtttgctttttgttaatgaaccatcttttaacttgtaactcctgagcagaatttgtgtggtgctgtagcattcataatatatggaatgatcctgggaggagttatagc

SEQ ID NO: 596919 - DNA, 362 bp, Homo sapiens
gacacatgcatgtgtggcatagctttaatataaaattcactttatgaaccaataagtgaaatgccaaaaaggagaggtggatattatttaaaagaagatgattgtttaaccacaaacccttcacagagggaagagaggtttagaaaggtccagaaaaaaaattctacaccaggtaccactgaagaatgcagggctacatttgcctctgaagaaccatgtgttctctggcatctgaattccagtgctttccaaatagatgggtagatgatgaaaaatggagcagcttcttttatctcctcctctctcctccgtgaattatagtacgacacgagttctgtgcctgcccccgagacagaaagcag

SEQ ID NO: 596920 - DNA, 512 bp, Homo sapiens
tacattattatttgttacacatggagaagagccgttttgattaaggccatgtatgtttttcttagagcccttgggatttactgcagccaccactagatatcagtgcaatagggctaaatggtaaggcaatggacagtatgagccagcacttgaccaggggcccgctggttacggacgacggaaaattgactgatccaagtggacaggtaagccattttcacaagcatcaacaacgtttctgaaccccgttgtggctggctactggcatggaggtcagggggaccctacatgatgcttgccagtggtgacctgcaaagaagacttgctgattcttaggtttacactgtgagggtgtgcattcttgtttttacagatggccttgatgctgcgatggttgccatgaataaaagtgtaggtgaatgtgcaaggtgaggacaggccccgaatgcttatgatgctttcacagaatgtgtcataccgtgcctcggggttgaccacatagtgcttgcaca

SEQ ID NO: 596921 - DNA, 122 bp, Homo sapiens
  misc_feature (5)..(5): n is a, c, g, or t
agtantcaaacccacagcaaagccacattgataatacaatgaacatctgtcgagcagtcacctagagtcaccaagtgttgtcattttgctacatttgacttgtctctttctttctttatatt

SEQ ID NO: 596922 - DNA, 315 bp, Homo sapiens
atatcgtcagtgtggtcgggagcgatgagcagcaccatttccggtgtgccctccgccttctatgcattctgttttcttcctcccttctctgtttgtcttctcccgaggaagtgagttgctgatgccatcggactttatgcattaatgatgcaaccggattcgtgtcaggattacgttgcacgagttgaattttgaatgaaggagaagagtttttttttatttatttttataagaggatgttgactcgtctagttgcgtgatacggggttaccgaagctcgaaatttcgtaactcagtgctcaaagcgtgtatccc

SEQ ID NO: 596923 - DNA, 949 bp, Homo sapiens
  misc_feature (949)..(949): n is a, c, g, or t
tggtgggcacctgtaatcccagctactagggagactgaggcaggagaattgcttgaacccaggaggtggaggttgcagtgagccgagaccgcgccactgcactccagcctgggcaacaagaacgaaactctgtctcccaaagaaaaaaaaaaaaaaaaaaggaatttaaagttaagccaggccagtgattgaatggacctcttacaagtcatgtgatctgggacagacaccctctagggaacttcataatctcattggtgaaaggggaataaatgctccgactggggactgccactggggaggaggacaggtcatggtgtgtgaaggagcagggccacccctcgctcacgggcgcgctcaggcaatgtgaactgtgggtgtgtaaaaatgtcccctgagtccgccttcttgccctaaaaacacgcacatgcacgcatacttatttttagagaaaaaaagctctaatgtccctcaaagaggtgaggagaagaccttgagtctggggtttagcgaaaatgccccgtgcaaggttgtgctttagatttcgtcctcatctgggtgtcaggaaaggcggagggagtgtccaaatcggggagataactttgtgggcattagggggaaagaggtcccaagggaggttagaaagggagccgaccgggtgggtgcgcgtccaacctgtaattccaaggattgggaggtagggcgggaggtcactggagccagcttggaattggaaacactttttcaaaaaaaaagggcggcgcaaaaaccaggggccgattactccccgttttgaaaggccataaggggtaagaaacagcgggtacagcggggaacgcaggatccacgacctctgcgggatggcaccgcaacacgacaaagatgggacacgactgcgcatcgtatacacacacacaaccgagcctgatggacaagacaatacccacan

SEQ ID NO: 596924 - DNA, 1362 bp, Homo sapiens
gggcaaggttcttcccaggatgaaagccatgttcagttcgagcgccgatgatctgtgaatgcccgaatggcgcagtaagtccaggacgtagttcggagtccgagcatcgtcgccagtgctctatctggcaggctggagactgaacatcgggacctcgaagtgctcaggcgtcacgagggagctgcagatattgagcgggctagctagagtgaacatgtgaacgttgggtgagtggatcgtgcacagacgactagtcgataagtcgtatatgatatcccggttcacttctaaccgtagaatagtactttcgcaagatacaactccatagttcccggcttacgtagcgcgcaagtgtggatgataaagagtgtcagtctggagtaaggcatgatcgagtcgtttatatccgcagtcgagagagagcaggcagattctatgcacattatagcgtcgaacttcggtagagagagaggcctgtgactagcacagattccacagcggacaaaatgctgtgccacgagtggatgccagtgacctcgtggacgagcatgttgcaacgaataacccatccacttgtgaggtaccttggtcttgcctcaaggcgaaacttagtagggcacagagaagtccgcgtctaaactgagtactggccagccacggtgtcattaacaggttcatttggggacaaagctacagacagagacacatgtgggaacacaagggttgaaactccctactaggtgtctatacagaagctcacgggcggaggtactgttaactatttgaacttcccagagtttcaatcgtaaacaagaaatgactagatcaaagacgtatataattcacacgtaacgtgatgacatagaaagacagaaaccgcacacagaggcaacaaacgggggagacaggaagaaacagagcatacaaggggggcacaggaccacaacagtgagtgaatgcaaccatgtatcggagtacacaagccggtgacacaggccgcacacaatacgagaggacaaaaactaacaggcagggacgcgcgggatacaacgaccagcggcaccgggacggttggcagtggccccggagacgaaccaggcccttcaaaaacaaagaaagcagagcaagacgaacagaacaaacaaacaagcaaagagacaccatgaagagagaatacggcagagaagacggaagaagggaaccaatccaaaagaaaacaaggcaatagaacagagaagaaaaagagacagaagcgaaccgacagaggcaaggagcaacagacgagagaagaaaacaaacgagaagcggcaaccaagaatacaccgagcaaacgaagaaacacaacaagacgcaccagcgaac

SEQ ID NO: 596925 - DNA, 149 bp, Homo sapiens
  misc_feature (147)..(147): n is a, c, g, or t
tccgcctgcagcacaagtggggcatccacagatgagactccatctaccctgggaagctctcctgagcctcgggggactggcttgtcatgaatccttggccttagttctcccctgttgtgtatttttaatgaataaacctgttgcatnta

SEQ ID NO: 596926 - DNA, 1030 bp, Homo sapiens
cggacgcgtgggtcgacctcaatcgttcgaatcacactttcctttgtactatactctaaaagtatgctaacactatggtaccttgtaacacgtgattatccccagactgatcttgaatagctgacttctatgtgtgctgaggcataccatatggatcatacctgatctgagacatcatttgactatcttaatatgatgacagatcatattatatcttataggaatataccactggttcattatgtaccaattgacgacaagtcattatatacctgtttttcaatgattaaccagaccgtgaatcaattcgtgaagtgttcacgagacacctgaagggattttcctccgtgttgaatcagggtgtccctgtagattggtcgatctgacttgtcctggactgaatagactgcgcattctcttctccttttcttttattcttggcttcgcctattactataatgaaggcatggcatactttgaactgtgcttagtaagctatgttctaccttttagcaagtgagtcattgctatacagatttccacgaaggctttcacgtctctcccttgacctttgcctcatcgcgctctagatgcaagagagcgttgtaatgctagcttaaactaaatggggggcttattcgctttttcctacgagtccttacacgtattatataaaacctcctccgttcatccaccactaagtggcctagaggtccccgcactctgtacttgatccgtatctaaatagtagacgaaactgactaaatctgtattcgcgtccatgtttcctaagctcgaagctctgcacttttagatactatattgaccggcttgcttacgaatgccacccatttcatctcggaccctctcgtgactcaccgtaggcccagttgtattggcaaaccctggctccttttgttccttatcacccggtgggttacaaatgccttctctaagcccaggacaaccgacggactaccagtatttgggacaagctgccgctaacccaacacctgggaccaacggcaat

SEQ ID NO: 596927 - DNA, 1182 bp, Homo sapiens
ccaagaaccgattgactcatgcacacggactcttctcctcgcatagcccccgactgacactcccttgttgtcaagaccatggtgttcgggtctcagttgagcctgggagggtgcccctaggcgggcacaaactgacggccgtgcgacggtgcgtctccctggtagttctaccggtgctcaatgttggagctgagacctgcgtagggaatgtttcggcattgatggggcactgtgtgatcctcatcgtcaggacacggggatgtggtaggcaaggggatgtccggtgtagtttgttaacttcctgaacagagctggctgacgtgtgcgacgtgtgagggagtgcacgggcgtattcggcctataattgctcactgtggggttcgggcttgcgcttacgaggatagttttggtgtttctgtaagcccgaggagtggtatggaagcgtcctactgcaatgccagggcacgtgtaccgaagctttggagtagagagtctgcgtgagtgactattccgcggatcggagggcatactggcttcactgtcgtcaaaggcatggccagaagatgtcatcaaggtccattgtgttgactgaattggtagagcgtagtcgttggcttggggagaccttggctgtaatggaatgggcatccctatggtgtacatattggctctatatacagctggcggagggatgaatcgctcaagaatgtctgcctgtcattctggatgtgggtataccgaaaatgaggagttacgtataagatccacgtgtacattggactatcggcagagaagagtaagaggttctgaatatgatgattttgctggacgaattcatggaggcagtgttctgccaaagtcgttgcaatgcaaaataagtcggtgcttcgtttcaaccgtaagtgactttctgtatggttgtgcagatgaaactaagaaaatgttggccggggcgtcggtggctgacacgctagtaatgtccagcagttccggagaccgagacgggcagatcacgaggtcagaagatcgcgaccatcctggctaacatggtgaaaccccgtctctagctacaagatacataaataaattagctgggcgtggtggtgtgcaccgtgtagtcccagctactcctgatggctgaggcagaatggcgtgaacccggtaaccggaggttgcagtgat

SEQ ID NO: 596928 - DNA, 517 bp, Homo sapiens
ctggatacacgcgtagcgacacacccagcctccatcgtttaaactgtttaaatgtgaaagtttctatcatgtaccgttagcgtagacaagatttgctttcctatttctgactggtgcctttcccctttttaggagcaacgaaagctactctcttagttatgttcttgtgatgtgacaaaatgtcaaaaagataggagaagagaatattttatttcgttgatgcttttgtccccaagtgtgaccctaaacttaagcttggtaggagttggcattctttcatgtcccttccctttactcatgccgaaactatcaactgggacatttggtgcttttggtttaaaagttaattgatattatacttgggttttatctaaaaagtaaatgtatttgcctttgacaaaagactgacacaagagcaaataagctttaaaatcgggtgttatgtgctttcctccatttttgagcatattatccaaaatggtctgtataatataaatgagtctgaaggcagtctgga

SEQ ID NO: 596929 - DNA, 117 bp, Homo sapiens
  misc_feature (102)..(102): n is a, c, g, or t
tggaaccagctgagcgcagctggacccagtagtcgttgtctccagtgccgcagtagcaggtagtgctcacagcccaccccgccctagtgaattggggttggncccagcgccttccca

SEQ ID NO: 596930 - DNA, 343 bp, Homo sapiens
aatgccttgtcgtggtgccattcccggcgcctgacgatacgctcttctattgtcttattctggcaggttttgacgttttaaattttttaaaggaattttattccttggaccaaaaggtttggttaaccacccccctcttgcttgctttcacattttgggtgtcccgaggaaacagcaagggatgggtgtgtgacgttgtgcccgcctgcctctgtgcgagcttctttctgtgtgtatattttgttttatttttctccgtgtatatttctgatcccgacagaacaacatgtgggctttctataaaaaagattaaaagatttaaaaaacaagggcggacgccagc

SEQ ID NO: 596931 - DNA, 484 bp, Homo sapiens
aaaaaataaaaaaaagcattctagaaaataaaaggaattcccttgacttgatcaagagtttccacagaagccttgcagccacagcgcgcgtccccatggtcaggagcaggactgggtgccattctcacagcttctgtccagctgtgtggaggtctcgggaacagagaaagaaaacaagccagaggtacactgtggaaacgaagagacaaaacaaaacccactattcgcaggtgatgtcactgtgttctggaaaactccaaacaatttccaaagataacctaaaatatttcccagggaaaaatatcggaaatattaagagatgtcagcacgtttttggggatcaaagtcagtatacaaggtgtcattgcgtttctgtcatcagcagtcatgcgaaaaggaaactttaaaaagccaccgttcaaaaagctttaagatatagaaatgtcaagaaataactccaattaaagatgcaaaaagaaaaaaa

SEQ ID NO: 596932 - DNA, 906 bp, Homo sapiens
ggctcgggagatggacggcctgccgtgtttatggtgcctggttcttggatgtggcttggctggtgggggcctgtgtgtcctgcccagtgcccagaggactggcagtgctttggcacctgaagcccggcatcagaggcaaccccgcggctcctgccaacggtctggttgcccctcgtgggaccagcccttcgctggggctgtgacaaaaaacctcaagtctgagaggacgctggttgatgcgctgcgggcagacgtggtggaccggaaaggacctctagtgacgttgaaacaagccacagggtctaccagtgacaggaaaaccaggagagctgacgtaagttctcagtgctgccagagctgagccagtccctagggctcaaggagcaggagcttcaggttgtccgaagcatctgggaaagaaagctctgagggcttgtactactctccagctgtaccccagacacgatagtcgcctccagacaatactttcacccatgcacggaggagaccaaaggaccacagcaaccatattgtgctgtacaatgatgggatcccagctgcttctgagtgggaagatacaggtgcccagaaactggaacacatttgatggggtcaaatctcaaagtaccagtgaaaggccccattcacagaaaggaacatcctgaaacaggtgtcaaagaaagactctcagtccacttagcggtgaggaagccacagggactcctggagtgtgcccaggttcagatagcagccaatgaacaatgtctccaaacactatcaggtgcaaaatgtactacaggctatagcctatggctgaggaccaaatgtactcgcccaggtggacctgtctggagcagagatatgttgacataaaaagaagccaaaaccaggctgataagcctatag

SEQ ID NO: 596933 - DNA, 105 bp, Homo sapiens
gtcagctcagcattaatactgccttatgtcagcagaatttcagcctttcatataacagctacgccagtattttttatgtaggtgcctattgatcgtccgagcgga

SEQ ID NO: 596934 - DNA, 627 bp, Homo sapiens
tgagcggaggatcctcgggacagatgctggtagaacgggtggcagccatcgatgtgactcacttgagaggaggcagatggtggcccagagcctactagaaacggatgtggacctccactcaacgatgggtccagagctgcgcgtctgatgatcccatggcagtagcttcaagatctgactcccagtcccggacctaggccgtcgtcagtccacggaaggcgtttcaccgtacatggagtcgtgccaggcgagggagagctactctggacggcggcaggctcgggccattatagccgacgtgggcactgcctaggcgacatcatccccaccggggccatggctgtgagtgcctcaccaatcagagtccacaacaaacgtgtgccatctcaagaatgcaagacggactgccgtgcaagctgatagcgaggtacacagcgtgcagacgtgcagcatttggcaacgggatgaccatacgtgtgctgcgtgcaggctaggagcgtagcaacgtaacaggtgaagcacagcactactcatcgcaagtgacaagatccgtttcccaacagatagaaggtgtactgcacagcacgtacatgcgcttctaccgacgcatccgagccgctcgccacc

SEQ ID NO: 596935 - DNA, 336 bp, Homo sapiens
tggagatggagtctcgctctgttgccctgaagagcagtggcacgatctcggctcaccgcaacctccaccttccgggttcaagcagttctcctgcctcagcctcccaagtagctaggattacaggcatgcgcccagctaatttttgtatttttagtagagacagggattctccatgttggtcaggctggtctcaaactcctgacctcaggtgatcttcccacgtcggcctccccaagtgctgggattacaggcgtggcccagcgtacctggtctccaagcactttttatttaattcctacatcacttttttaatgttgggtctttgctggtgggtag

SEQ ID NO: 596936 - DNA, 519 bp, Homo sapiens
caccgactggaggtgggaatgctgccgacagactgtgttctcttgcccaccttcatagcaggaatcacccggacccggcaggctgggctatcgtgctagcgagggttctgggggtgggtctatggagatcttgtcctatggggagtctgcagtggtctcagccacatcctatgtattttggctctggaggagcaaagctgtaatcctggagttggtctgtgatttgccgacagccttgcaggctgggctcagggacaaagtcccccccaaaacccgcaggtcctcatgtccagacgctgcccagtcctgtcctgaaaacagcacgccccaggcccacagaaccccccaccctacatttgccttgggtggagctgggggtggtcctaggactgcgggtgcccttagctgacgggggtggggagaagcgtggactgcgcagcctgtgggtaattggaggttcattgagaattgagtctttggaaacactaagacaatcagattttaaaagtatttatggct

SEQ ID NO: 596937 - DNA, 703 bp, Homo sapiens
  misc_feature (76)..(76): n is a, c, g, or t
tagaggatccccggacgcatcagtccattgctatttctttttcttcttgacggatttcggtcttgtagccaggtgnagtacaatggcgcaatctcaggtaactgcagctccacctcccggttcaagcaattcccctgcctcagactcccaagttgctgggattacaagtgcgtgccacatgcccaactaattcttgtatttttaatagagacggggtttcaccacgttggccaagatggtctccatctcctgaccttgtgatctgcccgcctcggtctcccaaagtgctgggattacaggtgtgagccaccgcacccggcttcgagagagcgtttcttttcttaaagcgtgttcttttcttaaaggtatcacaggagtgattatgcctttgttgattgatggagcagatggggagaggcattgcatgacatgggaaggaagcttagatgtgggtggcaccttgttcacccatgttatttttaagctccatcttgacaattatacttaattatttttccctctctctgtttcttttttttataattttattgaagttctaatatctgaaagtgtcaaagggtatatgtagtttaaacaataaaatgggtattacccagattttagcccagctcagaaatgaacattaaagtgtgtaagatcttgtgtacttttttacctactaagtcccttataccatggaact

SEQ ID NO: 596938 - DNA, 700 bp, Homo sapiens
  misc_feature (56)..(56): n is a, c, g, or t
  misc_feature (72)..(72): n is a, c, g, or t
  misc_feature (94)..(94): n is a, c, g, or t
  misc_feature (99)..(99): n is a, c, g, or t
  misc_feature (101)..(101): n is a, c, g, or t
  misc_feature (108)..(110): n is a, c, g, or t
  misc_feature (113)..(115): n is a, c, g, or t
  misc_feature (120)..(121): n is a, c, g, or t
  misc_feature (133)..(133): n is a, c, g, or t
  misc_feature (143)..(143): n is a, c, g, or t
  misc_feature (150)..(150): n is a, c, g, or t
  misc_feature (203)..(203): n is a, c, g, or t
acataggcatggatcagatggcctcgtgtaatcggccgtagtcatggtgctcagtnacggtagttgaaaggntgaaggatgatgaagggaagtncattnantaactgnnngtnnntttannagctcagaaganagagggacangtagaantactggagtaatattaacacttaaggaaggagtgatgtcagataggccttganagataatctctgtagtgaagaggatgacgaagggcaggtaatgacatgattctagaaagcagatatcccacagcgtgcacagaggttagaaaacaggcatctttgagttgaacactagattaattagggaaggttgaagttactgttggtaagatctgatgagagagcctagaatgtccttttaattcacaagcagtttggggggcatggcttgggaagttatgtggttagtgttttaagaagcttagttaacatggtggtgacatacaggtaaaattgtagaaaggtctgtcaataggatggactgagttactggttctcagctaagggtgacttttgcaagtcttggggacaatttctagttgtcacaactggggacagagagagatgagcataggcctatttggcatctagtgcatagaagctaagaatgctgctgaacatcttataatacaaggggacaagttccccacaacaatgaattttgtgggcccaaa

SEQ ID NO: 596939 - DNA, 918 bp, Homo sapiens
  misc_feature (6)..(6): n is a, c, g, or t
tcatcnaagagacaaaataagataagatgggagagaaaaaaagaacaacagatgacactgtgctagcccatactggccgccaattctgttgagataacatagcggttcttctatgctcccactgctctttgtaacaagtccctgaccagcacatttctggaccacattacggttgtctcgaaattcctaaaaggtgtgcgagtttcctcggtactccctatattgaccaggccgggtcttttatgtatccccaacaacggtctcttctgcccccataccaaattggtttgctcgcaacccgtgccccatgtatttttagcacacccacgttgtcaaaaataaccactggcgaccctaacctacctttattgggtagtcgtgcccaccagaaggccctttttaatgacacccactatatagtttttttactcggaagtccctccgacaaaaaacattattctacccttatgccccccctcttccccataattactacctgcgtgaaacttttcgtaaaacactcgccatcataaaaatctgtccaacaaatttcgccccccttcaatagtaacatataaccacttttataattgtaagggcgcccactagcgacgcttcgcggttcaacccccgtgtcgcacacatattgtgtgaacaatacaacgggggcgaaaacccatctatacacactcccttcatcgccataattcataaaattcatagccacacccgattgtctacctaaaatgcctcgtttcttttgtttacataagaaatcggaaatcaactctcccctttaaataagaaaataagactccacttcttgactatatcctagatttcaaattttccgctttctgtatttttttttgttttctttaaaaatcacaaaaaaaagaagtttgaaaccacataaca

SEQ ID NO: 596940 - DNA, 561 bp, Homo sapiens
ttgcaggtcatcataggatatctacaactttcaggctgacacctctgctgaggtcgggctgtacatcagaataaaaaaatcgaatggaatatgccctgaccatgctcttacaaagatgtaactagacagacttatcgaatggaccctatgggcctcctctttaccactgtgagatctacagggaagccaaaagaatgatctagagtatgtcgaagaagatggacatgtggtggtacgaaaacaattcccctgtggcctgctggcctgggtggaaccaagaccaggctaaggcacaccagttcttgacttgggacaatccatgagtgaaccagaatgcagtattccttgagatacctgtaaaaaaaggtaaaacagacaatttagcagaacggtgcatagattcttaaatcctctctgtggagagcatttcagccagaggactatggaactgtgaatatacttcctgaaggggagggagaagggaggaagctcccatgtagtccacaggctgtaattggcgcagctattggctgcgtacactgtgacctatggccattataa

SEQ ID NO: 596941 - DNA, 816 bp, Homo sapiens
gatcatggccaggaagctgatccaccttagagatccacgccgcgccatccggataccagatcatccgcgatctgcaggtcctgcacgaatgcaactcgccgtacatcgtgggcttctacgggtgccttctacagtgacgagtggagtatcatgcatttgcgaatgggacacagcatggtagtggctggcgtccctggacctacggtgctgaaattaggccaagaggattcccgcagcgtagatcctggaggtaaagtcagcatcgcggttctccgtgcgtgcttggcagtaccctcctgagtagaagcagccatgaatcatgtcatccgtaggatgtgatggccctccaacctatccgtcgctgcaatcgtctagcaggggaggatcaagctgttggtgaccttcggggtgagtcggccagtctcagtcgagctccatgggccgatctccgttcgttggcgcgacgcgtctccttacaatcgcctccgcgtagctggttgccgcgggtcaccaccatttacctcgtgctgcatggtcggtacactcctggtatgcctatggcccctgtttcctggttggagctggccgtcggtccggtaccccatcccccctgtcccgacgccgaaagagctggaaggccatctttgtgccgtgccctgtgcgtcagacgggggcaacgaatggagagcctcacagcgatctcgcctcgtgccggggtccccccttggcgcccccgtcagcggtcacgggatggatagcccggctgccatgtgcatctttgaactcctgggactatattgtgaacgagccactcca

SEQ ID NO: 596942 - DNA, 149 bp, Homo sapiens
gagagaggtgtgagcgatgcaaggggagggagaggaggaataaacagaggaaatgttatgttaaatggtctgtaaacgagagaaacccccaaatactctaagttctattttaaaattctgtcaggccacaattattctaatatgcttga

SEQ ID NO: 596943 - DNA, 849 bp, Homo sapiens
  misc_feature (2)..(2): n is a, c, g, or t
  misc_feature (172)..(172): n is a, c, g, or t
  misc_feature (187)..(187): n is a, c, g, or t
  misc_feature (201)..(201): n is a, c, g, or t
  misc_feature (204)..(204): n is a, c, g, or t
  misc_feature (244)..(244): n is a, c, g, or t
  misc_feature (275)..(275): n is a, c, g, or t
  misc_feature (333)..(333): n is a, c, g, or t
  misc_feature (376)..(376): n is a, c, g, or t
  misc_feature (382)..(382): n is a, c, g, or t
  misc_feature (613)..(613): n is a, c, g, or t
  misc_feature (647)..(647): n is a, c, g, or t
  misc_feature (655)..(655): n is a, c, g, or t
  misc_feature (693)..(693): n is a, c, g, or t
  misc_feature (757)..(757): n is a, c, g, or t
  misc_feature (813)..(813): n is a, c, g, or t
gnttttccccttctctctgttgggttcgggcggttgtgcccgggtttggctggcttttttcgggcggcggggtgtgggtgttgcttttttttaaaacacttttgtctttttttttttttttttttcccctttctttaaagacaagctagtttactgggaaaagaaaaaaatnataataaaataaaancccgggcaactttngtnccctcatctttttttgggggggggggggggggtcctgggncgccccccctccccctgctcctccccgctcngcttggctcgtccctcgtgcccccccttttgtgggcggtgggggggggccgggtgggngtgggggtgtctgggactggcgggggtggtgggtggggcgggngggggngggggcatccctggggcccggggtcggggggggctcggggtgccccgggcggggggggggcggctggccttgcgtgcctgcggtgccggggtgggggggctgtggccccggccggctgtcggttccccctgttccacacggggggggggccggggctgctgcgcttcgcgaggtcttgctcccttgggacctggtctcccatctgaccctccaggccttagcttgcctcanatgtcagggcaggtatccacctaaccaggctgcngggggggnggagggaagccgggaatggggtaggaagaaagctagangtggcctgcaagctgggctggggccccgccggcggccaccataaatactatgggagtttagccnatcccgagctccgctgtgtcttgtgctaaacattcctttctctccgtgcctctgtntcccctctgtcccccctcccaacctccccgtcccgg

SEQ ID NO: 596944 - DNA, 127 bp, Homo sapiens
taaataaatatgagtataatcgcgtttgagcccgggccatctgcttggtgtctgtatcgcgtgcatcgtggatggtctttaatccccgcttgtatgtatatccatcgtggactttttgttgctatat

SEQ ID NO: 596945 - DNA, 300 bp, Homo sapiens
aagcactaatcaaatgtgagactagtaataagcatcctgagtaatgagtggcctgggccggagcaggcgaggtggccggagccgtgtggaccaggaggagcgctttccacagggcctgtggacaggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactg

SEQ ID NO: 596946 - DNA, 773 bp, Homo sapiens
cccctcatttacataaagggtggcgtggcatctaccatctcacttctaggaatactagtatatcgctcacacctcatatgctccctactatgcctagaaggcataatactattcgctggtcattatagctgctctcataaccctcaacacccactcactcttagccaatattgtgcctattgccggactagtctttgacgcctgcgaagcaacggtgggcctagccctactagtctcaatctccaacacatatggcctagactacggacataacctaaacctactgcaatgctaaaactaatcgtcccaacaaatatattactaccactgccatgacttttcaaaagacacatggttggaatcaacacaaccacccacagtctaattattagcatgatccctctactattttttaaccaaatctacaacaacctatggagctgtttcccaagctttttctccgaccccctaacaaccccccttctaatactaaatacctgactactaccccttacaattatgggaagccaacatcacttttgctggggaccactttccggaaaaaactttacctctgtttctaatcccccttcaaatatcctagtgtaacaatccaaggccagaactatcctattttaattttttcaaacccactattccaccttgctatatttcccgtgagggaccaaccaacgcctgacccaggcctacttcttttttgccccaaagggcccctcctctcttggcttataaaaacacaaccggggagagaa

SEQ ID NO: 596947 - DNA, 166 bp, Homo sapiens
atccaccggtttttcttttagtgaaaacaaatcgttcatggatcctcatcctttgaaaaggagaggatggtggttgagtctcccaagccaggagaccctaagctaagccaaagacacctgatctaggcagtgggtactcgatcctcagatttcgtgtcgtcgtcct

SEQ ID NO: 596948 - DNA, 440 bp, Homo sapiens
cttgcatgtcttcctcgtacaacaggtatccttgatgatctcgtctgtaagccgatgaaactgtcgtgcgtctagcgtatttagatcgaacttgccccgatcatgatgacctaggcacagcatagtggagagctctagacagtgctagcatcacagaggactagtggccgttgataaattccggctctaatgaactcgtagcagattgacgctgaaatggaatcagtgctcatgatagggacagaagtgcaccctggcttacacccgtgtcagctgctctactcgtgacacactgaaccccattgccgcttacagccagtgctccctatgttgatggcatcacatcactctgcatctcactctaccatcagaccaagagttggctgttgaatatcgtgcttatgcatatagctgtctatatgcgtcgtgggacataccct

SEQ ID NO: 596949 - DNA, 275 bp, Homo sapiens
tggatcgatcagctgtacttgtgaatttaggacaaagccctcatttttggtgtccacattaagatcagctactgaacttggtgaatttcctgacagacaagtgctatcgtgaccatagttcatcgtgcgcgggaagcatttccatcagtttctttataattggattgtctggtgagtttggatattaaacattatgtagctcagtaatcttttagcatttcttttttatttttcaatctatattcacaggcccatacttcagtcagtccaatcat

SEQ ID NO: 596950 - DNA, 547 bp, Homo sapiens
  misc_feature (24)..(24): n is a, c, g, or t
  misc_feature (248)..(248): n is a, c, g, or t
  misc_feature (542)..(542): n is a, c, g, or t
agaaaattttagtctttcatctanaatgagaacacacagaatgtagctgaatccagacgatgtattacagtcattgagttaattctctatgctgattaaaataaagacataatctcccataaattgcttcctgatattcctttaagttgttttactcgaacgagatttaagatggagaaatatagcagacatctaaatgcaggaccacctgcaggttgagtctcagaagtctgatgagtagagatacnttagtcaggtgtctgatgcaaaacatcacatttctatcatcattttcaactggaaaggggcttcttggaggtaatctaggactgtatggtagtcagaatgaaaagtaacataatacaaatttcatctgtatatttgaactattaaaatttactttaaaaaattattggatatttagtcatcttgccaaaatcacttaaagtatattaagttattttatgcactctttggaaacatttttacctatgtaatcaaagtggtagaataagaaacattatataaaaattcaaaagttnaatcc

SEQ ID NO: 596951 - DNA, 450 bp, Homo sapiens
gcaggagatataaagccagactacagtgctaacgtgccatgatcccacagatgcataaaggaggaagataccccttcagaataatgatcgtggcatctgtatgagcccagagtcctatctggggtctcctcagaacagcccctctatcaggagcatctccaaattagagagcctcccatctccaggtgtactctgtgggtctgaaccgatccaaaagcttacaatcctcctggagagaagatggacgcagcaaaagtaaacgggtgagaaaatggataaagaagctgacaaaaaatggagcaaaacaagacagcagccactaggtaccgacagaagacgagggcggagcaggaggctcttactggtgagtgcaaagagctggaaaaagaagaacgaggctctaaaagagagggcggattccctggccaaggagatccagttactagagaa

SEQ ID NO: 596952 - DNA, 215 bp, Homo sapiens
  misc_feature (2)..(2): n is a, c, g, or t
  misc_feature (6)..(6): n is a, c, g, or t
  misc_feature (19)..(19): n is a, c, g, or t
  misc_feature (71)..(72): n is a, c, g, or t
  misc_feature (74)..(74): n is a, c, g, or t
  misc_feature (77)..(77): n is a, c, g, or t
  misc_feature (113)..(113): n is a, c, g, or t
  misc_feature (118)..(118): n is a, c, g, or t
  misc_feature (126)..(127): n is a, c, g, or t
  misc_feature (137)..(137): n is a, c, g, or t
  misc_feature (167)..(167): n is a, c, g, or t
  misc_feature (183)..(183): n is a, c, g, or t
anaatntgcaggaacagtnttgggaaccaaacagaaaatgtcaccttttatttgccatcttatatatatcnntnagntttaccagctacttctaaatttgtacattatttgtnagggnaagaaggnnaaccctaagncttgtctaacttagtggagaatgtgtgttnggcttaggatggatanctaagtcttattgagctgtgttaactaacttg

SEQ ID NO: 596953 - DNA, 139 bp, Homo sapiens
tgagtgataaagaagttgtggtatatatacatgatggaaattactcagcatagaaaggaatgaattggcctgacatattaaagtaaatatataggccaggcatgggggtgccacctatagttccagctactcaggaggg

SEQ ID NO: 596954 - DNA, 201 bp, Homo sapiens
  misc_feature (200)..(200): n is a, c, g, or t
ggtattgagtgtgatcagatatgagggtggggggccttgctaaaactgacttagccagggttctttgctaaaactggatcttacaaggaagtgcacagatggacctaggagaagtttcaggggcttgactaaagttcagccaagcaaaggatctttgtcaccgtgtcttagcaaagcttgacacttcccttccccacaanc

SEQ ID NO: 596955 - DNA, 125 bp, Homo sapiens
ccctgctgcgcagtatgtcgggtcgtcaggcaggaacctgatctgtttcatgatggcctccagatacgaaagcgccccggtcaaacaagcatctgcttgctcaaaggcaggggtagatacaaaca

SEQ ID NO: 596956 - DNA, 169 bp, Homo sapiens
gttttttcagtggggcggggcggaaagcgggtgggcccgggcaaccagttttcaaaggttgtggggccgattggaggccacaagcccctcacccctaaacgttgccaaccaaaactgacgtgtgacctcctgggtgtttatgccattaaaaccaacgttggtgcccgga

SEQ ID NO: 596957 - DNA, 413 bp, Homo sapiens
  misc_feature (373)..(373): n is a, c, g, or t
acccttgtttggagaacttcaaaaaattatcagatgagaactcacagaagacacaggaatacgacataacaacagatacagagcctggagtaatgacagtacaagtcaaggaacaccaaggatcaccagctgccacccaacccaggaagaggattttgctcctcaagtcattgtactttggtacctacgaatttcaaccttgtccttcataccccgtgggtgtgaagattcctggcaggactctatttccacgctgcaactaggtaaataaatgttcccaggaaaaacctttagagtttagtatagaattatagattcaaaagcagttttccttgaaactttgaaagcattggttcattattttttagtatcntgggttgctgatgtgacattttattaaaagcaaaacaaaa

SEQ ID NO: 596958 - DNA, 180 bp, Homo sapiens
gtcacatctgacagctcccgtcctcacgtcgtcagtggctgggctcaggcactcgccaccatgcttggctaatttttgtatttttagtagagacggggttgcaccatgttgattaggctggtctcgaactcctgacctcgggtgatccgcccgcctcggcctcccaaaatgctgggatta

SEQ ID NO: 596959 - DNA, 249 bp, Homo sapiens
  misc_feature (162)..(162): n is a, c, g, or t
  misc_feature (168)..(168): n is a, c, g, or t
  misc_feature (182)..(182): n is a, c, g, or t
agtacaggagtcattgacccggaggtccagcgatacaacaccccaggtttctcagggtgctgtctggtgtacgattcaacaacgtggctcccctcaagacccacttccgaacccctcgacccatgactgttgaggtagctgaggcccttcgagttcaggagnaactgnccgattctatttgnggagatatgccacgacttgatttcagaggtgccacctgagcttggatccctgggtatctccccccag

SEQ ID NO: 596960 - DNA, 744 bp, Homo sapiens
gtggcagcaggagcgacaagtcaagtgcttctgctccgtgatgtggatgacccagaggcatgcccatctctggcttaactggatgccataagacaaccctggttcctttgtgaacccttctgttgcaaacgcttttgcgatagcttaagcgattccaaagcgactaagaagattcaagagaaaaaaatagactgtgcgattcatagccatgtcactccgtaaagactgaactttgtctctgtttataaaaagtgagacttctcccggctacacagaagtacacaacatatggtagtcagttcggtatttagaaatgtatgggtagcagggaatgtgttcataattttcagagattatgcatttcttcatgaatactgttgtattgctgcttgcaaatatgcatttccaacacttgaaatataggtgtgaccagtgtgtaccagtttaaagctttcacttcatatgtgtagatcaatgtaaggatttagaagttcccccaagttacaaactggttttaaagtattgggacatactggttttaatacctgctttgcatattcacacatggtcaactgggacactgttaaacctttgattggtcaaattttatgctgtgtggaatactaactatatgctattttaacgttagtgttgaaccattttcagtttttgggggaaaaaatgcttttgtgtcagcttcgtcatgatagctgttatatatatatgctaaatctttatatacag

SEQ ID NO: 596961 - DNA, 250 bp, Homo sapiens
  misc_feature (138)..(138): n is a, c, g, or t
  misc_feature (174)..(174): n is a, c, g, or t
  misc_feature (201)..(201): n is a, c, g, or t
  misc_feature (220)..(220): n is a, c, g, or t
  misc_feature (227)..(227): n is a, c, g, or t
cctaataaagagaggcttgatttggcaccccatgtaatcacggtcaatgcaaaacacactcacataaccagttgacaaagctacatcaaagcaattctaattggccgggcatgtgtggcacgcctgtaatcccagctncctgaaaggctgaggcaggagaattgcttgaacccnggaggtgaaggttgcagtgagctgagntcatgccattgcagtccancctgggnaacaagagcaaaactctatctca

SEQ ID NO: 596962 - DNA, 1064 bp, Homo sapiens
  misc_feature (361)..(361): n is a, c, g, or t
  misc_feature (373)..(373): n is a, c, g, or t
  misc_feature (558)..(558): n is a, c, g, or t
  misc_feature (897)..(897): n is a, c, g, or t
ccatattggaatcaatatttatttcaggactatgccacggtgttcaggaacttaaacaaagatgagttcaacccgtggcctttaagcaacctatattttgtgttttattaaaagcacttttacaactctccatctcccattcttttaagttcacgtggatatgtggtgggcataatgtgattatatctctgtgataaccatttctctctcttattctcgagatctccatataatctccacaggtgtgctctctctctgtgaatatattataccaaggcgcgtgaacatatataaggtgtggagaagggtgtgagaggagaggagacaagaggagaacagagaagagcgggagactataagnggatctctctcnccaggtatatataaaggcgtgttgtgtgcgtctccccacagtgtgcaggggcgggatgttgagaggagaaacagtctatatcgaaaagatatatttttttcgtgtgcgtgtgcctctatgttcctctatctcttttatatactccgcgtggtgtgtcaccaagactatagcgtggctctatacanacacacatgatatcacatctctcacgcacgagtggcctttattctccgcgtgggagcgcgtgtattacaactcttcgacaaagaagatgtttgcagcgactccgctgtggcacacaggcagcagtgtgtttttgtttacacacacaatgtgtgtggtgtcttactcatatatgacggcgccctattatacaccacgaggcgacaaatcctctgcttccaaccaaaacataaaactattaagtataaaacaccgcatctttaaaacacaagagggcgccgacaaaacttctccgctataaggaaatatataacattgtcggcggggtgctgcggcccagnagcgtagcctttcatataaacacgggggcggacacaatcttaccgcttttattgttgtggccccaaggtggggtcgtaagaaaagcgctccttcctataaaacatgatcaaggaatttctccaacacgcggaaatagcacacattgtcttgtggaagagagagaatt

SEQ ID NO: 596963 - DNA, 413 bp, Homo sapiens
ggagatagcgcgagagactcaccggctcctgggaaccagtcgagggcccgggcaggggcataagaggaagttgtcccgagtggctcgctctggcctgggagaggggccccgggagcgcgtcccgccccgggcctcattccccgaccctcctccccggctgcgcgcgcgccctggctgtatctcgggggctgcgcgggaactgcagcgggcttgactggacgcactgcctgaggacctgcggaggagacgagggagcgcggcgggtcagcccgaggttaggccgcggtcacctgtccgtgcgctccgccttttccagccgtcttggtacagaatctgcgacctcccacactccttctcttttgagtatgtcacttaagtcttctcgccggatgctttttcttccttgcttttgc

SEQ ID NO: 596964 - DNA, 700 bp, Homo sapiens
gttctagatcgcgagcggccgccctattttatatattatatattttcagaaaatttacccattttatggagtgcatgggaatgggtcatacaatataccagatattagtgtagaaaactagggaaaagtcacaagcaaagtgaggaaaaacaaagaaaaacacaggaaacgcaagacatagcaagaggaaagaccgaacagaaacaaaagagtagtagagaaagagcacagaaacaagcagacagacgagaaaacagacacataaaagagagacaaaacaaccacaaaaaaaaaagagagcaacagaagcaaccaaaaccaaacacacaagaaaaaaacaccaacaaaaaaacaagaaacaaaacaacaccacgccagcaaaacacaaagaggacgacaacaaacagtgagagagagaagacaggaaagaaacgagaaacgcatgacacagcaaaagaacaaccaaacaaaaagagagaaaacaacacgacacagaacaaacagacaaagagaaaacagacacaggaaacaagaacaagacaagaacagaaaaataacaaaacaagagagaaaaacaccagtagaaaacaaacagacggaaagagaacagcaaacagagcaaagaaaatgagaaagaagaaaagaagagaaacacaacacagagagaaacagagacaaagaaggagagagaaaaaaaagg

SEQ ID NO: 596965 - DNA, 104 bp, Homo sapiens
ctaggtcttaaggagaggagggggtggggagcctaaccatctaggtctggggggagggggcagtgggggacccagtgaatccagcccccagcaccaatttctct

SEQ ID NO: 596966 - DNA, 765 bp, Homo sapiens
gagtctgtgagggaaggagatgcctcttccttcccttcaggtagtggggtcgaaaacacccgagctgggacctcgtctggaactacgggaacaatatctgcacgaggaaggtcactctaccaaagccgggagcgacagaattctcaggatctcaagaagggaagagcaagaccaagtatgctgtgtccaatccaggccaaagggttacagagcatctataacgctgtcccctagccagcattcctcagcatctcatgtgtaccatcatcagcgctgatgacatatagcggtaaaatcgcttccgctatggattccagaggtgatcaacagtcctcagctggccagactatcaaatgcatatgccatcccagcagctgcaggagtgcataacgctccataccgagaactcctgatcatgaccatacttaggagtcaagcgagaagctttgattgcaagatctggcacacgaaagctgacaatgcgacggacacccttctttcatcattggaacatcaagcctaacacgtatgaaggagacgacgggccgcggagaatcgccaggaccaccagacatgcagctgccgtgtcaaggcagcctcaggatgaccagctgggtgcccaagactctgcataccaaacgcagaaccaggagcgacgcagttcctacatccacagcaagagggactcatctcaaggggagatgtgacgatcacgagacccagggaaactgccagcacgtccctcaggcagagaactctcgatgg

SEQ ID NO: 596967 - DNA, 404 bp, Homo sapiens
cttcctttaaatgctgggaggcttaaaaagagatctgatggagctcagatactaactctcataaatggccttttgaataccagcagaaaatacatctctcagctgatatttcaattaactaaggaagcacaaatcaacaacattcctgctacacagtcatggtctgaccacacactggggtgaatcactggccatggtgaacaactgtcgtgaaaacaagtaagagtcctatgtaaacacatccagcaaacctactgggagcagcaggaatcatgaatctaatcttttattaagagacggagtcctgataagtcaccacaggctggagtgcaatggtgcagactcaactcacagcagcctccacctcccaggtacacgctattctcctgcctcagactcccaag

SEQ ID NO: 596968 - DNA, 218 bp, Homo sapiens
  misc_feature (13)..(13): n is a, c, g, or t
attacagtacganaatctccatagcatgctacaggcttgtctctatagagactgaggctacaatctcatgtctttacaattcactgaaggtaaaatctatgccaaaagcattcctctataaagaccgctcaacttcttcaagtaagtcttctcaggtcattgaaatctaggtaatgcaaggaacccctggcgctgtgattctccggctccctcccccc

SEQ ID NO: 596969 - DNA, 120 bp, Homo sapiens
tgtcagtcgctctggggacccagggtgtcaccccggccccgggatcggctttgagagcgtcaattctgcaggtgatccttaggggaacggtggcaaagtctcgaggagttccttggccaa

SEQ ID NO: 596970 - DNA, 126 bp, Homo sapiens
gctttgttccgcgttccctgcacaaaatgcccggcgaagcaccaaaaaccgtccctgctacagagcaggggttgtccgaagccccaggttgtagacagggtctgtgggacagaatcttaaaaatga

SEQ ID NO: 596971 - DNA, 253 bp, Homo sapiens
ttctgggtcctctgccatttcggggttatcctcagccactacccagagtgttattgttgcctggttcagttgcttggcctgctgggcgtccgctgttcttttggctgtgaactctactggtcagcacattcaggcaagcactgcatggtgtcatttggagcacatgggcctgagctcatccgaaaaaaaattgcaatggtgtttcattagttgcattagtatcccaacatttttcagtacacctctccccctc

SEQ ID NO: 596972 - DNA, 284 bp, Homo sapiens
ccccgggcttttttaaaaaaaaaaggggcccaaaggttttattgggggttttttttatttttaaggtttaatggggaacccccccctgggcccttttagatccggtggggggcgggttaaaaaattttttttaagcccctccttaaagttttaaaggggtttttttcccccgcccatttccattgggaaaccttttggccagttttttttttcccgatttttttaggccagcggggattccaaaaagggccttgccccttttccaaaaaaaaaaattttttgga

SEQ ID NO: 596973 - DNA, 188 bp, Homo sapiens
  misc_feature (87)..(87): n is a, c, g, or t
  misc_feature (97)..(97): n is a, c, g, or t
  misc_feature (133)..(133): n is a, c, g, or t
  misc_feature (153)..(153): n is a, c, g, or t
aggtgacaaaaaaaaaaattaaagatatatcaggggtttgggacaaacatatgagccattttttggtcatccaaaatagtaagttanaaacaagagnacaaaagaaaaaaatagttaaaatcattaatttttntatttttcaaacttggtaangttatgttttcaaataaaaactatctcaaaatttt

SEQ ID NO: 596974 - DNA, 209 bp, Homo sapiens
caagcattccgcaaggtggacacccatcatccatgcctcgtcctgcatgaaccagaagctatctgcgtgcgcttctatcaatgcgggcgatgaagctggcaccctggagagagatcgtgcacgtggacgcagggccgtagaacacgacgctgcgggagagtctttgagagtcatgaatctcacggacctacgaacctgagttgtggaca

SEQ ID NO: 596975 - DNA, 406 bp, Homo sapiens
gctctggtagtgaattccagtccatgttctcatttcagcagatggctggcatctttggggattgatcccaaggaattgtctatagtggaggtgcccgcattggggtgttgagggtgacgggcgttttcacatgggtcttgtctgggcaaacccgtcggggtgggactcagaatcaaagcaaaaaggctgaaggagccccaaaccagggcagaaaggcagagggaaccccaaaccagtggcaaaaagacagagtggaaccccaaaccaagggaaaaaggcagagggaaccccaaaccaaggcgaaaaaggcagaaggaaccccaaaccaaggcaaaaaggctggaggggtcccagaaccagggtaaaaaggtagattcaagcccaaaccaggggaacaaggtggagg

SEQ ID NO: 596976 - DNA, 177 bp, Homo sapiens
ccacgcgtccgagtcaccttgctgtacattagatatctagaacttatcttgcatgactgaaactttgtaccctttgaccaatatcaccccattttcttctcccccgccacctgtgtgttcttttgatacatttatcttctgtttttctcaaataaagttcaaagcaaccccctgtca

SEQ ID NO: 596977 - DNA, 977 bp, Homo sapiens
  misc_feature (32)..(32): n is a, c, g, or t
  misc_feature (95)..(95): n is a, c, g, or t
  misc_feature (99)..(99): n is a, c, g, or t
  misc_feature (145)..(145): n is a, c, g, or t
  misc_feature (153)..(153): n is a, c, g, or t
ggagtcggggtgggggggcttgtgcgcggggnggcgggagaggcggcggggggccagcacggaggcggaggccgagggggctgtgcacaggtcgncgcnggagaggcgtgcgaattccgagccgagcgcgaggaccgtgctaccnaggcgggntgccagccggaggctccctctctgcagaagtgggggagcgtgaccccgtgtccctcggcctcccttttcccatccacttccgagctttcttctttcccgagaacgcctgtccggcccgggcggtgccctccttcaagtgccggccgcatggcacagaggactgtcaggcgcggggaaaaattcttagccgggggaattctcaagtgcgcggccttaagcatcgggtattccggacattcacttccttcggcgcggggccccccaagggggtattgccccgggaacccctagacacaaccttcgaggcctccgggggatattacttcgagtgtgatcgcacacttggaaaccacgggcgccgggagagtggtcaagaaagtggcaaacaatagttgaagtgggcccgattagagaagcaccgggacacaggtacaaagggatgtgcttcgcaccacagacaaccaagtgggtattctacctcatttccattccttccaagcgacagaggggaatccggtgggaaacacacacttttcaggaaacacactctcccacgtcaattggactgccggacaacttccgggtcagggggaggcatgccttgtcgatcaaccaagacgggggaccttgggttggacacacattggttgggccacagtcaacaccaattatgacgactctttggacaggcagggctttacaaggtacaccgagttaccaacaagacgattctctctcccatcacaatgtggtgatccttcaacacaccggtggtttgaatctacacccaaattacacggcatttaaccagtatcctaagggca

SEQ ID NO: 596978 - DNA, 261 bp, Homo sapiens
  misc_feature (101)..(101): n is a, c, g, or t
  misc_feature (149)..(149): n is a, c, g, or t
  misc_feature (159)..(159): n is a, c, g, or t
  misc_feature (162)..(162): n is a, c, g, or t
  misc_feature (168)..(168): n is a, c, g, or t
  misc_feature (183)..(183): n is a, c, g, or t
  misc_feature (198)..(198): n is a, c, g, or t
ctcggcccggttgcttggtctttccgtatgcccttttcctaacactcacaacaaaactaactaatacgtaacatctcagacgctcaggaaatagaaaccgntctgaacctatcctgcccgccatcaatcctagtcctcatcggcctccnatccctacgnatnctttanaatacaagcggggtnaacggtccctccctntccttcaaataaattggcaccaactggtgcttatccttcgcgtaacccgcttcggcgggctat

SEQ ID NO: 596979 - DNA, 125 bp, Homo sapiens
gaagttctttgatgcatttaacatatgattagatttacaaatatttgattagcacacagaattttccaagagcacatcctgataatcaaagctgagagaaaacaaaagcaaaagaggcagtggat

SEQ ID NO: 596980 - DNA, 525 bp, Homo sapiens
ctaccttcccctcatgtgtacttagccacctgtgttgctttgaatctgctgccagtcctggctcaaatgtggcacaaaatcagtacatcagacacaccatgaaatccctgtggctataaattctaaggcaatcttttcgcacacttccagcccaaagcaacttcatccgcatccgtatcatataagagtccccacctctactccacggtaccccaaacaagatacgctgtcctcagatcctccttctaaccaggagggaccactactgggactactggccaagggacacaagtcagcacctcatccgggctcgacacaacgacccggccaagcttgggctaggcccgtttcagcaccaacaggacgcagtaacaactggggaaaacgaagccccagggctacacaaaccgatacgacccaagctgaccaggtggatcacacgcccggacaccaatcgggccaggagcggacacagggaagagatacaagggagcacagcctcggaataaaccccgtcacacaaag

SEQ ID NO: 596981 - DNA, 854 bp, Homo sapiens
agaattagatcgtcgggaacgagaaatgcaaagaactcagtcaacatggtagaaaaaataattggccaccctcttcctagcaagtttgtccttgtcggacctttgtattctatcaggatgtatctgtagacattcctgtagaatatccaaaagacaggtaaagctatatggtactactggtggatgtctccatgcgagttaacactgattgtctagaatatcttcggatgctgggcttggtaaggtgtagatatctgcaagagcggttgatgtttggattgaggtatcctgatggatgcgttgctattttactccttgtacatttgtctgttggtacagaccagtttatggagctttcagtggttggagtggcatccctgtactggtctcaaccaataatattcctgttggaatcgatgatgatgatcatagcagcacttgtcacagcatcagcagtcatctcactagttcatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagttgcagctcagaatgctttcaagggtaaccagatttaagaatcttcaaacaatacacacttacctttgtgactgtaccttttactccagttactgtattctacaaatatgttatgttcaaaacacgacagtacagacagcatggatatttcctggtacacttgtgcatgggctaaaaacaaggaaaattacttgtcttattattttacctaatagttcttaatattaagtgccctgaagagaa

SEQ ID NO: 596982 - DNA, 134 bp, Homo sapiens
tctagacggatcccattaaactgaaggaaggggttgcagaaccctgatttttagccagttggtcagaagctcacagaattaatggaaacctggttactaggctcttacaaatgttattttaaaggatataaata

SEQ ID NO: 596983 - DNA, 424 bp, Homo sapiens
attcagggtttttattcttatgtttttcttctaagaaataagttcaccaaaaaagtagcatacacctattggtatccagaggaggaaaaaaaaaaaagggcggccgccctttttttttttttttttttttttaaaattaaaggtagcctccgggggtcaccatttaaaagaaaatttaattttgggggaaaaacgaatttcagggtgatcccaaaaattttgggggtaaaacaacattcggggtgtaatttattggaacactattagagtattgggggttaagcttggagtcattccccatttcatagggtgttcatatggggggaaataggccacacttaattataagttctaccttttcaaatggccgtggtataaaaggaaaatacctcaattaaaatttttccatatagattttctcaac

SEQ ID NO: 596984 - DNA, 120 bp, Homo sapiens
gcgccgcggttaacgaggcttgctggaagctcatcaacgaagctattagttgtgagtatagtttgaatgtccgttgtagaagaaggattatgatgcgactgtgagtgcgttcgtatgttt

SEQ ID NO: 596985 - DNA, 151 bp, Homo sapiens
  misc_feature (84)..(84): n is a, c, g, or t
  misc_feature (122)..(122): n is a, c, g, or t
caagtgatccacccgccttggctctcgaagtgctgggattacaggcgtgcaccccagcccggctatcagcactgttctgattgnagacgtttcacagcatgtttggctttggtaaatcaatnccaggaagactagcatgtgcactttatct

SEQ ID NO: 596986 - DNA, 499 bp, Homo sapiens
  misc_feature (19)..(19): n is a, c, g, or t
  misc_feature (161)..(161): n is a, c, g, or t
  misc_feature (199)..(203): n is a, c, g, or t
  misc_feature (205)..(210): n is a, c, g, or t
  misc_feature (215)..(216): n is a, c, g, or t
  misc_feature (221)..(221): n is a, c, g, or t
  misc_feature (224)..(224): n is a, c, g, or t
  misc_feature (226)..(226): n is a, c, g, or t
  misc_feature (229)..(229): n is a, c, g, or t
  misc_feature (267)..(267): n is a, c, g, or t
  misc_feature (269)..(269): n is a, c, g, or t
  misc_feature (286)..(287): n is a, c, g, or t
  misc_feature (302)..(302): n is a, c, g, or t
  misc_feature (304)..(304): n is a, c, g, or t
  misc_feature (306)..(306): n is a, c, g, or t
  misc_feature (308)..(308): n is a, c, g, or t
  misc_feature (313)..(313): n is a, c, g, or t
  misc_feature (336)..(336): n is a, c, g, or t
  misc_feature (352)..(352): n is a, c, g, or t
  misc_feature (356)..(356): n is a, c, g, or t
  misc_feature (361)..(361): n is a, c, g, or t
  misc_feature (369)..(369): n is a, c, g, or t
  misc_feature (379)..(379): n is a, c, g, or t
  misc_feature (381)..(381): n is a, c, g, or t
  misc_feature (388)..(388): n is a, c, g, or t
  misc_feature (406)..(406): n is a, c, g, or t
  misc_feature (434)..(434): n is a, c, g, or t
  misc_feature (499)..(499): n is a, c, g, or t
gggtgcatttggtgctgangctttgaagccaccgtatttttcgttacctgtgactatggagccaatgggatgtgacttcgctcatcacggacagtcattccttctcctttccagggtgctgggggctggggttccctggcccaagggtccagcctcctctnaccccattccaggtggcatactgcagtctggctctttnnnnngnnnnnngccanncaagnatnanctncccaacccttgaacccccatgcaatgagcttctaactnanagctgatgaaaaaaagnncccccacccccaatncntncntcctnactcctccgtcgctgcccttcanaccttttggtgctaancctncccanagttaagnactggatgtntnctgatcncaggctgggaaccctacncccaccccctttgatcctttctacttcnacggtgaaaggactgaggtcggaataaagagggaagagggacttcccttgactgggttgtgtttn

SEQ ID NO: 596987 - DNA, 926 bp, Homo sapiens
  misc_feature (6)..(7): n is a, c, g, or t
  misc_feature (10)..(10): n is a, c, g, or t
  misc_feature (20)..(20): n is a, c, g, or t
  misc_feature (25)..(25): n is a, c, g, or t
  misc_feature (61)..(61): n is a, c, g, or t
  misc_feature (64)..(64): n is a, c, g, or t
  misc_feature (70)..(70): n is a, c, g, or t
  misc_feature (78)..(78): n is a, c, g, or t
  misc_feature (90)..(90): n is a, c, g, or t
  misc_feature (111)..(111): n is a, c, g, or t
  misc_feature (122)..(123): n is a, c, g, or t
  misc_feature (127)..(127): n is a, c, g, or t
  misc_feature (136)..(136): n is a, c, g, or t
  misc_feature (145)..(145): n is a, c, g, or t
  misc_feature (147)..(147): n is a, c, g, or t
  misc_feature (160)..(160): n is a, c, g, or t
  misc_feature (163)..(163): n is a, c, g, or t
  misc_feature (169)..(169): n is a, c, g, or t
  misc_feature (172)..(172): n is a, c, g, or t
  misc_feature (176)..(176): n is a, c, g, or t
  misc_feature (187)..(187): n is a, c, g, or t
  misc_feature (196)..(196): n is a, c, g, or t
  misc_feature (198)..(198): n is a, c, g, or t
  misc_feature (203)..(204): n is a, c, g, or t
  misc_feature (219)..(219): n is a, c, g, or t
  misc_feature (223)..(224): n is a, c, g, or t
  misc_feature (226)..(226): n is a, c, g, or t
  misc_feature (228)..(228): n is a, c, g, or t
  misc_feature (238)..(238): n is a, c, g, or t
  misc_feature (240)..(240): n is a, c, g, or t
  misc_feature (243)..(243): n is a, c, g, or t
  misc_feature (245)..(245): n is a, c, g, or t
  misc_feature (247)..(247): n is a, c, g, or t
  misc_feature (256)..(257): n is a, c, g, or t
  misc_feature (274)..(274): n is a, c, g, or t
  misc_feature (277)..(277): n is a, c, g, or t
  misc_feature (279)..(279): n is a, c, g, or t
  misc_feature (283)..(283): n is a, c, g, or t
  misc_feature (288)..(288): n is a, c, g, or t
  misc_feature (300)..(300): n is a, c, g, or t
  misc_feature (308)..(308): n is a, c, g, or t
  misc_feature (310)..(310): n is a, c, g, or t
  misc_feature (316)..(316): n is a, c, g, or t
  misc_feature (320)..(320): n is a, c, g, or t
  misc_feature (324)..(324): n is a, c, g, or t
  misc_feature (337)..(337): n is a, c, g, or t
  misc_feature (343)..(343): n is a, c, g, or t
  misc_feature (346)..(346): n is a, c, g, or t
  misc_feature (350)..(350): n is a, c, g, or t
  misc_feature (355)..(355): n is a, c, g, or t
  misc_feature (362)..(362): n is a, c, g, or t
  misc_feature (364)..(364): n is a, c, g, or t
  misc_feature (367)..(368): n is a, c, g, or t
  misc_feature (371)..(371): n is a, c, g, or t
  misc_feature (376)..(376): n is a, c, g, or t
  misc_feature (385)..(385): n is a, c, g, or t
  misc_feature (397)..(397): n is a, c, g, or t
  misc_feature (399)..(399): n is a, c, g, or t
  misc_feature (401)..(401): n is a, c, g, or t
  misc_feature (413)..(413): n is a, c, g, or t
  misc_feature (418)..(418): n is a, c, g, or t
  misc_feature (420)..(421): n is a, c, g, or t
  misc_feature (444)..(444): n is a, c, g, or t
  misc_feature (447)..(448): n is a, c, g, or t
  misc_feature (451)..(451): n is a, c, g, or t
  misc_feature (456)..(456): n is a, c, g, or t
  misc_feature (458)..(458): n is a, c, g, or t
  misc_feature (464)..(464): n is a, c, g, or t
  misc_feature (507)..(507): n is a, c, g, or t
  misc_feature (509)..(509): n is a, c, g, or t
  misc_feature (511)..(511): n is a, c, g, or t
  misc_feature (516)..(516): n is a, c, g, or t
  misc_feature (518)..(518): n is a, c, g, or t
  misc_feature (537)..(537): n is a, c, g, or t
  misc_feature (539)..(539): n is a, c, g, or t
  misc_feature (541)..(541): n is a, c, g, or t
  misc_feature (565)..(565): n is a, c, g, or t
  misc_feature (593)..(593): n is a, c, g, or t
  misc_feature (598)..(598): n is a, c, g, or t
  misc_feature (600)..(600): n is a, c, g, or t
  misc_feature (797)..(797): n is a, c, g, or t
  misc_feature (840)..(840): n is a, c, g, or t
  misc_feature (916)..(916): n is a, c, g, or t
tgaagnngcnggccagaccngaganggggagagccgtgggcccagtgcccgtggcctgccngtngtgccngggagccnacgaccaggccnggagccagcaaccaagcgcangcccggaggannggcnccaggacanggagcgccngncagaggagcggcngcngccacngcngagncagcccacacngggcagccngnggganncccttaggcactgcncccnncncngcaacccgcngnccngngngccagcccnngaagcgccccccagccncgngncacngggcngctcgggaggcngcccccgncncagtcnggcnggcncagcctcaccctncccatnccncacngcccncctctcncngcnnaanacccnggcccaganccacaaggggcngngnggccagcgggcngccanannggctgccccgggactccagaatnacnnccnccagngngtggcncctggggctgccccacacctcacacctttctctgcatgggccntntntcatnantaccacctgtttttttttngnantcgctctggcccagaaagcggcancctgcagccactgccagccacccatgcngcccncnatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctnctggctcaggcctgccaggacctccccagcatccgcaactgcnacctgactcattgctcgccagcccgagccagtctgctggcctcccaggctctgcaccgaggggagcgacagcgagnccaaccctgc

SEQ ID NO: 596988 - DNA, 302 bp, Homo sapiens
agctataatggctaggagagaggcgataggttaaagtgtaatgaccaaacattctaaaagaaatgcaaaaacaaaagtttattttcacgccttcgaactatattaaggaaagcaaaatcatttcctaaatgcatatcattggtgagcaatttctcacttactatccttgaatcattcatttaagactctggcttcatgtagactcgagtatgtcttctaggaaagtactatttcatggtccaaacctgttgccatagttggtaattctttcctttacgtgtgaaatatttagatgaaatttt

SEQ ID NO: 596989 - DNA, 466 bp, Homo sapiens
  misc_feature (8)..(8): n is a, c, g, or t
  misc_feature (56)..(56): n is a, c, g, or t
atgtattnccccaaagcttcactgtgaacctcctttcaaagtaaatgtttccaacnaaatgtgaaaaggtgttgaaatccccccatagggagaaataaagagtggaaagagggaaaaataacagcagcctttaagtatgcctgttttaaagcaaataaggacaaaaactggctccttctggcccgggtgtggtggcctcaaacctgtaatcccccaggactttgggaggcccaagaggtggatcagctgaggtcaggaattcgagaccagccctggcccaacattgtgaaacgccgtcactactaaaaatacaaaaattagctgggcgtggtggcaggcgcctataatcccagctacttgggaggctgaggcatgagaagcacttgaacctgggaggcagaggttgcagtgagccaagatcgcaccactgcactcgagctgtcggacagagcaaaagactgtgtct

SEQ ID NO: 596990 - DNA, 211 bp, Homo sapiens
gaggatcccatatcatgtttacacaagttagaaaaggacactctctacatcagaagacaaagaatgccaagttaaatattgcatttcattttacaagatatttttacatttaatagtcatgtaaaaagaataatgaacttgtagaaaacaacttcaatctctgtacaaatgttgaatatccaatggagcagcttgaagctttaattgtggt

SEQ ID NO: 596991 - DNA, 227 bp, Homo sapiens
agcggagtcgccggcggctcgcgcacggctcgcggtccttttgcctgtcagccggcgctgtcctgctcctccctccgtgaggtgtcgggttccttcgcccagctctccacctacgaccgccgtccgagggatgattgaatatgtagaaaccggagaactctaggagagatggcagctgactcccattgtttctaaaatctggaaacttgtccttattgaatacgact

SEQ ID NO: 596992 - DNA, 257 bp, Homo sapiens
attctggctgagggattcacagcacacgtgttgatgtatcgattgatgtcatgaggatagcggcatcatagtattagaggcccactgactggtgagatccccgaggatctcttcaatggttccagaagagttgtctggctagggatcggtgacgcattagtcgagccatgtagacaatctcatcaaaagtgatattcccactgtagttaaatgtttctctgtgtctttctgtctcttggtaccagaaatatcgaggt

SEQ ID NO: 596993 - DNA, 108 bp, Homo sapiens
  misc_feature (24)..(24): n is a, c, g, or t
ttccacggttcatcgtaatgaaanaataaaatttgtctgtcctgccttaaaattacattcgttcttccgctcaaatcctgatctggtccgtcaatggcgtccgcacaa

SEQ ID NO: 596994 - DNA, 239 bp, Homo sapiens
ctggataatgataacaccatatggagtgctagaggccgatgctgctgatgctcttctcagcagataattatgaaatcgatagggatgaggctgacatacttcaggaaggtctagtcaaagaagctattcaagcaaaaagattggatgtattggtctatatgctagagaaagatcaaagacttgaattggctataacttttttcagatggcggctatgctgtatgaagcagtccatgaat

SEQ ID NO: 596995 - DNA, 130 bp, Homo sapiens
tactttaccaggtagactagcaattgacgaactgtacttgactaaatcaggaaaggaactgctatttggtgtgttcctctgtggacccagtttatttcatccttaaacataatatttatgcggaagacat

SEQ ID NO: 596996 - DNA, 1010 bp, Homo sapiens
cacgacaaattgctttcttgcggtcttgtgggttcacctctgatgtggtgcagccccggagtggccctggtactcagggggaccccttgcgcggggtcctgttcctccggagctgggtgtcccctcttctcatgcctggtttctgctccgcgcgtgtgttgttcccggagcacgtcccccgggcgggcatcgcctttctgtcggtgcggttctccctgtgttctctgtgccggcgcggttgtgtgccaccggttctttcgcgcgcgatctggccaatttgtgtgcgcccccgcggaaccccgctgtttgggggggtcgctcccatgatgaccctcattccgccgggcgcaacccacaaaattccttgccccccgggccaccccaccacatgaagcaagtggttgccactagtcgaacccctgctttctttttgtgggtgctcccccagaccccagtgatttatggatcgctttgtcaaaacattggtcttatgggttttcccatcccgccgccttttctacctcttctcggcatgagtttctgagtggtgtttaagacaaacactgatgcggcgctaatgaactcgcgtgtccgtgggatggcacgctttctggtaggcatgtactttcgccgcccggccctcggatggcatcgttgggagattcccgccccacccacgaccagatccctctgtggacgggtggtgccggctgacaaccccacccacgtcgcaatcttcttgtggggagacaacctccgctcttctttgtgtaaggccttgtactatttctccgtgctagaatctcccagggatggcgccgcccaagaaatattctcgtgcctgcagcaaacggggtgtggtagatagagcaaataaggacgggaccaacgatttatctggtaatagttcaggatgcttttcttaccggaaagagatcttttttacaaaaagccctccgacaaacccttcatcaaatccgggaaaacaagacccttttcccccacataac

SEQ ID NO: 596997 - DNA, 1010 bp, Homo sapiens
  misc_feature (117)..(117): n is a, c, g, or t
  misc_feature (170)..(170): n is a, c, g, or t
cgatgaattctgaggagggtaatatagctagacagtcctaacctctgagcggaatcgttgacctgatcatgatcattcttgcaccattcattcatatgacagtgcacgtaggcacantgatgtgctgggccgtcactgatttgttggcttgcatgacgggtactcagaancaatgcaccgctagcgaagagtgcatgctctgcagtactcgagtagatagtggaggcttgccgaatgcttacttgcactgtccaagatggaccctcggcttggcttgcatctgtacctgtactactcctataactgaacattaaactactagtttcttggatccgggaactctgcctaggggggaataccagagcagaatgtatagcctcgtatgcccaaggaccctctttagaacacaccgctgcactgcaactttcaaagactccggaggtgatatatttggccctagtgtacgactcgtagcgacaaagtaacatcagagtgcccgttccctctagaacaaacatcttagggaaggtgtcgggtcgcgtgtgttccccgtaattatttattttcaaatgcactccatttccctaagtcaaatatggttgcctcaatccccttggcaataaatattctcaagagggctaatgaaatacgcgcattaagtaattctttccgaacctaaacttgaggaccacgagaattcgactttttgaggtttcggaacatcctattttagggtaacgtcaaggtaaccattctcctcaagtgtctttaaaccctttgaaaaattccgggctgaggaacaaacccaagataaagggcgtaacccccttttgtataaccccaatccaatttgggaaacaaaaagaataaggccaattcacgttaacatgataacagtttcgaaccaacaaaagtccagttagaattcccataaattagcgcagaggataatcgttccaccttaagtttgccaaaaccgacaacagtactccaaattggggcacccccga

SEQ ID NO: 596998 - DNA, 376 bp, Homo sapiens
  misc_feature (136)..(136): n is a, c, g, or t
  misc_feature (265)..(265): n is a, c, g, or t
gaactccaggccggtgtctgaacgggaaaccgaagccccggaagccttttggagtgtaggtgtgattgaggaaggaaaacaaaagccagcggacaggtggtgaagtgagggctgagttagccaccctagggaattntccgccttgcagaaaacattgagaggaatgatagcaacctgcctctatttgtgggcagttggtttcaaagggttgtgtgtctcgcccagaacctagggaaatgggtgtttgttccatcgtgggaggagnacctgtcagtgctgcacattagacagctgtgtcaggagttctcctttaataatgctgtggctttacgttatgattgaccggactgcggaataaacactggaatgaagatgt

SEQ ID NO: 596999 - DNA, 411 bp, Homo sapiens
cccccgcggtcgccctcgttcgggcatttagctctcgttctgctggagagcatagtatataggtcatgcaaaacctactataccttcttatgagatcgcacatgattggctgatgagcaatccatctttgctataacaatttttgggtcattgcagagcttctcgccgattcctttatacttagtgctccaggttcttacaataaccacaccaaggggcatcctattccatcagcacatctttgttttcattattcactatttcatcaaaattctctgctaccactaccttcacaggcccatcattgctctctgggataggtacccacttcaggtatctcttcagattgccatcaccgtaatcctgcaggatcctctccagagccttcccatcacgcgatatctcctcctg

SEQ ID NO: 597000 - DNA, 117 bp, Homo sapiens
gaagggaacattcttccatggacaggacaactataccagcttgttcgcattgccaaggtttctgggtacagaagaactgtatgggttctgaagaagtatcacatagacctagatcca

SEQ ID NO: 597001 - DNA, 288 bp, Homo sapiens
gagagagagagagagagagagagagagagagagagagagagagagagagactgagagcgctagcgccacattttcttcctcttctcttctctctctcctttttctctccctgtcccttctctcccttcctttcccttctccctctctctccctctctcttcttcctcttctctcttctctcctcccccctcctttctcctctcctcccttcccttctttctctcccttcttccctccctccttcttccttcttcctcttcttcttccctccccttctcttcttccccc

SEQ ID NO: 597002 - DNA, 456 bp, Homo sapiens
  misc_feature (420)..(420): n is a, c, g, or t
  misc_feature (448)..(448): n is a, c, g, or t
  misc_feature (450)..(450): n is a, c, g, or t
aattgtatttttcaaaaaggatacagcaagatttcagatctcaaatactgttccagaacctattgcctgtgacaatcgttactccccctaaagaggcaaaatgatttcctttccactggaaccggggtcaaattttttgatggccttgatgaataaagtgtggcacaagtgacactgcaagactttggagggtaggccataaagggaaagaaagcttctgggtttcttttagtcctgggactgggctgccatactgtgacaaagcacacatgaaagaacatcaagagatgtttagatgaaatccaaatcacatttatgtgaatccagcccccagcctttgaatccttcagttaacttccccaactttgtggagtagagaaaaattgtccccactgtgactatccaaatatcttgccttcncaatctgaacataataaatttttgattnanaccaaa

SEQ ID NO: 597003 - DNA, 227 bp, Homo sapiens
cgtgggtccttgcagaactacgaacgggcccccactgtcagactggacacatggtggcggcagaggcggctggagcccaggacagtgcagctgttctggaagccagtgcccctggaggaagacagcggacgtgatccaagggttatgtgtgtttcttgggagacacctcaggccaggctggggccatcctgcccctctgcaagaacccacgggttaccgagctcgaa

SEQ ID NO: 597004 - DNA, 120 bp, Homo sapiens
ccggagtttgcggaacttggggtcagggctttccgcttggggttcagggggcagagacctagaaaaaaatttcccgcggcccgggcgcttttttgcccctttggggcccccgcccctgga

SEQ ID NO: 597005 - DNA, 643 bp, Homo sapiens
  misc_feature (384)..(384): n is a, c, g, or t
ctctctggatgagaccgataccctaccccctgatgaagttcgcctgctttggacgtactgttgaagccctgtgaccagtttgtggttcctaagcccccccagtgaatgttccaagcccgagcagctggttgtaacatttgtagccggttacataagctggagtcttttgtgccattgtttctcacccctcgctgattctgtggtatctgtgttgagataaagaaaaaggtagccgtgcttctctggtcctccagagaacttggagtttataaggtgtatggaagggagctgtttgcccgtatcactcactgattggtaaccctgagctgcacctacacgtggtttatctatgactccgctgaaggtctatcttcagagcttccntcgccctcctccacacccgagaatgccacgaggtcttctgaagaagaaagcttgggttaaactcacgtagttatgatccaagcacaaatgtggagctgaattctgcttgttgaatcacgtgttgaagaaagtgccaaaggagacttttatatatttgaccgtgtaggaaattgtctattcctgatataattactgtagtactcttgcttaaggcacagagtttcagatttactgttgaaataaaccccactcttcatga

SEQ ID NO: 597006 - DNA, 515 bp, Homo sapiens
gcccgaggattaccggaccaagtaaccctcagtaataactcaaacatcgttaccctgaaaccgattataggatcaatgccccacaggatccaagctactggctgcatcgaggtaaggggtgaagggtctgagctagatcaaaaggcacgggatggagatgtggcagagaaagtacttgtggggagacctagcttttaacaggcttctggaaaagctagggaaaagtggttgcccgctttccccctttccctccccttcaagcaccgcttgagatctgggctttattattaagagctgctataaaaacagcttgcttaaatgtaaagagaagcccaggggtacttcaagcattccttcggatgcttcactccagaaagagggagttgaggcaagtcctcattactaataaaaatcaggtgaggctggcacttctcttgaccttaggataatagcgctttgttgtctctcctgccacaggaaggctccatggttgtcctactttaagccttcggtgc

SEQ ID NO: 597007 - DNA, 242 bp, Homo sapiens
cgcgtatccgacactcatataaagtctctctgtctgtcatagattatatactgacgtcgaattgaattggggatggtataccttcatagtccccacagaagacttgctatacattgcagtgtgtagtagtgtgtttacctactgaactcatttactataatgtgattagctaatgccaattgttaaaaagtgactgatatcgcactaatgaagaaatcatgttgagtcatatgtgctattcc

SEQ ID NO: 597008 - DNA, 191 bp, Homo sapiens
  misc_feature (11)..(11): n is a, c, g, or t
  misc_feature (34)..(34): n is a, c, g, or t
  misc_feature (70)..(70): n is a, c, g, or t
aaatttagtanctgaattgccgatgttgagctgnactgtaagtgtaaaatatacactggattttcaaacncctaatatgaaaaaatgttcaaatgattttatgcattgcatttttcatattgcatgaatatattgaaatgcataatagtttgggtatattgggttcaaacaaagtcaagtctttcaatgtc

SEQ ID NO: 597009 - DNA, 343 bp, Homo sapiens
gtgctctagaggattcccattggatagcggataggggtcttctggttggcatgcatcatcgtggatggacacagcgtgaagtagctgtgcaaggcctttgcgcaggcgaagcaccatgcaacagccatcattgccaagaccttcaagggccgagggatcacgcggggtagacgataaggagtcttggcaatgggaagcccctccccaaaaacatggctgagccgatcattccaggagatctacagccagatccagagcaaagcgaagaatctgttcaaccccctccacagaaggacgcacccttagtggacattgccaacatccgcatgccaagtccatgccc

SEQ ID NO: 597010 - DNA, 424 bp, Homo sapiens
  misc_feature (337)..(337): n is a, c, g, or t
  misc_feature (380)..(382): n is a, c, g, or t
ccagggtgcaggccgggaacagccgcctgagtcctccgtggccctgccggtcacttccccggcctcacctccttccacgtcctctctccaccagctcctgcctcgcagtctcccggctgaccttcaaacactcccagtgcaatcccgccccaaggacaccgcgcttgcagtcccctcctgggaacgtctttgcccagatgtccctgggattcccttcccccgctggaccccattccctccttcactttcccactgggctcgtgacatttactcctcactgaggatcccccgatgccctcctcccaccagaacatcagctccttgaaggcagagactntgggctgctttaaccaccacatcctagtgtccaggacagtgcnnnacacacataagtcatgggatgaataaacactagaaaagcaaa

SEQ ID NO: 597011 - DNA, 181 bp, Homo sapiens
caaaggtgacgtatccagaatcatataaggaacttaaatttacaaggtaaatagacaaatcacctaggctgttctgtggtgtagccattcttttattcctttactttcttaataaacttgcttccactttactgttaaaaaaaaaaaaccacaatcaattggggcggggtgcgttgctgat

SEQ ID NO: 597012 - DNA, 489 bp, Homo sapiens
  misc_feature (156)..(156): n is a, c, g, or t
  misc_feature (252)..(252): n is a, c, g, or t
  misc_feature (264)..(264): n is a, c, g, or t
atagttatgggccccctaagggcccccgtttggcggcccctttgggaaagaaaattttcttgcccctttccccccgcccccccaagaatggtttattaagggggttcgggctaccaaagcccttattgacaagcccagagtcccccccccccccgnaacagggcactttggtgtgaacattccccctaatgtgaggctgtgaaaaggcattatggaccctgcaaaaggaggccccccacaccaggacagacnctagtttcaaangaggggcactgccccctgcctgcccctttggtgcccaggcacaaaaccctgatagtgggtttgggtccccttggtatggaatgtatgtgctgaccccctaggtgagtttggggattggaacagggattttaggtctgcctctctctctctctctctctctctctctctctctctgtgtgtgtgtgtgtgtgtgaagttttttacaggtgaataaacaaagtttga

SEQ ID NO: 597013 - DNA, 112 bp, Homo sapiens
acccgtcttcctatagtcactgagtctaaacagacagcaggtgaagagatagcgttgaggccattgagggctcaagagaggacatcgtggttcctgtctacctgcgggagcg

SEQ ID NO: 597014 - DNA, 1560 bp, Homo sapiens
atgtgatgtggtcacacacgcacgtggtgtgaataaaataatgtgtgacacagttgtggaacctgatagtgattgaatttagtgttgtagaggtagcgacggttgttgtaacaagaggagggagcaagtcttgttgataaaaaagaggcacgccaccgtggttgtgtcgcataagagaggctgcttcgcgcacaagagaaagaggggtctctttttggggaaaaaatgcttagggagaacagggtaatttataaaattcatctaattggggcccgttttttgtgttcgcccgccccgcggttgcgtattatccactctcaattatatggggccccttttgtaagagtggttgcacacaacaatctttgtgggggttctctgttataaagattactctctgcttaaagagagaaaaaaatatataacactggggggtgcaacactgttttccacggagaagaagttttttctctgtgtacaacataaagagtgggggttatattggggcccccctcttaatataattgtttaaacacgtgcgtttttttgttgttataataatgtagtcgtgtttttttgtgtggtagggacgccccaaagggcacacaccacactttgtctggttgtcttcgccccctatggccctggagaaagttgttttgtggtttggggcaacccaacacggtcttttcaaaagcgcttcaaaccgtggccaaaacacctttcttgggcccccgtcctcccacaggttgtcaaaaagccacacagtctctggtgtctgttgcgccgctcacagcgcgctcttccacacaggttagtgcctggtggagatttatacacggggcacacccccgcgcacaccaacaccgctctcacaggcttaaaatttttttgttatatttttttctgttaagagagaaatgtgggttgttttcaacccagagatagtgtttgtgccccacagagcctgtgtggtctcttcacaaacactttctttgacgacactcttcaaaagtgtgagtgtctggcgcacacacactctggggcgctctccccacacaagtggtgtctcgggaggtatacacacagtgtgtgtataaagcccacaactcgcggcgcccgcgcgctctgttttaaaccttttataaaacacactgtgtgttataagagattgtctaccccctatataaagagatcacaaaagtatatacacatggagatttgagacctctctacatctacacattggagatatagcacagtgagagtggagactgagaagggttctcacaatatcacaagagaaaagcccggcacaccacacagaaactttccacattcttaaatctagagagctgagccacgtttgagagctgagattctctcctttgaaagaggtccctttttgagttgcacgtgcacgtaactggcacatttcttgagaatggagatgtaaagtggaggtatattttatagtttaaaaggcttttctcaaattacttgaatttttttataaaattgaggagctttatttctatttacccttccatttttgtgtga

SEQ ID NO: 597015 - DNA, 116 bp, Homo sapiens
ggtccctccctagtctctgtacccaaagcaactcatcccaaatcttctttcttatccctacccacctctcccctcaggccaaccccaatgtgtctctaagtctgtattaactgctt

SEQ ID NO: 597016 - DNA, 508 bp, Homo sapiens
tctagagtataccggctatcacattatcagcatctgtatgaaggcagcagacagcgtttcctcagagcagcccattcttcagcggcaggacacgaggacccacaggcccgctttccgtcccgagcacagcatgcccagagggaccagcggggctcctcagcagaaacttaaatttagaaggtgctcccagtcagggaccctcacaggcttgggtgacgaaagggtgtcttgccggggagaaggtccgggccacgacccagccagcaaattgggaggaggaacttgcacacccacggacacttgctcttgaaaaggaggatgatttacttgcttcctaaaactgacaggctgcacttgtcctctccaagcagaggtgtgaagcaggggcagctggttctcactggtctttgaagttggcctttctcttttccacaaacgcggtcatcccttctttccggtcaatcagtggcaaaggttgaataaaagagtttcgataatgtgatagccc

SEQ ID NO: 597017 - DNA, 359 bp, Homo sapiens
actcagtctctcgtctgtgctgcgtgaggatcctcgtagcagtcgtgctgacagggtatacataccatagtactgctagtcgtaatactactgcggagagtgcgatagcacctcagcgatggcggcttcgacatgggctttacggagtcataagtggagtccgtaacgaggtatctttagtataaaagctattgtgtaagctagtcgtattaactagttggctcaggagtatgatagttctatggagcagtgagagtgaatagtagaatgtatagtgagcctagggtgtcgtgagtgtaaattagtgcgatgagtaggggaagggagcctactagggtgtaggctcctacagcctgtta

SEQ ID NO: 597018 - DNA, 356 bp, Homo sapiens
tcggcattgaaagcaaactcagacacatctgacctggagttctacctgcactaagagaagagagtggtaactaattcatggataaaacagaccatcgaggcagcactgaatgatctcacccacgaatgacaacagtggcacaggagggctatgaacattttgcttcaggatgttttatttcgctctactgttatgtagagaaagcatggtttgctttttataacttttgtgacccaaaaataccagactgttgttttccctaggtgccaggccatcctgttctgtgtgttcccaaactcttagttttgttcatgtaaaactcatgatttcataattaaaacaatattcaaataaca

SEQ ID NO: 597019 - DNA, 349 bp, Homo sapiens
  misc_feature (72)..(72): n is a, c, g, or t
tgtagtgacctcttccccctcaagcactagtcctgaatatcagtagccaggtgctgtagctgagcccccccngggttcacattattttggttgtttattacccctagcagaggtttagaaagatcagtagttttatcatttgagttcaggagtttcgagactagccctggcccaacatggtgaaaccccatctctactaaaaaaataaaaataaaaaataaataaattagctgggcacgtagagcgcacctgtaatcccagctactcgggaggctgaggcacaagaatcacttgaaccccggaggtggaggttgcagtgagccgagatcacatcactgcactcctgggc

SEQ ID NO: 597020 - DNA, 278 bp, Homo sapiens
cgtaacctccaatataatttcatataactgaaacttggtaccatttaaccaacacctccccattaccgtctcccctaacgcctggcaaccaccattctactctgtgcttcatgtgtatgcctatttagattccacatgtaactcaatcacgtagcatgtgtctttctgtgtctggcttatttcatgtagcataaagttctgcaggaccatccatgttgttgtaattggcaggatttccatctttctaagggctgagtagtacagttagctttcgcatc

SEQ ID NO: 597021 - DNA, 478 bp, Homo sapiens
  misc_feature (41)..(41): n is a, c, g, or t
  misc_feature (47)..(47): n is a, c, g, or t
  misc_feature (91)..(91): n is a, c, g, or t
  misc_feature (109)..(109): n is a, c, g, or t
  misc_feature (262)..(262): n is a, c, g, or t
  misc_feature (301)..(301): n is a, c, g, or t
  misc_feature (373)..(373): n is a, c, g, or t
  misc_feature (377)..(377): n is a, c, g, or t
  misc_feature (384)..(384): n is a, c, g, or t
  misc_feature (391)..(392): n is a, c, g, or t
  misc_feature (408)..(408): n is a, c, g, or t
  misc_feature (410)..(410): n is a, c, g, or t
  misc_feature (430)..(430): n is a, c, g, or t
atttccccccctcccgtgatggagaataattaaagccaaantccccnctttatatgattatatgattttcccccccagaagcctcctcttnccccaggtgatagaaggnagttccgagaggcacacagcccgagtacagagtgttcccggttaagaaaagagcaacctgcaaagacccctagccatgagcgcttggtttgtttgaggaacagcaaggatgtcaatgtgactagagcacactgggttgaaggacagtaggagncctgaggtcagagagcttgggagtgggataaggtggggnacataatggaggcatcgtaggccactgtaaaactttgcctctaagtgagagagcaaccatcagaaggttttnactnagaaatncatgacnnactatattttaaaatngnctaagagtagaaggggaagnaccagagcaaccagtagaagcatttagagaactgaaccagggtcagtg

SEQ ID NO: 597022 - DNA, 841 bp, Homo sapiens
  misc_feature (3)..(3): n is a, c, g, or t
  misc_feature (841)..(841): n is a, c, g, or t
tcnccctggccgggtgtcctggctcggcggtccccggcatggtggtctctagaattttggacgatgtgcggcggatgaacaagcgggagctctattatcaagtcctaaattttggaatgattggctcatcggcactaatgatctggaagggggttaatgggtataactggaagtgaaagtccgattggagtggtgctcagtggcagcatggaacctggcatttcatagaagagatcttctctttctaacacaatcgagttgaagatcccatacgaatgggagaaattggtggttttaggaatagaaggaagagagattcctatagttcaacgaggtcttgaagaattcatgaaaagcaaaatggggatatcaagtttttgaacaaaggagataataatgcgggtgatgaacgaaggctctataaacaagggacacattggctagagaagatgttgtggggagagccagggggattggtccttatattggaattgggacgatcctcctgaatgactattctaaatttaagtatgcagttctctttttgctggggttattcgtggctggttcatcgtgagtaagaaggctggcttggtgttcctgggaagatgccataattttcggtactggatgttcggagtacatactggtccgggattggtggcatgggaaccccgttgtggggctccgggttacctggtttgattaattatgttcctgcctttgtgtggcgggacttgcccaagaattgcccgagggattcagccaggatccactgctggccctacatttgacccgactttcattacgtgccacccctgtgtttcctcttttgccactn

SEQ ID NO: 597023 - DNA, 522 bp, Homo sapiens
agactgcctcctcaagtgggtccctgacccctgacccctgagcagcctaactgggaggcaccccccagtaggggcagactgacacctcacacggctgggtactcctctgagacaaaacttccagaggaacgatcagacagcagcattcgcggttcacgaaaatccgctgttctgcagccactgctgctgatagccaggcaaatagggtctggagtggacctctagcaaactccaacagacctgcagctgagggtcctgtctgttagaaggaaaactaacaaacagaaaggacatgcacaccaaaaacccatctgtacatcaccatcatcaaagaccaaaagtagataaaaccacaaagatggggaaaaaacagagcagaaaaactggaaactctaaaaagcagagagcctttcctcctccaaaggaaacgcagttccttacaagcaatggaacaaaagctggatggagaatgacttttgccaagtttgagaaaaagaaggctttaaaacaatcaaactactt

SEQ ID NO: 597024 - DNA, 379 bp, Homo sapiens
tccctgccgcagattgcatagccaggcaacggggttggggcaggggctttcgccgtcacggcatcagagatgttggcttctagattttcttgcaaggtgatggacgaaacctcttactggtcgccggtcgatagcttcgtcggtgcctcgatggcggccgtcatcctatgcatcctggccctggtcggtgcgaatatgctattgctcctggcgtccggatggattcttgcctacggcggagtgctcttcctgggcttcggcggctcgagctggacctcgtacatggcgatcaactactacatgaccgtcctcggggtcgccgcgcagctcttcgcaatggtgctgctcgtaggcatggacaggaccttgattgttgacc

SEQ ID NO: 597025 - DNA, 213 bp, Homo sapiens
ccaaattatatttcacccccaagtcagagactgaggacattccagggacaccccttctttctccaggatatcattcatatccacaggtcatagtagagtcagtctttaggcattgcttaaaaaacataaagccctgcctttttggaataagttaaatgatcagcttgtcaggcttatgcccacactttatgtctgggcaaatttcagcaactt

SEQ ID NO: 597026 - DNA, 190 bp, Homo sapiens
tgctctgaagtgtagactccctgagccaacgacgttaatatgactagctacaagtagcttttatatgtaaagatacctctttacggacgtccacttagtgactcccgtagatagcccagtgtcgaaggccccatcgctgggtcaatagtacttgccgcagtactcttgaaactaggcgggtatggtatga

SEQ ID NO: 597027 - DNA, 225 bp, Homo sapiens
gtttccctgggaaccccccccccccttttttttcccccctaaaaaaccccgggggcgttcccccccccggtttttttctttggccggggggggggttactttttttccccgggaaccccttttcccctttggccctttttggggccccttttaaaccatttttttcaaaaaaacgggggggggccggtccgggttttccggggtttttttccccccccggtccca

SEQ ID NO: 597028 - DNA, 184 bp, Homo sapiens
  misc_feature (106)..(106): n is a, c, g, or t
gggcttttcggctatacgccggatgagatcgtgcgcttatcgcgacgctggcgcaggtgtcaacgcgctgccggtggcaagcgacggctaaaattggtctgctctngcgtttcatattggtccgtattgtaccgtcgccgcgcggtgtattctgccgctatccggttatttccccaatggaaat

SEQ ID NO: 597029 - DNA, 142 bp, Homo sapiens
  misc_feature (33)..(33): n is a, c, g, or t
  misc_feature (75)..(75): n is a, c, g, or t
  misc_feature (86)..(86): n is a, c, g, or t
  misc_feature (109)..(109): n is a, c, g, or t
gaacgggccgctaggaggaagacggcgagcgtnacgatcgaggacggggaggccgccaaggaccggcgcaacatnccgtgcaccanagtggccgcgccgagcgttcctngcaccttcctccaccagcggcagcaagcgcaac

SEQ ID NO: 597030 - DNA, 339 bp, Homo sapiens
gtctcatcacggatccccatacagacgaccctgccggcctctgactcgcgaatggtcccctggggcaggtttcccgcctgcccgcgtgctggcgccttgtgctgagtgattcacagacctctgttttgaacccagcccaccctgtcacgtgtgtggtgtcatcctaggctctcaggcggggaaactgaagccctgcattacagtcgatggcagagctgtgatttgattgcccggctttcccactcgccctgtccatcatctgcaccagggctgcctggctgacccctgacaagcccttcgtggggagcactgagctttacccgttttgcagctcgcccc

SEQ ID NO: 597031 - DNA, 407 bp, Homo sapiens
atgatacaataaatgtgctctgaatggaggcagtcagactgggtgatggtgcaattcttgcacaggtagaaattaagttgcctggtctgtaaaaaaaggagacctaaggtcaaaaagtagaaactttggagcttagattaagatctcagaaattcttacatggagaatcagggggataaagcaatggcaagtacactgtaagtagccaaacagtatacaaagggatgcttctatattttcaccttgtttcattacactcattttaattgtgaggagccctgaatccaaaaagggtagtgacgactagtccagtgctccttccaccgtatcatgcggttctaaagtcattctggacatacaatctacaaaaatacatcatttttccagctcatgtccatggtccaaag

SEQ ID NO: 597032 - DNA, 401 bp, Homo sapiens
ataacagtagggaataaactgtgtcccacctgttttactttgtgttttattttgtctggttcaagtgcatgagcttattgcagccttagccaattttgcctttttaatttgtggatcacttaaaacattgagtgccaaaggtttaaggagggttgagaaacacaaagtaattccccttttttaccggattcagttcctgctaggatgttgtatcagaatcatgtgagaactcaggaagagatagagcagaacataacaaaggaagaaaatgtagattagaaaataagacttctgagaaaaagttcaaggaataaagattgtttgactctggagaggagaaagctgttgagatagtttgctaagtttgctaataaagctttattgagtcttttattgaaggg

SEQ ID NO: 597033 - DNA, 124 bp, Homo sapiens
gacgtagttcattggaattcagatattcagtctttggataactacagtactgcttcatctcattctggtggtccacctcagcctactgccttactgagtcattcccagtcagtagctgatatcg

SEQ ID NO: 597034 - DNA, 122 bp, Homo sapiens
  misc_feature (77)..(77): n is a, c, g, or t
ccagagtgggtcatgtcttcaggacagacgcaggatcactgctctggagaaacattgtcagaacactatgtttattnggtacaacagatgccaggccagggccctcgattgattatatataa

SEQ ID NO: 597035 - DNA, 285 bp, Homo sapiens
  misc_feature (137)..(137): n is a, c, g, or t
tgttgttgtttgtttttgaagacagggtcttgctctgttgcccaggctggagtgcagtggcatgatcatggctcactgcagcctcgacctcctgggctcaagcaatcctcccacctcagcctcccaagtggctaacnatataggcctacagggaaagcaccaaccaataccccagctaaattcttttatattttatagagatggggtctcccttatgttgccctggctggtcttaaactcctgggctcaactgatcagcctgcctcgtcctcccaaagtgctggg

SEQ ID NO: 597036 - DNA, 259 bp, Homo sapiens
atccatggggttaaaggactcggctttcttgttgctcccaacagtggttaaagaattcgtaaacttctttgataaggaggccacttcattgcagattggggtagttcattaactaagagctattgcttggtcttgaactggtgggtcctcttcttgtccatgaagacatgatctctgctactttattgaagctgctcagtatagcgcgattgtaagctccgccgaggacttacaagtggacgacatgtatacttgctat

SEQ ID NO: 597037 - DNA, 479 bp, Homo sapiens
ggagtatcgcggatcagcaggtgtagtcgataaggtcgtgctcatcatctgaccgatcagggcaagagagttccagtagctggtggggctgcaactctttaagctgccatcatcagaagctgccttggaaggtcccatgatattattgacaaccaggacttgaacccgatcaacacggatcctccagctccgagtccacatcaaagtctccctcactgtagatgaggtcctcattctcatcactctccatctcatcctcaatggcagcctgcaggtccccgaatgcgcttgaatgccaacatttaggatcagcctgcaggctctggttagcagcctccaggctttctagatccatctccagctcgtgcttcattgcggctcgcctcggcctccttcctggcaacctcgcccatctcctccttggagtcccggagcatgctctgtagccgcttgctctgttccttctcccggtactcggc

SEQ ID NO: 597038 - DNA, 824 bp, Homo sapiens
  misc_feature (15)..(15): n is a, c, g, or t
  misc_feature (75)..(75): n is a, c, g, or t
  misc_feature (103)..(103): n is a, c, g, or t
  misc_feature (147)..(147): n is a, c, g, or t
  misc_feature (153)..(154): n is a, c, g, or t
  misc_feature (172)..(172): n is a, c, g, or t
  misc_feature (186)..(187): n is a, c, g, or t
  misc_feature (190)..(190): n is a, c, g, or t
  misc_feature (202)..(202): n is a, c, g, or t
  misc_feature (204)..(204): n is a, c, g, or t
  misc_feature (210)..(210): n is a, c, g, or t
  misc_feature (242)..(242): n is a, c, g, or t
  misc_feature (340)..(340): n is a, c, g, or t
  misc_feature (342)..(342): n is a, c, g, or t
  misc_feature (348)..(348): n is a, c, g, or t
  misc_feature (357)..(357): n is a, c, g, or t
  misc_feature (404)..(404): n is a, c, g, or t
  misc_feature (424)..(424): n is a, c, g, or t
  misc_feature (451)..(451): n is a, c, g, or t
  misc_feature (454)..(454): n is a, c, g, or t
  misc_feature (482)..(482): n is a, c, g, or t
  misc_feature (544)..(544): n is a, c, g, or t
  misc_feature (599)..(599): n is a, c, g, or t
  misc_feature (751)..(751): n is a, c, g, or t
  misc_feature (756)..(756): n is a, c, g, or t
aaataaatgaagtanaagaaaaaattaaaattttttaaaaaaaggataagaaaataggaaaaaaatatgttcagnactttacatctatcatacaattgtatgnttttttttatctacattcatccattgagctatggaatcccctgnatttcnnatctttagcggatgtttnaacgccggcccggnnggntctctacacagngnccggtncgccctttcgctctccttaatgtctcgcggtncgcgtcttgagctgcttcccacacaaacactaccagccacgtctccaggccacggggaggtgtgtgggatgttttttctaaaccacatcagataaatntncgctcncatcttccnatgggctcccaccagcgggtcaggctgtatcgggctgtgctctgcantcatattccccagagttcantgtgggaagagacaataccagtagccnttnatgtctcactttgtttgtttctaaagtnaccaagacacacaaaaagacgagagtgtttaggaagaaccgggtcaggaacctcctgtttcncccaggtggggggcgtgggtgcggcgtgcccagagctgccctcccccagccgggnccggcccgcacaccctgcccagagcagccaggtagcccggggcagcatcgatgccctcacaaggctggtcaaaagaatgtgggggtggggtggtctctggatggtctttggaatgtccgtgtgcggccagctgggcagcgcctgcccccgancttgntcccgccagtgcccgacgggaggtgaggccactgtgccgcgctgctctatgtacacctggcccgcagt

SEQ ID NO: 597039 - DNA, 847 bp, Homo sapiens
tgagtcttcagttgtttggggaaacgcatacccgacactaaaaaaaaaaaaaaaaaaaaaaaaatttcacgtccgccagtccaggaaaacggaaacccccttcgtttacccggaattggttaatcccctcgccagggccagggactgggggtctaggtggggaccaaaaaaaaccggtccaaaactcccgttgcaaaccacattgggggcggggtctgactccgggttccccggttccccaaggctggagggcctgacttccccagacacagagattgattgtgtaaccaaacatgaaggttgaattgcccggtgacccaagggccctctccacgcgtgcccccttagcctccggggcgccagtgtctggggtggcgctcccacggccccatggcgcgactctgggccgtccccgaagtggggccctcttgtgatcggcggtcccccacaacccgtcgctttccttacgcgggccgaggggtgagtgtcaagtttgggcgccacttcgagggttctccgccgatctctgtatcgaaagaagggggggagggcaaagcctggggttacaggggggtggccggaaaggtgcccccagtacgtgaaaagccgaagctgcggtggggacaaacgcgccaagagcacttccgaagcatacccgaggggggagagcgaggcgcagcgcggaaaaaggaagcatgaaagggtgggttaagaccagccccttcacgtaatcaaggttcaatgacgctaagatcacgtaggtgcaattctccggaagaccaaatttcctgcggaagaaaagggccgtacccgttgaagcctccgggggggccaccccgaaaaagtc

SEQ ID NO: 597040 - DNA, 247 bp, Homo sapiens
  misc_feature (107)..(107): n is a, c, g, or t
acgattgacgtccgtgtcaggcagctttgtcatgtcttccaagtcaggaaggcgccaccgccctgcccacgacagctgcgtctgagccgcacgtcgtgagcactgtnctcggcggatatgaggacaccatccaagatttcctccgtgggagacctcctaaggagacgcgaagactatcgatgctttggaagaatgaagagaagtctctgataagccaaatctagggtagtatgggaagtgccctgtg

SEQ ID NO: 597041 - DNA, 880 bp, Homo sapiens
gtggcgatctttatttgtggcgtgtgggtgggaggggggttcccacgtgagccctggtgctatagagagccggcctgtcctccagagggtgagctggtggagtgcttctgcggttctggagtcccggctgattgtgcgccagttccccagcaaaacccctcacagagctgcaccccggatgcacagacaatggagtgggtgcttgggagtgacttgaggctgtgacggggtcagccctacggtgtgggcaagtgagtcctctagtggaccaagaggtcagagtcgtaccctgaggctagagatcgaacacagacaccgtggccctcataaaatttaaacataaaagcacaaaaatggagcaaccagacagcatatggctacagacaggcaggacacggaggaccctacgtgtgacctgtgacttatccacaaagggcaaggacctggcactgactaccggaacagtggagacggctgtgccgcccagccggccatgagtcagagccagaggctgaaagccacagacggggccgcagggcagcaagatcacgaggctctcgtgaaacacttcagcaaggcaaaatcctaaggaacagaatcctgactggagagaagccaaggtgtttaagcacaagacagggaagtgtatagatgggaatgtacaggggtgggtgaactttaaagagggagaaaagatgggagtgcttggaaagaaacagagcagtagaataaggagaaggaggagaagagggagaaagagagaagtgacattgatgaaaaaagaggaaaaaagttagtttaggatagaagttatgagagtggtaaacgaggaagtggcaaggagagataggtgagttagaaggaggagaagtgagagtag

SEQ ID NO: 597042 - DNA, 526 bp, Homo sapiens
tgttcagaggatccccgatgcaactcatcgggaatcggtcaaatgttattctagttctagatccttgaggaatagccacactgttttccacaagggttgaactaatttacactcccaacagtgtaaaagtgttcctatttctccatatccactccagcactgttgtttcctgactttttaatgattgccattctaacgggtgtgacatggtatctcattgtggttttgatttgcatttctctaatgaccagtgatgagcattttttcatgtgtccgttggctgcttaaatgttttcttttgagaagtgtctgtccatatcttggcccatttttggatggggcagttggttggtttcttgtaaactgtttaaattcttggtagattctagatattagcctttggtcagatggatagatggcaagaattttctcccattctgtagttgcctgttcactctgatgagtttctttggctgtgcagaagctatttaatttaattagatcccgatgatggcagggtaccgag

SEQ ID NO: 597043 - DNA, 686 bp, Homo sapiens
  misc_feature (356)..(356): n is a, c, g, or t
actggacgcttgaccttgcaggtgcctctggtctcaaggaacgtgtctgcgtgccggcgtcagtgtgtgcttctccaccttccagcccaccacaggccaccgtctctgcagcgttcacttccatgccggccgctagagatcctacacggttacgcgtccccaccagtcttcccagcttgcgcggcgtctaatgatgctgcaaacgtagcgcgcagacccgtcgtggggccgcagtccgcccgccgtacgcagcagcacgcaacagcagcagcagcagtaacagcagcaacagcagcagcatgcagcaacagcagcagcagcatgcagtgagcatgcagttcgctcgacctctctgnccgtccactgcccagactgacccagtgctgcagccgaatcctgggtatctgacttccgtggtcgtgcttctcacccttcaggcccctgttacacatgctcttcgggctccgaggttccgtatcatgccggtgcccattctacttcccatgtggatcattgatcgtgaatcccatcgtatctcccagatgctgcgtggtagctttgcggccggcagagggcgcagctcgctgctggccgccgtcgttcgggagtttacacgtgcttgctaccgcggggctggaggctgccgagtgccctatgggcccccagttggtggtggtgggggcaga

SEQ ID NO: 597044 - DNA, 707 bp, Homo sapiens
  misc_feature (303)..(303): n is a, c, g, or t
gcaagtcgatgtggaaaagagcaattataaacaccggggcgaagggggcccccggagggggcttcaaaggggggcgcaattttttaaggaaaggtctgtaaagatttttgctgcgtttttttataaaaaagggaaaaacggttgtttaaggcgtttaaattttccccaaaaagtttttgcttctgcaaagcaaaagggcaaaaaaagttttccccgccccgttggagagaaaggaaacaactacgcttgagttaatatccccagatgggtcccccccaaaggggggaccacatcactgagggncctttgggggagggaaaccccagtttgggaccgaaatattttcccagtacccgttacccagttgggggtttcatagcaaaagaacacgcaaaaaacaagtttttttaaaaaaggttgtttttttccccaaaaagtttgggggcccaaaatttttgcggttgaaacggtttttctccccgagaaaaagggggcgggggcgaacaaaaagcgggccaaagcgtggtttcgtcggcgtttaaaccttttaacagccagggagcacaagcgagaacaaggccccgaagaaagaacgccaaggaggggaaaaaccccccccaagtggcgcccaaaaagcaaggaacctaaaggaaactttagacaacacgccaacaccgcgggctttttcgattagtacccaattggtc

SEQ ID NO: 597045 - DNA, 149 bp, Homo sapiens
agaagcacgggcagttgggctgaattaggggcgatgagctagggtacgtgagcaggatgttaagttagggtctgcctgtatttctggtccccttggaaatgtccccttcttcagatgtcagacctcagtcccagtgcttcagagtcctc

SEQ ID NO: 597046 - DNA, 245 bp, Homo sapiens
  misc_feature (85)..(85): n is a, c, g, or t
ggccggcagcacgatgttcggcgttaccgttggtcgcggtgtccctggtaggtgtcctgggtgatcaccagttcggccgtctctnagcctcgatgacggtctgccgattggccacggtggcaacgggattggtgcagatgatccacacggccttgatgtcgcccgtgcccagctgccggaacatctcgatggtgccggggccgacatcggtgcggatggtgccgggttcgagctcccagtgctcc

SEQ ID NO: 597047 - DNA, 203 bp, Homo sapiens
tagatctagaggctcccggtcacgaggctacgatcccatcccacggacacgctttaaaaagattacaagccgggttatcactcacctgctacagcatggcctatttaaaggcctataaactctccttacaaattcccccattttacctgtcctaaaaccagacaagccttacgagttagttcaggatctggcgcctcggtgcc

SEQ ID NO: 597048 - DNA, 161 bp, Homo sapiens
tatcccctggtgcatgatgtgtaatttaaagaaacgaaaaataagcagcaccaatgccacactctacagtgtaccctgtatcccacccaattatgaatagttagatatattttatgtactttatacccacatgcatgcacccagggttaacgaggtcgaat

SEQ ID NO: 597049 - DNA, 200 bp, Homo sapiens
ggtagactgtacaacctgtacctgtctccgagcctccactatagcagatgcgagcaggagctaggacgagagggaggtaagagtcagaagcttatgtcgtctactgcggggaaacgccatactcgggggcaccgattattagagggaactagtcagattgccaagagccttccgcattatgcatgggctatatactatga

SEQ ID NO: 597050 - DNA, 393 bp, Homo sapiens
  misc_feature (22)..(22): n is a, c, g, or t
  misc_feature (34)..(34): n is a, c, g, or t
  misc_feature (74)..(74): n is a, c, g, or t
  misc_feature (341)..(341): n is a, c, g, or t
ggcttgatcgtggttcactgcnagcctcgcctcnccagaactcaatctatcctccccacctcagcctccctgancagcctgggacccaaaggtacacacccacccatgccctggatcattaaaaaaaattttttgtaggctgggcgcggttgtcacgcctgtaatcccagcactttgggaggtcaaggtggggtggatcacttgaggtcaagagtcccagaccagcttggccaacatggtgaaaccccatctctactaaaaatacaaaaattagccaggcgtggtggcgcatgcttgtaatcccagctactcaggaggctgaggcacaagaatcacttgancccaggaggtggaggttgcagtgagctgagtgagagagagactctgcctcaa

SEQ ID NO: 597051 - DNA, 259 bp, Homo sapiens
ttttttttttttagccagaacacacacagttatggttttattcttgtcctctggggccggtaacagtgcctctcacaaaagaagaactccctctggcaggggatgtgactagggactcattgggccggcaccacccacaaaagaatctaggcattagaatgaactactggaacctgagtcaaagacctgttggtgataatttgcccattttctggcctctagttgcttgaataggggaaagacagggaaatattaaatg

SEQ ID NO: 597052 - DNA, 527 bp, Homo sapiens
  misc_feature (49)..(49): n is a, c, g, or t
  misc_feature (377)..(377): n is a, c, g, or t
gataattgattatattaatggagtttaattctggctctctattatgtcngttgatctaattctccatcttttgctgtgcagaagctctttagtctagccggatcccacttgtcaatttttgtttttgctgcaattgcttttaggacttataaatcctttcccaaggccaatgtccagaacggtgttccataggttttcttctaggttcttacagtttgaggtcttacatttaaatatttgatccaccttgagttcagtttcatatatggtaaaatgtagggttctagcttcattcttctgcatatggctcaccagtgatcttaacactatttattgaatagatagtcctttccccattgcttatgtttgttgacttngtcaaagattagatggctgtaggtatgcagctttattcctgggttctctattctgttccattgttctatgtgtctgttttaataccagtaccagactgttgaggttactgtaaccttttagtttgaagttgggtaatgagatacctctgg

SEQ ID NO: 597053 - DNA, 245 bp, Homo sapiens
gactagcaggatccccattgatttcccgtggtggtctagtggttagaatcagccttgtacttgttgtggctcaggttacctctgtggcttgagttcgatccctgagccaggaactattgatactgccaggtgcaggtgaaccaaacaaaccaaaaaacaaatatgtaaccttcatctcagaaagcttgggagggccccttcccatgtgatccctatcatgtttgaaatcactggggtaccgcgct

SEQ ID NO: 597054 - DNA, 1853 bp, Homo sapiens
  misc_feature (352)..(352): n is a, c, g, or t
  misc_feature (423)..(423): n is a, c, g, or t
  misc_feature (1036)..(1036): n is a, c, g, or t
  misc_feature (1388)..(1388): n is a, c, g, or t
  misc_feature (1687)..(1687): n is a, c, g, or t
  misc_feature (1795)..(1795): n is a, c, g, or t
  misc_feature (1824)..(1824): n is a, c, g, or t
  misc_feature (1850)..(1850): n is a, c, g, or t
  misc_feature (1852)..(1853): n is a, c, g, or t
tgggggggggggcagagggggggggcggcggggggggaagaaaaagagggagggggggggtctcttccccccccccccgccactaataaaaaaacagggggggaagagaccaacaacgccgcccacacagagggggggggtacacacagggggcggtgaagaggcgcaccagagaggagggacaacaaagtccgtacacagacacacgggagagggcgcgccgccctctgattgttagtgtagggtggggtgggggcgccacacacatgatgacacagcggggcggcgggcgggagaacacacccggggagcgccacagagcggccgggggggcgcgacagacagagctctncacacacagagagagagcgcgcgcgcgcagacgagagacgagagcggtgaggcgcgcgccaccccctctgnagagagagagatgaggtggcgcgagcgacaaagagagtggtgggtgggcgctctccgagagagagtgtgggggcggtggagaggcaacagaagccgcgccgccgcggggggtgaggagaggagagagagtcgcgaccagagcagcagcgcgcgctgcataatgtcacgacacgcgctgagagagatcacacccgcgcgagtatggcgcgccgggatcatagcagcgggcgagcgagatgaatcaagatacaccaccaccgacagaggacaagagacgagccggcggggctggcgcggtggaacagagacccacaccgcaccaagagcggcgcgaccgtgaagcgaggggagcggacccccctcgtgtggggcgccgggagaagggaagcgcggcccacccaccacaaaaggagagagagacccccagcggggtggggggcaccacccacacacctaccgagggggggagcgaaataaaacaaccacgcggcgacccagcaccaagagaagaaaaaacccatctggtacgggacacagcccgccaaacacaccgccgagggggggacgacaaacacagatccgccgccgcaccagcatcgcacaacacaaaaanaagacaaccacacacaaggcagcggaggcagcgcaagcccggtaggccaacacaacagccagctaaagatggctgacgacgagcccccaaacaaacaatgttcgtggtgcaacagcacaaaaaactacacacagccgaggaggatgtgagcgaccaaccacaacccacccaccagaaactatgggagaacgacgcgacgcaacgatacaagtcaactcagtgacgaacatgccacagggagacgacggatcgagcacacccacccgaagtgggtggggaggcagcaccgcgccatagatgtaggaccgcgaccagggcacaccgcaaccacaccattcgtaatagcaacaancgcacgcgccagtgagacgacaggccaagtacacaccaccacgcacacgaaaacagtaatgaaagagtgcgaaggtaacgccgacgcccacgccacgagtgaactacccgagcacgagaagagacgagcgagcgcacaataaataatccctcatcaggcggtggcggacccaacagacgcacgacagccagcccgccactgtatgtatagacgaggggccgcccccaaacagaagcgggaagataaaacaatacaagcgagtcggccgggtcgtcaaccaaccagaatgaagaacagcngcacccccgtggcgttggtagacgaccacaccaccgtgtcggagatgtagacagccccaacacaacatcacgacgggacacatagaagatgacgcaggtatcgtagangatgaacgcgacagacatcacgtatgacnacagcgacggagccacacatcagacngnn

SEQ ID NO: 597055 - DNA, 104 bp, Homo sapiens
ggtacagtcagcatagatactgaaagatattggcccagagcagtggaggcagtgaacatcaaggcaggcaacagccttcctgcgtctcaagcgcaaggttcatc

SEQ ID NO: 597056 - DNA, 287 bp, Homo sapiens
gaggagactgctgagccccagctggaagcatcttgcttggagaaatgcaaggacctcctgagggccacactgacccactgggggcccggtgaccccttgcctggtcccacacaggggtctgtgggccagactatccccaagagtaaaacactgagctctgcgcatgctgctgtttctttggtggccagctgggtgcttcggtcattggctgagcgccctgtcagcagggcagaggtcacaagactccttgactggctcaagagccacattttgccacagccaatggt

SEQ ID NO: 597057 - DNA, 113 bp, Homo sapiens
atggcagccgagtagagacagatgtttctgggatcatatctcagattcccaagctaaagaggatgaggaagaaatttctactagcccaggtgtttctgacgttgtcagtgatg

SEQ ID NO: 597058 - DNA, 213 bp, Homo sapiens
gttggtcgcctctcgtccctggctacttcagatgctgagtgttgaatgaatggcttgagcctgggagacagagggttgcatctgagctgagtttgcactcactgcactccagtcgctggtgatgacagtgagactctgctctctaaaatatcagaaaatacaaatatagtgaactttgggggaagggttttttggttggtcgctcttcttgga

SEQ ID NO: 597059 - DNA, 539 bp, Homo sapiens
tgggaaaaagagaagcagtatgagcaagtgagctactcaagagaatctgggcctagggggaaagaaagagagaactggtcaaatattaaatccacgagatttctgtactgaaacatgggctgagaactacgacacattcccccaagaaaagggaagctggtggtgagggtgggtacccaagctaggaaaacagtacatacaggttggctttgggtggtccggcagcaaccatacaaggtagatggtcgcaaaagaaagtcagtggctccaaggaagactcccgaccatggtgggaggggagggataatggagagcccagttcagaataaccaaagagagcctgccttgggagaataactacatttcaggtgaatggaagcacctagagaaagagcaggttacggcaggctgtatactcaggtaaccctgggaagagggagaaccctctggagacatgccaggacaaaggccaagataggaccctgaaggctagagatgtatacgagtgacagttatggggatgggtacggagctcgaat

SEQ ID NO: 597060 - DNA, 198 bp, Homo sapiens
acaggagtacttcccggaccactgcatggtcggtaggatgccatgccagctgcatgcaggcgtgggtactgcagctgcatttggtcaactgccatatgatctacctctttaagatgtaactatcataatagctgtgtagacgagcattgttctggtttagcaaatatctttgccatatttgtccagttttgtccacag

SEQ ID NO: 597061 - DNA, 655 bp, Homo sapiens
ttgtcggggtgtgggctctcgttgtttttcttgcttagcgtccttgtgggccccgccaattttgttgtttttgaaaagtggggttttttgaggtgtttctcttttttggggcccgtgggcacggggtgccacaagagtttttgtgttcgccgctgtctccgcacactgggcccctcttctgggtgttctctcagtctctcacgtgatgttctcccacacctccccagggcgccctcgctgtgggttgtgcgcgacagagacacgctgtcggatgtgggttcgcgggaacaaaccgcgctgtgtgtgcgcccacacctttctttgggccattgtggcgcactgtgatttcccgtgcgatgctccctcccttaattttctagataatggggatacgggagaaacgaggatggcctcaaggaaagttcttccactgatttttttttcactagtagattttttttcctccacgagtttgacatatttttggttctttttcctggtgtttttgggcacaaattagggggagcccgcggggtttcaacatgcgggaaaggggctgtgcccgaggattccaacgggtttctacaccaaggttttgttacaaaactgatggggtgaatttttgtttttttgagaaaaaacagaagaaaaatta

SEQ ID NO: 597062 - DNA, 539 bp, Homo sapiens
gatctctgcgtgagagagaactggtggagggatgataatccagaaggaaacacaaaggcttgagctcactgttggcatggagatagaagggaatggcaaaaactcaaggacatgtggtgacatacagaaatgaaggaaagaggggacatttccagatgacatccaaggaatgacagaagggggaaaaggaagggaaagatgggggagagatgcagctatacttgatgtcagagacactgttctgtttacatctatacttccagatcctgtgtaaatgtgtgtaaagcagtgtccaccccattttttggctagatccatttacagtagaaaagattagggcagggcttacaaattttagtgcaaaagaatcacttggaaaactttgttaagatgcagattctgattctgtaggtttgaaacagggtgtgagattctgcatcctggatagtgctgctgctgttgttctgtgggctgtactttacataacaagaagttagggtatttcgatgcagacaagcccagtctaaagcccatggttg

SEQ ID NO: 597063 - DNA, 926 bp, Homo sapiens
  misc_feature (913)..(914): n is a, c, g, or t
gcccaggtggagtgcagtgagccgagatcgcaccattgcactccagtctgggcaacagagtgagattccgtctcaaaaaaaaaaaagaaagggaaaaaaaaatagctttatacctctttccttgtctcaaccgccatgaaatttctgaacactccaaatttcagttgaaataatccaaaacaacattttataaagtataaaataaatttactctcttatagtaatagtatacttaaaaaagcctcagggtatattattcttctaaacagctacaattccagtgcagctacatttacccaactatgttctctagttgagaacaaactaggcctatttcactgctgtgtaccctcagtgccttaacatgggtgccaaattaaattttttcgtagaatacactgaattgtaaaaaccattcgttttggttcacaatttgccaaaattctcaaaaggctctgtatttatgtaaatccttggaaatattatttaattagattcctcagtattgactggctgggtgtgactagtacataaggttctcattttataaaaaacactcacataattgactgatttttacaccaacatccctccctttctagcagttactcttttttacccacttcatttggcgttaaccccctaaaatgggcttaatattttaattgcttccatgaaacccagtttccaatttaatgcctaactcaggaacaatttggtataatatttcccccaccaatttccaaatttcccgacaaatcctgccgagaattggcgggaggcaccttaaactgtgattacacacttgtggtgggctcccagttatgtgtgccccagtgcgcagacatttgcaacatgggcaggagccacacagagagagtgttaaaacaatggaacagtaatagtacaaggnncactcaatcatg

SEQ ID NO: 597064 - DNA, 365 bp, Homo sapiens
ccatagccaagtagccacatgtcacagaacaaaaaaaactatggacaactgctcaccactgaggcaagcatgtacttttattcatcctttaatatgaagccatgacacacataatgttactttgagctttgtgtaggatagatgtaccttgccttatttaaattcaatagagtcataaaggaaaaaaatgctgaagataattttcactttaaaaaagaatttggaaaatactctttaaaaagtaagtcccagaatgactcattctacaaatatattacatactacaaggaacaataaatgtttatgaatacacatagcagggactacaggcgctcaccaccacacctggctaaaatttgtttttt

SEQ ID NO: 597065 - DNA, 133 bp, Homo sapiens
tgtgccatcttgtgcttctcacttatccccaattccactgtgtattgagtaaatgcggagtcttgccatggcctacagaccctctctgctctggtcccatctaatcatgtgcacagagcagcagggaaagaca

SEQ ID NO: 597066 - DNA, 128 bp, Homo sapiens
tcggtaccgggctgtcggatgtgcagagactagggccgggcagtggtgaggcaagttggtgcctgggagggacagctttgaccgttgaacttgtcagcactcctggtccacgcttcttgagaggtgga

SEQ ID NO: 597067 - DNA, 205 bp, Homo sapiens
cagggcttgcgtcaggtgccaacaccctcgctccttgcagtgaacaagatgcgcacagcccgagagagccctaagtgttcacggtccaccctgtaaccttcacagctgtggggtcagctccagggttgttgcctgtttagcctaagttctctgctgggagcccattgttcgtggaatttcagatagaggggtgtcaggtgcacaa

SEQ ID NO: 597068 - DNA, 129 bp, Homo sapiens
gcggccgcctactactactactactgctcgaattcaagcttctaacgatgtacggggacatgaatatatccacccacctagattttaagcagtaaataaaacatttcgcaaaagattaaagtcgaaaaa

SEQ ID NO: 597069 - DNA, 412 bp, Homo sapiens
  misc_feature (56)..(56): n is a, c, g, or t
  misc_feature (89)..(89): n is a, c, g, or t
  misc_feature (235)..(235): n is a, c, g, or t
  misc_feature (310)..(310): n is a, c, g, or t
ctcggtggcggagtgctaaagaccctagcggttcaggcgttcggcgagcggggccntgcttgttgcgctcctggctctcccggggcggncgcagatgggccagcatcccggattgtagttggtgttggtgcaaggcgggacgaagcggcggtcggggttcccgctcttgggagcgattggtcactcccccgcgggagggccgagccgaccagattttcctggggccggggacccnggggcttcggggcaagggactcaccttgtcgcacccacactcattcgggttggacttgccggcgtcaccgccgcnggactttccgcttttgggccatgaccagatataatttggttgattacaactttcctctataaattaactcttgacactccttggggatttgaagaaaaaaat

SEQ ID NO: 597070 - DNA, 287 bp, Homo sapiens
  misc_feature (10)..(10): n is a, c, g, or t
  misc_feature (84)..(86): n is a, c, g, or t
gaggactctnggagctgacagcgcgcacttcacccgcagttgttctagcgactccgaagaatagctcgctgagctggaaacccnnnagaatcaccaaacaaaaattgaagggcggcagatgagcctgcctacctgacagtgggaaccgatgtgagtgccaggtaccgaggtgccttctgtgaggcaaagattaagactgtgaaaaggctggtgaaagttaaggtactcctgacacaggatattaccacacacttggtacacgatgaccacgtaaagggtcctctaag

SEQ ID NO: 597071 - DNA, 107 bp, Homo sapiens
gggcccccaaagcatttggtgcccctccatgttgcaatgcaaaccccttcccccctggggcagtggggaaaaatggctatattaataaaaaaacgtgtgtctttcca

SEQ ID NO: 597072 - DNA, 85 bp, Homo sapiens
taagggatgggggtctccctctcttgtcatccatgctgggaaaatgggtggctatgatcatagctcaccgtagccttgaactccg

SEQ ID NO: 597073 - DNA, 140 bp, Homo sapiens
gtgctctaggctgtcatcgctgcacttacatcttctgcgtcagcttccgcttggcaggttgcttcaatgctttcgtgcctttgccctcacctaccggctctttgtcggtgtgcgtgctctcccctgaagattgttgctgg

SEQ ID NO: 597074 - DNA, 229 bp, Homo sapiens
  misc_feature (9)..(10): n is a, c, g, or t
  misc_feature (41)..(41): n is a, c, g, or t
  misc_feature (46)..(46): n is a, c, g, or t
  misc_feature (48)..(48): n is a, c, g, or t
  misc_feature (53)..(53): n is a, c, g, or t
  misc_feature (57)..(57): n is a, c, g, or t
  misc_feature (82)..(82): n is a, c, g, or t
  misc_feature (105)..(105): n is a, c, g, or t
  misc_feature (107)..(107): n is a, c, g, or t
  misc_feature (128)..(128): n is a, c, g, or t
  misc_feature (134)..(134): n is a, c, g, or t
  misc_feature (148)..(148): n is a, c, g, or t
  misc_feature (157)..(157): n is a, c, g, or t
  misc_feature (159)..(159): n is a, c, g, or t
  misc_feature (183)..(183): n is a, c, g, or t
  misc_feature (187)..(187): n is a, c, g, or t
  misc_feature (193)..(193): n is a, c, g, or t
ctcgtgccnntaaactacatgagaggttacagagccctttnaaacntngacangatnttaatggcccatttcccctgaaaangtatgtatggactcatgtattantnttttagtatgcagtttcctangaattnctagatttcttaantttcataangntcggctctagattgggaatctctnaacntactgncttttaaaataaagagccacatcttgtcactaaagg

SEQ ID NO: 597075 - DNA, 763 bp, Homo sapiens
  misc_feature (570)..(570): n is a, c, g, or t
tcagggtggcaagggtagaagaaagatgcgccagaacgttctcgaaggggtcaacttctccaggcagagccacaacgctccctttcccggcggcaactggcctggccttctaaccggactcgtggtaaccccgggcactttggggcctggttccaacctctcagagggcagggggcagagaggcttggcagggcggtctggtgggcttatggagaggccctaatggggaaacgggtagcaacagggcccttaacggggccttccggtggtgggcgggcaggcatcgcggacactggcggagagcctatctcagaggcagtggaacaggcaggcagggaaccaagcaaggttcccagagggcgggagatccacacctcaataccttacttcagagggagaggcacaacctagaaaactaggctgggcaactggtgggttggggccaattgggggcttgggcagacaaggcgcggggccgctgggggggccgcgggaggccttctttccccctgtggcaaggtgggttatcttgtacggaaagtacacaagcttaaagagggcgttccaagnagagcagattattttcccaaacccaggtggattatgaaacaatttgggaaggaaggtggaaagggtactatggggagagggttacacaaaaaccaaggcaggacattcaggggcagaaactctcttatggctgggttcagccaaaagaaagtgggcgaacttaaagtcttctgggggaatccggttctcgggt

SEQ ID NO: 597076 - DNA, 502 bp, Homo sapiens
  misc_feature (26)..(26): n is a, c, g, or t
  misc_feature (38)..(39): n is a, c, g, or t
  misc_feature (52)..(52): n is a, c, g, or t
tcgacccgcccttccccccatgactnctattcgaatgnnctcgcgccattgngttgatacccgctaattcggccattatggccggggggcttctaagcggggacgcttttcaagatggtttacatttcgaacggtcaagtgtaggacagtcggagtcagtctccatggacataatctatgataacagatttgttttggggaatagctgggtttgaggttttgtttttcaaaactctgctttaacaagatgtgtgagaataagctttggaaacttatctgattccagatatgacgatggaatagggccaccaggaaacctttccctaacaatgggtggaatcaatcatctgcctgtccctagtctccatccaatgtctggtggatgaggattgtaaatgtctgctctaagaagcatacgaccgtacatgcgcattaatagcagaaggaaaccatcacgaagtggtacgctgaccatgatgagcagtagatgtgtgttgtctcc

SEQ ID NO: 597077 - DNA, 156 bp, Homo sapiens
ccatggtgtcaagtcaggaatcgctcctccgggagcaagaggaagtctctcaaaactagaagggaaaggtgttttctccacatcaatccagctgtggagacattctattagtgacatatgcctcttctccctttccatctttcagcatagacttaa

SEQ ID NO: 597078 - DNA, 150 bp, Homo sapiens
  misc_feature (133)..(133): n is a, c, g, or t
tgaaaggatatctttaaatactgagtctccctacctgtgaacagacatagcttcactttgttgcctaggctagtatcagattcctggcttcaagtgattctcccaccttggcctcccaacagtgctgggatgngggatcctctacgagtc

SEQ ID NO: 597079 - DNA, 570 bp, Homo sapiens
ggagacgggggtctcaccaatcttggccagtgggtctgggtgatccacccggcctcggcctcccaaaatgctgggcattacagggcgtgacgccaccgggcccgggcctcggttaagattttaaagagcagaatcaagaaatggaaggattggctggtaattcctaccggcatgggacttgaccggggtgtggggtgagtagcaatcgtgtacggtttctctatgtggacgatgaggaaggggttgagaaatccagcgaagggacacttctgtaaatagctcaatctgctgcccagggtggggaaaaggggagtatgcgggggtggtggtggggcaatcagggggctatagggaacaggtgtcctgattctgagcagaactactctgctctcagtaaagcggtcatgatagaacacggcccctgggtatatgcccttgtggtccatcccttttttagttcttagcaaagccgtcttcctatttctcttgggaatgtccacagcagcattattaataatagaccaagggggggaacaaccgaaatgtgcatcagcagatgaatggataacc

SEQ ID NO: 597080 - DNA, 794 bp, Homo sapiens
agagggggagagagtgagagacaccgagtagagagaatatgtttgtgtgtgtgtgtgtgtgtgtgtttgtgtgtgtgtgaatcttccctgccagggaatggcatcttgtgcacgattggttctggccttgaatggtgagcttctaggataagctctggccactcaccactctgaactgtaataattgggtaaataattagcttgtttttagtaatcggtcgtaaatgtatgtatagcttacatttatttccatggtaaatattgaatgtgctttgagtccttatttcgaagtttaatgatgtttttgtcaccagaaacatgccacaggaacttaactcttgtttatatcagactgtggttttggtttcattatatgttattcccaagaacctatggatgaagttaatgaagggttggtgtttctgcagatgctgctggttgagggttatcctttgagaaccactggttctaggccttggttaacaccactctcagccttcagcatcaggctttcaggattcttcagaatgaatgacagtaataaacataatgaagcataacaagctcatctaattcaccctgtaaaagaaggataaaggaaactccaggtcaggtgtgggtgctcactcctgtaatcccagcactttggtaagatgaggtggatggttcacttgaggtcaggagttctagaccagcctgctcaacatggtgaaaccccatatctactaaaaatacaaaaaattagccaggcgtgttggtgcgcgcctgtatccccgttactcaggaggctgagg

SEQ ID NO: 597081 - DNA, 213 bp, Homo sapiens
ccgatgcttttctggccaacgactcgagccaggaggtcatctgggtttcactctcactggggactacaggcccccgcgaccatgcctggctaattttttggtattttaaagtaagagacggggcttcatcatggtgggccaggctgatcttacagtttccggttggataaaatgctttgggtttggtgggtttggtgtctgtgagttcacgat

SEQ ID NO: 597082 - DNA, 276 bp, Homo sapiens
cagactcaaatgtgtggtgttggggcaggaactgagcctgcagtctagatccccacctcatccatcacgtcaaaagaaattacgggcgggtcacagatgaaaacacctaacagcaggtaactgttttgtaatcttggggagaagcctaaagcccaggaactaagagagtataacaagtgtgaatacagaatttaaaagaagagactggtttagcaatcactaaggtaaaacacgcgtgacaggatctgcttgtttcctcttagcacgcaggagcct

SEQ ID NO: 597083 - DNA, 461 bp, Homo sapiens
tgccacctccaccatctccccaacagcatcgccagcaacgtgatccgggcagacccaggtctgggactttgtccagagcaactggaagaagctctttgcggatttcaggtggtcggctccttctcctttgccaatctcattgcgggcagtgacaccgccgggttcacactggagtatgactgctgcagctggagccattcaagacttgacaactactggagacagggcttcgcgctcgacgccctgtccgggactggaggcaggatccctggagcaacgacagagccaacattcgagtcgggtggcagattagaacagaggagtgccgttgctcttggatggtttacgcggcaaaacagcccgagtagttcagaggagaaaaaaaggccaatctatgagggtgcaaattgttaagaaaaacaacatgaatatcaagacccacggaccaaaaaatatataaa

SEQ ID NO: 597084 - DNA, 1187 bp, Homo sapiens
gaagttctggaacgcagtgcgccgatttgagattggacccacgatcaagatagaacatgacaggtgggcatgaggacattaacagacacatggccaagaaggatctaggcgaggacgctagccaaggacgaaggctggagctagatccgaagcatggatcatccagggggctctttggacaattacctgctcgtggtctgcagggtagctgcaaggctggctgtgttgctcaaaggtcacgcacgaggagttcgccatggctgaccgttcgcaccgtcagcatgcagtatcccctggcaccatgacaggcggccggaacgcagtcaagctctcggcgctatgtagactctagtaacactgatagtatgctggtggccgcagtgtcccaggagagaacgttactcgcgcaggaggcgacatgtcccgaattcactcaaaggacacgaaggtagtgcgtctagatgggccttgcatccggggtgcggagatcctccggatgcgacactgcgttgaacttctgcggtcttccttccggtgatctcctggggagttcccactcggtggtcgcttgaccctaaggctgtgttcttggccttggcaggaggctcgggaaatgttggagcatcccttggagccccatgttggttgcggtctgacagtaggatgccgccgtactggatcacgctggctttgctagacattccaggcaggtgagggcagaggccacttggttgctaggacgccaaccagggacactgcaaaggcgacagtgaaacctgtggacccctggggccgtgcatgtggagacgctggtttagattgcacttctattcgtgagccctaaggtgcggaccgttcggagacttgcacgtagataacgacgcgaatagtagcgaagacgaaacgatgccaaggtttccggcatttcccaacggctggcattggggccccgtgcatgacgcgcgtgaggggatactggacggacccaatacatcttggcgcgacccttgttagccctttcccttcttgcgagagccttctctctgaatgacattgccaacaagagtcgggggaagaccgagaacctcagggaaccagtgttgctggcgggctctgtcctcctgaagctactggaatggcccgtggcgcgttattggaggaccaaaggggcctggccaagctgtaca

SEQ ID NO: 597085 - DNA, 273 bp, Homo sapiens
cgacgcaacagttgctgtcttgcagcacactattagatcctcgtcccgttcaggcactacgcggagtggctcgccgaggttctctgtgatcttgtccaatgcggatgccggccatggtccgcactgccagggctcgagatgagtgggtgttgggctcctcacatgtccttcagcaaaggtgttgacggccataatggccatgtcaggctgactcttggcgtaaattcatcaagtagaggtatactagcttcttcagctccaggttgtccgtct

SEQ ID NO: 597086 - DNA, 5813 bp, Homo sapiens
  misc_feature (5811)..(5811): n is a, c, g, or t
gggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacagcaagtgtctccctctcagtctcccagccctgtgagacagattcctcaagcccccaggtttcttggaaaaggggcattgaagagtagcttcccctgcccacaactaggagagaaagggcagctccctcttcctaatccctttacctgactctgtcagagtgattccagcagcacccttgtaagtactgttttgtgtgcgttcccaggggccaggcctcttccacacactgtcccagggccacctcacagccatcctgcactgtctagttttccagatgaagaagctgaggagggctgggagcagtggctcacgcctgtaatcccagcactttgagaggctgaggcgggaggatcgcttgagccaaggagttcaagaccagcctgggcaacatagggagaccccatctctacagaaactaccaaaattagccaggtgtggtggcacacaccagtaatcctggctactcacaaggccgaggtagaagaatcgcttgagactaggagtttgaggctgcagtgaactaagaagatgccattgcactccagcctgggcaacagagtgaaaaaattaaaaaattagaaaagaaaagaagttgaggaggcccaaggagggcaagcagccaggatcactggctcaaggccaagccaggattcaccctaagttggtgtcatcccaggagcaatattaacagctgagctccagagggaaccaggccatcagaggctcaggcctggctctcaggggcagagtcagggctggaggtagagacctgagtgtcatctgaggattgccaattggcagtagttgaagccatggtacaggtgggatcacctggggcacatggagtgagctgggggacggggactaagttctagaggtgccagcattcctggccaggtacagggggatgagccagtgcggtggagagagccaagggccagaccctcgtgaccagccctatggcctcactctacctctgtcctgttgtcctccttccctaaaagagggccagaaggcctgctgagggctgttgggagtgagagagcaagtcctctgtggagaacacccagtctggggcgaggggagcgctccattgctgtggctcctgccctggagatggccccgggaaccccagcctgccacgctgccttccgctcctcctggtctttccctgatttccctgcgctcacaaaaacctggtgagggtcatcaggagatgggcattctcatccacgagacctcatggctttcacagccttcatgcaggcccctgtgcaacacccctgcccatgcgcgggaggctgcagcatggcagaggcggcatggcagaggcggtgtggctcggaggaacctctggtaacaatgccactcccgttccctggtcagaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggtaaggctgggccctgggcacaagtgccagaatctggcgatgcagctgcacatccataggtgaactgtagccttcatgggcacgcctctgctggaaacgtccagcacgactcagcgtggcaggctgtagctttcttgctcatcagtcctgtttgcttttattacattttaatcatttacattggaagtgattcttgtggaaaatgagaggtgagctcattcttctgaaatggtccccctatcctggaagtcagtggggagaggtttttgattagacccctggagctatccgggtactctaaaggcaaagcgcacccccacttggggaccaaacaaagacccctccgcattgcagcctgcagttgccgcttctcaggtgacgtgaggaggctgcaactcagcactaagtagtgaaaatgaaaagcgccgctgtctgaaattcattagcagccagagtatgtgttacaaggcagcggaggctgggagtctgaagtggtgtgatgaattgaacctcatcggatgctgctgtggctgggccaagtgatagcacctaatcaattcctcacacgtcaagtgacacctcagacatgggatagatttccccatcacatcacagggcaggtgctccctccctgctggagagcacaggcactgcagaagcagcgcacagtgccaggggcgagtgaggcagcagctcccagccttttcaggcacggagattgcctttcaacatccaaacatttcccagaacccatgtgccatcctacttgtattactggtggccagaaagccacaagcgcaatcatgcttttcaatgaccctatttttattcacgagaacagcacatacatgtgtttgaaaattatgtgaggtgctcactctgcagacagtactcacattcctatagattccacccctgcccaccttgcagcccctggagtctatagcagatgggagtggggcactccgagagtggcaggcctggagatcacatcttccattgttccttcaatcaacactaactcccatttgggccttaggtgccttgctaagcaccacaaaacagcaactaactgaaagagatctggagtgccagcccgctcctactgagggcctcctctctgtcaggcaccttgcaaagcattttgtgtgaagtgactcatttaacctcaccacaacgccacaacgcagggattatgcaggtaacctatttcccagatgaggaagataaggcccaaggaggtgaaatgcctttcccagagttacacagagtgctggagctgggaatactgacccaggcagtctagctcttaacagctcactccactgtttccctggaggtgatgcacagatgtcactgggaaacccaaaggagagggggttggctgtgtgtgtgtgtgttgggcaggcaggtaaggggagtaagaccaggacaagtgttcctggcaaagttccggtgacagcattaaacattcagatggtgagggagttaatatggttggagaacaacaactttagagagagcagaggggtcagttcacaaccatctgctcaggagggtcaagatgggtggtctttatgctgaaggtctgtgattagaggagctggttgctaaattttgaggagtaccttttgctctgtgctggacatctaaatatgcatgttaactgtgttctttaacatttccaggagactataaacatgtttgaaaggaacattgttgacatggtaggactgtttatcgaaaatgtccaaagcctatatcctttctgtgatgaccttccccatggggaggtgctacagagcccctgggcttgtcccggcctctggacaaaagaatgttccacagggtctgaggaggtttcccgaccctcagaacaatgatggcctggttagagctgtggtttggatgcccagagggacaacatccaaactgtttgcagtaggctcccagcatgattgttctcatatgagtgatgttcactaggaaatgacgccccctgtgttgcaggcaagcacactctggggttgaggcaacccccacgtggaagacactataaggagtacatcaggtgaaatgttagggtgaggagccaacatcggagcatggccaacccttcttccacccgaactcagggcactccacatggggcaaactgctgtgctccagctagcagcagccctgtggtcctgccctcctggggctcacagtccctcagggagacaagttgtagaggcaacaagtggtgccaaatgcacagggtgagaagcagttaacccagaggccaggagcctccatgcaggagggagagaagagtgtgatggcaggggccgagggtccgtccgaggtgtggggcaggggcagggagtcgaggaaggcccagggttcggagcttgtgagtggacggtgctgccagccagaatttccgagctcgccttgggcccttaaagtctgtctcccgccgtctgagagcatcagggacgcgccgggcctgctcctcccgggcctttgcttaactcggggctgcacgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacaaaaanaa

SEQ ID NO: 597087 - DNA, 1008 bp, Homo sapiens
  misc_feature (532)..(532): n is a, c, g, or t
  misc_feature (568)..(568): n is a, c, g, or t
  misc_feature (1006)..(1006): n is a, c, g, or t
aattgattccctagaaaatcccacgtgctggagcacttcacggtgaaggtttggttttagaatggcgccctccactgaaccgccttgggaggaaatgcacagacttggggtggggatacccacgtcctgtgtagagggggagactgcgcgcacccgggggggccccttgggctttccctttccgcgggggcccctctttgggctttatacactttcgggggggtcttgtcacccgcagttggggcttcacaggttgcccccgcgggagcacctcgggagagaatttttcactctcactctcactcgagtgagaaggctctcctcgggagagattgtctctctatattcacggcacacccctgggagagaagagattttgtttcgagggggggcgagaccccgggagacgagggggagacctgggcgctataacgagactcttggcgcgcggcgcctctttttggttcgagttataaagattaatccgagtttggttaaaaatggctcgtttcggggcatcttcggccacacngagacacttccacaccctctcctcgagaagagtttngagacacactttcgagagagaagagttgagagctcggtggagaccacggagagtgcacaactctctcttggtgggtaacaccgtgttaaatagaccacggagattcaccacaaggaatgaggagtcactgaggggacccgcacagcgccgtgaaaggaggagtccaatcacggaacactcgagccacacaatgcacgaggcgagacctggagcacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacaaaaanaa

SEQ ID NO: 597088 - DNA, 286 bp, Homo sapiens
gtgcctccggagcggatgaggagtgggcacagctcgcagtggtccttcagcaccatcagcagcagcacccagcgctctacaacaccatgctgcagctggaccaacaccctttgatccagaagaaccgccagagtggtgctggcctccattcctgctcctgctgctggggctgggtgctgatccatggtctggcgtgggacatggaggcgaccccactctcctaggtgtctccatgcgccatcattcattcgtgccgaggcttccatgtagttggtgcctaggagtc

SEQ ID NO: 597089 - DNA, 785 bp, Homo sapiens
  misc_feature (26)..(26): n is a, c, g, or t
  misc_feature (224)..(224): n is a, c, g, or t
  misc_feature (243)..(243): n is a, c, g, or t
  misc_feature (733)..(733): n is a, c, g, or t
taatcggggccccctccccctcctcnaaaagtctaggggcggtcttttaaaatttaaccttccttactaattggcccataataaacttaccccaccattgcaattaagcgcatactatcttccggcctctatccctcttccttgaatacttcaataacgacttgaccagctaattcttctctacaagcgggattccaacaagttgttcctggaggggggggcanaaaaccccccaaccgcccnattcaaaaggaacgccacccttcttcttgtggggacggtgttttcacccatattcccacattctaccctttaaagccccctatagcccctagctaccttataccgtattccttgggtgcccaacttacacagcattttcgcagtaccaaccctctgccataaacaaatacaacctagttctcggacataatggtataccgcccactacggctatttactattgaggcaaattacctaaatccccaaccccctatctggaattatgcgggaacaacaatcctgctcttgtgattgaattctagtggccgccccactctggaaacccctgccttctgcgcattgggagaagtaccaaaacaccaccccactatacttggttttttcccttatgaatttcctctctcattttacaaatatgggggccgcgccttacgcctcctttacacattgtcccctttacctgcgttttttttctcgtacgacgggtgtncaccttatttaatattttaactgcttctcagtgttatcccagccctctatag

SEQ ID NO: 597090 - DNA, 465 bp, Homo sapiens
  misc_feature (19)..(19): n is a, c, g, or t
  misc_feature (362)..(362): n is a, c, g, or t
  misc_feature (462)..(462): n is a, c, g, or t
ttttttttttttgaaggangaatgcggtgttttttagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggagtatgtatccaaggttcaggggtggtggccagggtgggccctccctggctttctctgctccatcttcaagccccaggattccatgcaaagtccacggtcgaggttcccacatcagcattagggcctacctgggttacaaggcataggngcagcacagatgtttgtaaaagcgtcatactttaagtgtcttcatcattttgaatatccacgacgctccggattcctgataagtgttgggcgaatgtccngta

SEQ ID NO: 597091 - DNA, 1359 bp, Homo sapiens
cccaaagtgtcccgttgctcagagagaaggatcgggtagcgtcaagaagaaggcaagcttccgtcagagcgtcaggagcgggctgcttgagagcgtaaatcccagcaatttttctatgattatgtttcagatatagactaataagacttatgaacagcgaactaagaaagaaacaaagaaaaagaacaacaaaaaaagagggtcggagcggcgcacccaagaagaattaccacccactcagcggggggccacacaagcatagccacaggtcactcccggagaaaatgtctaggggataagggaggggggcgccctagtatgggcggaggcgtggacacaatgaatcgaagacagagagggcgacagaggggcgcgagcgagaaaaattatagaaaaacaagaaagagagtgccacgacgtgcgagcagacggcacgggggggaatagaacactggggggagcccatcttcgtgggcgataaatgaggtgaatacccgatgtaaaatcgcaggagggaagggggcgggagtgagagcacagtaattcgggagggagagagaaacgacctgttcacccacttaacaacagagagacgatatttctaaggaagagcccgtcaagatgggagggaccaagaatgagtcatagataaattacttactatataacagcgttgcctaattaacagggggcgggtgagtaaatcgctacaaaatgtgggtgcgagaatattcgacgtcgcaagagccacagccgaccaccgccgaaagcaaagaactgcgaggagaagccaccaagacagaaggcaaccaaatgacagcgccacagtaacggaacactgggatcttcaaaggacagagcacgaggggagaccaaaacgccggcaaaacaaaaagcggggaaagaccacaaacacagaacgcagagaaaagacaaatggcaaacgcacgaagacgaaccaaaaagggccacgcaacgaagaaagaccaacgcattagtaagaagtacaacaataaacgcaagcaccaccgacccgtgaaaatatgcgccaaggacacagagtgcaagatcacagaatcaaaggggaacccaagagccattggaagacactaggcaacgctccaagggatgagaaccatggaaagacgaaaactcccgcgaggaagaataactaagaaccaatacagggaacaacacaactaccaagaagaaccagggaaaacaagcgccccatacaacaagcacaacagaacaggagggggatgacataaacacaacacaaccaaggcaacgaaaaacgacccccgagaatacgcaaaggacgaacacccacaaaacaacacagcggcagcgcaaaca

SEQ ID NO: 597092 - DNA, 4426 bp, Homo sapiens
  misc_feature (4424)..(4424): n is a, c, g, or t
gggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggtaaggctgggccctgggcacaagtgccagaatctggcgatgcagctgcacatccataggtgaactgtagccttcatgggcacgcctctgctggaaacgtccagcacgactcagcgtggcaggctgtagctttcttgctcatcagtcctgtttgcttttattacattttaatcatttacattggaagtgattcttgtggaaaatgagaggtgagctcattcttctgaaatggtccccctatcctggaagtcagtggggagaggtttttgattagacccctggagctatccgggtactctaaaggcaaagcgcacccccacttggggaccaaacaaagacccctccgcattgcagcctgcagttgccgcttctcaggtgacgtgaggaggctgcaactcagcactaagtagtgaaaatgaaaagcgccgctgtctgaaattcattagcagccagagtatgtgttacaaggcagcggaggctgggagtctgaagtggtgtgatgaattgaacctcatcggatgctgctgtggctgggccaagtgatagcacctaatcaattcctcacacgtcaagtgacacctcagacatgggatagatttccccatcacatcacagggcaggtgctccctccctgctggagagcacaggcactgcagaagcagcgcacagtgccaggggcgagtgaggcagcagctcccagccttttcaggcacggagattgcctttcaacatccaaacatttcccagaacccatgtgccatcctacttgtattactggtggccagaaagccacaagcgcaatcatgcttttcaatgaccctatttttattcacgagaacagcacatacatgtgtttgaaaattatgtgaggtgctcactctgcagacagtactcacattcctatagattccacccctgcccaccttgcagcccctggagtctatagcagatgggagtggggcactccgagagtggcaggcctggagatcacatcttccattgttccttcaatcaacactaactcccatttgggccttaggtgccttgctaagcaccacaaaacagcaactaactgaaagagatctggagtgccagcccgctcctactgagggcctcctctctgtcaggcaccttgcaaagcattttgtgtgaagtgactcatttaacctcaccacaacgccacaacgcagggattatgcaggtaacctatttcccagatgaggaagataaggcccaaggaggtgaaatgcctttcccagagttacacagagtgctggagctgggaatactgacccaggcagtctagctcttaacagctcactccactgtttccctggaggtgatgcacagatgtcactgggaaacccaaaggagagggggttggctgtgtgtgtgtgtgttgggcaggcaggtaaggggagtaagaccaggacaagtgttcctggcaaagttccggtgacagcattaaacattcagatggtgagggagttaatatggttggagaacaacaactttagagagagcagaggggtcagttcacaaccatctgctcaggagggtcaagatgggtggtctttatgctgaaggtctgtgattagaggagctggttgctaaattttgaggagtaccttttgctctgtgctggacatctaaatatgcatgttaactgtgttctttaacatttccaggagactataaacatgtttgaaaggaacattgttgacatggtaggactgtttatcgaaaatgtccaaagcctatatcctttctgtgatgaccttccccatggggaggtgctacagagcccctgggcttgtcccggcctctggacaaaagaatgttccacagggtctgaggaggtttcccgaccctcagaacaatgatggcctggttagagctgtggtttggatgcccagagggacaacatccaaactgtttgcagtaggctcccagcatgattgttctcatatgagtgatgttcactaggaaatgacgccccctgtgttgcaggcaagcacactctggggttgaggcaacccccacgtggaagacactataaggagtacatcaggtgaaatgttagggtgaggagccaacatcggagcatggccaacccttcttccacccgaactcagggcactccacatggggcaaactgctgtgctccagctagcagcagccctgtggtcctgccctcctggggctcacagtccctcagggagacaagttgtagaggcaacaagtggtgccaaatgcacagggtgagaagcagttaacccagaggccaggagcctccatgcaggagggagagaagagtgtgatggcaggggccgagggtccgtccgaggtgtggggcaggggcagggagtcgaggaaggcccagggttcggagcttgtgagtggacggtgctgccagccagaatttccgagctcgccttgggcccttaaagtctgtctcccgccgtctgagagcatcagggacgcgccgggcctgctcctcccgggcctttgcttaactcggggctgcacgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacaaaaanaa

SEQ ID NO: 597093 - DNA, 116 bp, Homo sapiens
catgagtctgatttttaagctctgtgtctcatggtgattacctgagttaccatattatgaagttgtctgcagttcttctgataatactttcagctgttacgtttagcgtgcttttc

SEQ ID NO: 597094 - DNA, 4523 bp, Homo sapiens
gggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggtaaggctgggccctgggcacaagtgccagaatctggcgatgcagctgcacatccataggtgaactgtagccttcatgggcacgcctctgctggaaacgtccagcacgactcagcgtggcaggctgtagctttcttgctcatcagtcctgtttgcttttattacattttaatcatttacattggaagtgattcttgtggaaaatgagaggtgagctcattcttctgaaatggtccccctatcctggaagtcagtggggagaggtttttgattagacccctggagctatccgggtactctaaaggcaaagcgcacccccacttggggaccaaacaaagacccctccgcattgcagcctgcagttgccgcttctcaggtgacgtgaggaggctgcaactcagcactaagtagtgaaaatgaaaagcgccgctgtctgaaattcattagcagccagagtatgtgttacaaggcagcggaggctgggagtctgaagtggtgtgatgaattgaacctcatcggatgctgctgtggctgggccaagtgatagcacctaatcaattcctcacacgtcaagtgacacctcagacatgggatagatttccccatcacatcacagggcaggtgctccctccctgctggagagcacaggcactgcagaagcagcgcacagtgccaggggcgagtgaggcagcagctcccagccttttcaggcacggagattgcctttcaacatccaaacatttcccagaacccatgtgccatcctacttgtattactggtggccagaaagccacaagcgcaatcatgcttttcaatgaccctatttttattcacgagaacagcacatacatgtgtttgaaaattatgtgaggtgctcactctgcagacagtactcacattcctatagattccacccctgcccaccttgcagcccctggagtctatagcagatgggagtggggcactccgagagtggcaggcctggagatcacatcttccattgttccttcaatcaacactaactcccatttgggccttaggtgccttgctaagcaccacaaaacagcaactaactgaaagagatctggagtgccagcccgctcctactgagggcctcctctctgtcaggcaccttgcaaagcattttgtgtgaagtgactcatttaacctcaccacaacgccacaacgcagggattatgcaggtaacctatttcccagatgaggaagataaggcccaaggaggtgaaatgcctttcccagagttacacagagtgctggagctgggaatactgacccaggcagtctagctcttaacagctcactccactgtttccctggaggtgatgcacagatgtcactgggaaacccaaaggagagggggttggctgtgtgtgtgtgtgttgggcaggcaggtaaggggagtaagaccaggacaagtgttcctggcaaagttccggtgacagcattaaacattcagatggtgagggagttaatatggttggagaacaacaactttagagagagcagaggggtcagttcacaaccatctgctcaggagggtcaagatgggtggtctttatgctgaaggtctgtgattagaggagctggttgctaaattttgaggagtaccttttgctctgtgctggacatctaaatatgcatgttaactgtgttctttaacatttccaggagactataaacatgtttgaaaggaacattgttgacatggtaggactgtttatcgaaaatgtccaaagcctatatcctttctgtgatgaccttccccatggggaggtgctacagagcccctgggcttgtcccggcctctggacaaaagaatgttccacagggtctgaggaggtttcccgaccctcagaacaatgatggcctggttagagctgtggtttggatgcccagagggacaacatccaaactgtttgcagtaggctcccagcatgattgttctcatatgagtgatgttcactaggaaatgacgccccctgtgttgcaggcaagcacactctggggttgaggcaacccccacgtggaagacactataaggagtacatcaggtgaaatgttagggtgaggagccaacatcggagcatggccaacccttcttccacccgaactcagggcactccacatggggcaaactgctgtgctccagctagcagcagccctgtggtcctgccctcctggggctcacagtccctcagggagacaagttgtagaggcaacaagtggtgccaaatgcacagggtgagaagcagttaacccagaggccaggagcctccatgcaggagggagagaagagtgtgatggcaggggccgagggtccgtccgaggtgtggggcaggggcagggagtcgaggaaggcccagggttcggagcttgtgagtggacggtgctgccagccagaatttccgagctcgccttgggcccttaaagtctgtctcccgccgtctgagagcatcagggacgcgccgggcctgctcctcccgggcctttgcttaactcggggctgcacgatggctcagtgccgggacctggagaatcaccaccacgagaagctcctggagatctctatcagcaccctggagaagattgtcgagggcgacctggacgaggacctgcctaacgacctgcgcgcgggtcgtttccaaaagttcaattatgtggaggcttctggcactttctaagagaagcagttacaggtagaggttgaagtctgagatttcccctggaggtcttcttaaccttagagtctgtataatgagtactgtgggggtgttggaaccaccatttctgatcctgcacaatgccatccggtttgcaccagcacatccactgatgaatggtcacaaaatcagcagggtcggcctgaggaacctggctccatccctggggtctgcacgctaagaaggctctcccggatgtctgcgctgggtcccgcagcagcatgtctatgtctctggaaggagtgtgggcatcaagggcccagacagagatactatgttgtcagggcccagacagagatactatgttgtcagggcctgctttagtgcatgcatcattcactccactgccagtttctcagcttctctctgtcgcgacatcaccaccaaggcaagccaccatcgtccttggcctggactgttgcctctttactgcctcttacagtccgtctca

SEQ ID NO: 597095 - DNA, 1031 bp, Homo sapiens
  misc_feature (10)..(10): n is a, c, g, or t
  misc_feature (54)..(54): n is a, c, g, or t
  misc_feature (69)..(69): n is a, c, g, or t
  misc_feature (131)..(131): n is a, c, g, or t
  misc_feature (984)..(984): n is a, c, g, or t
  misc_feature (1002)..(1002): n is a, c, g, or t
  misc_feature (1009)..(1010): n is a, c, g, or t
atggacagtnggctcatgattcacataagagtcaacagctccggaagcctcttnggttcactcgcattnctcctctgctgactcccgaagtgacaaacgtcttcctgcttccatggctttggctttacttnggaggcccttttcagtccaaatcaagcaaaaatgtactgagtgcctactgtgtgctaagattgggatattcagcagcccctactctaagaggtcccctggccattgtgtaggctagcatagggagtggggacacagtcttagggtcctgactactcatgctcacacccaactctgccactccccactttgccctctaggcctctgtctccttttttttgacttgaggatgatagtggtattaatatccagctcacagaattgtgatgagcagtacatgaaatgcatggaaagcagttaacacagcattcccttccccctccaacttctcctggctgcaaattaatcacctcatctgcatcctgggcctcttttgaatgcacatgctgttagagcgcttctcacattgtattaaagttagtcatttatgattccatttttcccactgactgtaggttctcaagagtagggtgtaccatatttcttttacaaccccagcaccaagcaaagcacctgctacttcgtcggtattcattgttccggctatgaaagcttagactaggaaaggatcttggaacagtctggtccactggttcctgaatgctcgaccgtggacctgcaggagcagaatcacccagaagtgtgttgagaaacagattccgtaggcacatccacagagacagaaagtggatccttgggccttggagttggggtgggatggatgggaagtgactgctgatgaggatgaggtttatttaggggttaaggaaaatgttctaaagttagattgtagtgatattgcacaactctgtaaataccaaaaccatcgcattatatgttttaaacaagtgaaantaatggtatgttaattgnatcccannaaacctgttaggaaaaaaaac

SEQ ID NO: 597096 - DNA, 4515 bp, Homo sapiens
  misc_feature (4513)..(4513): n is a, c, g, or t
gggcgcttggttccccagcaaccgggagacgcgtctgctgcgtggaaccgccgagttcccagcgcttgagaagggtcttcctatgttgcccgggctggtcttgaactcctgaactcaagcagtccttccacctcggcctcccaaagagctgggattacaggtgaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggtaaggctgggccctgggcacaagtgccagaatctggcgatgcagctgcacatccataggtgaactgtagccttcatgggcacgcctctgctggaaacgtccagcacgactcagcgtggcaggctgtagctttcttgctcatcagtcctgtttgcttttattacattttaatcatttacattggaagtgattcttgtggaaaatgagaggtgagctcattcttctgaaatggtccccctatcctggaagtcagtggggagaggtttttgattagacccctggagctatccgggtactctaaaggcaaagcgcacccccacttggggaccaaacaaagacccctccgcattgcagcctgcagttgccgcttctcaggtgacgtgaggaggctgcaactcagcactaagtagtgaaaatgaaaagcgccgctgtctgaaattcattagcagccagagtatgtgttacaaggcagcggaggctgggagtctgaagtggtgtgatgaattgaacctcatcggatgctgctgtggctgggccaagtgatagcacctaatcaattcctcacacgtcaagtgacacctcagacatgggatagatttccccatcacatcacagggcaggtgctccctccctgctggagagcacaggcactgcagaagcagcgcacagtgccaggggcgagtgaggcagcagctcccagccttttcaggcacggagattgcctttcaacatccaaacatttcccagaacccatgtgccatcctacttgtattactggtggccagaaagccacaagcgcaatcatgcttttcaatgaccctatttttattcacgagaacagcacatacatgtgtttgaaaattatgtgaggtgctcactctgcagacagtactcacattcctatagattccacccctgcccaccttgcagcccctggagtctatagcagatgggagtggggcactccgagagtggcaggcctggagatcacatcttccattgttccttcaatcaacactaactcccatttgggccttaggtgccttgctaagcaccacaaaacagcaactaactgaaagagatctggagtgccagcccgctcctactgagggcctcctctctgtcaggcaccttgcaaagcattttgtgtgaagtgactcatttaacctcaccacaacgccacaacgcagggattatgcaggtaacctatttcccagatgaggaagataaggcccaaggaggtgaaatgcctttcccagagttacacagagtgctggagctgggaatactgacccaggcagtctagctcttaacagctcactccactgtttccctggaggtgatgcacagatgtcactgggaaacccaaaggagagggggttggctgtgtgtgtgtgtgttgggcaggcaggtaaggggagtaagaccaggacaagtgttcctggcaaagttccggtgacagcattaaacattcagatggtgagggagttaatatggttggagaacaacaactttagagagagcagaggggtcagttcacaaccatctgctcaggagggtcaagatgggtggtctttatgctgaaggtctgtgattagaggagctggttgctaaattttgaggagtaccttttgctctgtgctggacatctaaatatgcatgttaactgtgttctttaacatttccaggagactataaacatgtttgaaaggaacattgttgacatggtaggactgtttatcgaaaatgtccaaagcctatatcctttctgtgatgaccttccccatggggaggtgctacagagcccctgggcttgtcccggcctctggacaaaagaatgttccacagggtctgaggaggtttcccgaccctcagaacaatgatggcctggttagagctgtggtttggatgcccagagggacaacatccaaactgtttgcagtaggctcccagcatgattgttctcatatgagtgatgttcactaggaaatgacgccccctgtgttgcaggcaagcacactctggggttgaggcaacccccacgtggaagacactataaggagtacatcaggtgaaatgttagggtgaggagccaacatcggagcatggccaacccttcttccacccgaactcagggcactccacatggggcaaactgctgtgctccagctagcagcagccctgtggtcctgccctcctggggctcacagtccctcagggagacaagttgtagaggcaacaagtggtgccaaatgcacagggtgagaagcagttaacccagaggccaggagcctccatgcaggagggagagaagagtgtgatggcaggggccgagggtccgtccgaggtgtggggcaggggcagggagtcgaggaaggcccagggttcggagcttgtgagtggacggtgctgccagccagaatttccgagctcgccttgggcccttaaagtctgtctcccgccgtctgagagcatcagggacgcgccgggcctgctcctcccgggcctttgcttaactcggggctgcacgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacaaaaanaa

SEQ ID NO: 597097 - DNA, 213 bp, Homo sapiens
ctacacacaaatcaaaatatttagccaggtgtggtcgtgtgcacctgtggtcccatctactccagaggctgaggtgggaggattgcttgagcctgggaggttgcgtgctgcagctgcgccatgcattgtgccacatgcactccagccataaacaacagagtgaagaccctgtctcaacgaaacacaaacaaagagcttggtaaatatacatgg

SEQ ID NO: 597098 - DNA, 6000 bp, Homo sapiens
  misc_feature (5998)..(5998): n is a, c, g, or t
gggcgcttggttccccagcaaccgggagacgcgtctgctgcgtggaaccgccgagttcccagcgcttgagaagggtcttcctatgttgcccgggctggtcttgaactcctgaactcaagcagtccttccacctcggcctcccaaagagctgggattacaggtgtaagccatctcgcccaaccaattttcttcttattaattcatggccaatagggactatagttttcagatcctgttgacttcaggttatcatttcccaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacagcaagtgtctccctctcagtctcccagccctgtgagacagattcctcaagcccccaggtttcttggaaaaggggcattgaagagtagcttcccctgcccacaactaggagagaaagggcagctccctcttcctaatccctttacctgactctgtcagagtgattccagcagcacccttgtaagtactgttttgtgtgcgttcccaggggccaggcctcttccacacactgtcccagggccacctcacagccatcctgcactgtctagttttccagatgaagaagctgaggagggctgggagcagtggctcacgcctgtaatcccagcactttgagaggctgaggcgggaggatcgcttgagccaaggagttcaagaccagcctgggcaacatagggagaccccatctctacagaaactaccaaaattagccaggtgtggtggcacacaccagtaatcctggctactcacaaggccgaggtagaagaatcgcttgagactaggagtttgaggctgcagtgaactaagaagatgccattgcactccagcctgggcaacagagtgaaaaaattaaaaaattagaaaagaaaagaagttgaggaggcccaaggagggcaagcagccaggatcactggctcaaggccaagccaggattcaccctaagttggtgtcatcccaggagcaatattaacagctgagctccagagggaaccaggccatcagaggctcaggcctggctctcaggggcagagtcagggctggaggtagagacctgagtgtcatctgaggattgccaattggcagtagttgaagccatggtacaggtgggatcacctggggcacatggagtgagctgggggacggggactaagttctagaggtgccagcattcctggccaggtacagggggatgagccagtgcggtggagagagccaagggccagaccctcgtgaccagccctatggcctcactctacctctgtcctgttgtcctccttccctaaaagagggccagaaggcctgctgagggctgttgggagtgagagagcaagtcctctgtggagaacacccagtctggggcgaggggagcgctccattgctgtggctcctgccctggagatggccccgggaaccccagcctgccacgctgccttccgctcctcctggtctttccctgatttccctgcgctcacaaaaacctggtgagggtcatcaggagatgggcattctcatccacgagacctcatggctttcacagccttcatgcaggcccctgtgcaacacccctgcccatgcgcgggaggctgcagcatggcagaggcggcatggcagaggcggtgtggctcggaggaacctctggtaacaatgccactcccgttccctggtcagaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggtaaggctgggccctgggcacaagtgccagaatctggcgatgcagctgcacatccataggtgaactgtagccttcatgggcacgcctctgctggaaacgtccagcacgactcagcgtggcaggctgtagctttcttgctcatcagtcctgtttgcttttattacattttaatcatttacattggaagtgattcttgtggaaaatgagaggtgagctcattcttctgaaatggtccccctatcctggaagtcagtggggagaggtttttgattagacccctggagctatccgggtactctaaaggcaaagcgcacccccacttggggaccaaacaaagacccctccgcattgcagcctgcagttgccgcttctcaggtgacgtgaggaggctgcaactcagcactaagtagtgaaaatgaaaagcgccgctgtctgaaattcattagcagccagagtatgtgttacaaggcagcggaggctgggagtctgaagtggtgtgatgaattgaacctcatcggatgctgctgtggctgggccaagtgatagcacctaatcaattcctcacacgtcaagtgacacctcagacatgggatagatttccccatcacatcacagggcaggtgctccctccctgctggagagcacaggcactgcagaagcagcgcacagtgccaggggcgagtgaggcagcagctcccagccttttcaggcacggagattgcctttcaacatccaaacatttcccagaacccatgtgccatcctacttgtattactggtggccagaaagccacaagcgcaatcatgcttttcaatgaccctatttttattcacgagaacagcacatacatgtgtttgaaaattatgtgaggtgctcactctgcagacagtactcacattcctatagattccacccctgcccaccttgcagcccctggagtctatagcagatgggagtggggcactccgagagtggcaggcctggagatcacatcttccattgttccttcaatcaacactaactcccatttgggccttaggtgccttgctaagcaccacaaaacagcaactaactgaaagagatctggagtgccagcccgctcctactgagggcctcctctctgtcaggcaccttgcaaagcattttgtgtgaagtgactcatttaacctcaccacaacgccacaacgcagggattatgcaggtaacctatttcccagatgaggaagataaggcccaaggaggtgaaatgcctttcccagagttacacagagtgctggagctgggaatactgacccaggcagtctagctcttaacagctcactccactgtttccctggaggtgatgcacagatgtcactgggaaacccaaaggagagggggttggctgtgtgtgtgtgtgttgggcaggcaggtaaggggagtaagaccaggacaagtgttcctggcaaagttccggtgacagcattaaacattcagatggtgagggagttaatatggttggagaacaacaactttagagagagcagaggggtcagttcacaaccatctgctcaggagggtcaagatgggtggtctttatgctgaaggtctgtgattagaggagctggttgctaaattttgaggagtaccttttgctctgtgctggacatctaaatatgcatgttaactgtgttctttaacatttccaggagactataaacatgtttgaaaggaacattgttgacatggtaggactgtttatcgaaaatgtccaaagcctatatcctttctgtgatgaccttccccatggggaggtgctacagagcccctgggcttgtcccggcctctggacaaaagaatgttccacagggtctgaggaggtttcccgaccctcagaacaatgatggcctggttagagctgtggtttggatgcccagagggacaacatccaaactgtttgcagtaggctcccagcatgattgttctcatatgagtgatgttcactaggaaatgacgccccctgtgttgcaggcaagcacactctggggttgaggcaacccccacgtggaagacactataaggagtacatcaggtgaaatgttagggtgaggagccaacatcggagcatggccaacccttcttccacccgaactcagggcactccacatggggcaaactgctgtgctccagctagcagcagccctgtggtcctgccctcctggggctcacagtccctcagggagacaagttgtagaggcaacaagtggtgccaaatgcacagggtgagaagcagttaacccagaggccaggagcctccatgcaggagggagagaagagtgtgatggcaggggccgagggtccgtccgaggtgtggggcaggggcagggagtcgaggaaggcccagggttcggagcttgtgagtggacggtgctgccagccagaatttccgagctcgccttgggcccttaaagtctgtctcccgccgtctgagagcatcagggacgcgccgggcctgctcctcccgggcctttgcttaactcggggctgcacgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacaaaaanaa

SEQ ID NO: 597099 - DNA, 195 bp, Homo sapiens
  misc_feature (107)..(107): n is a, c, g, or t
  misc_feature (109)..(109): n is a, c, g, or t
tattgattatacttgccccattattcctagaaccatgcgcctgcgactacttgacgttacactcctatcatacttggaattgaagacccattttttattaatttttntnccaagacgtcttgcacttatgagctgtccccacattaggcttaaaaacagatgcaatttccggacgtctaaaccaaaccactttca

SEQ ID NO: 597100 - DNA, 1968 bp, Homo sapiens
  misc_feature (1966)..(1966): n is a, c, g, or t
gggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcgagtttaagtgccattcgagaggagttggaactgcccaacattgagaagatgatcctagaatgcagtgctgacatcagtgagttgttcgatgcgctcatgacgctggagatgcagctggtggagcagctggaggagactataaacatgtttgaaaggaacattgttgacatggtaggactgtttatcgaaaatgtccaaagcctgatggctcagtgccgggacctggagaatcaccaccacgagaagctcctggagatctctatcagcaccctggagaagattgtcgagggcgacctggacgaggacctgcctaacgacctgcgcgcgctttttgtcgataaagatacgattgttaatgctgtcggggcatcgcacgacatccacctcctgaagattgacaatcgagaagatgagctggtgaccagaatcaactcttggtgtacacgtttaatagacaggattcacaaggatgagatcatgaggaaccgcaagcgcgtgaaggagatcaatcagtacatcgaccacatgcagagcgaactggacaacctggaatgtggcgacatcctagactagatgaatgtcagccacaggagcttcttcaaaacatagcaccagccccagccaggagaaggaagtgcacacgcctcacccgcacctctagagagttgctgggcatctctcaaccgcgatccccaacaccattcttcccccacccctggaaaaacttccaaaagtagagaaaataaaggactcatttcacaaaaanaa

SEQ ID NO: 597101 - DNA, 1531 bp, Homo sapiens
gggcgcttggttccccagcaaccgggagacgcgtctgctgcgtggaaccgccgagttcccagcgcttgagaaggaaaattctggatctgttatctgtgaggaggccactccgttgacagttgtgtaaaactctgctgctttccccagctccaacctctctggtcttcaacaacactatcatcagggaaaacgtgggggaagatgaaccagccgtgcaactcgatggagccgagggtgatggacgatgacatgctcaagctggccgtcggggaccagggcccccaggaggaggccgggcagctggccaagcaggagggcatcctcttcaaggatgtcctgtccctgcagctggactttcggaacatcctccgcatagacaacctctggcagtttgagaacttgaggaagctgcagctggacaataacatcattgagaagatcgagggcctggagaacctcgcacacctggtctggctggatctgtctttcaacaacattgagaccatcgaggggctggacacactggtgaacctggaggacctgagcttgttcaacaaccggatctccaagatcgactccctggacgccctcgtcaagctgcaggtgttgtcgctgggcaacaaccggattgacaacatgatgaacatcatctacctccggcggttcaagtgcctgcggacgctcagcctctctaggaaccctatctctgaggcagaggattacaagatgttcatctgtgcctaccttcctgacctcatgtacctggactaccggcgcattgatgaccacacaaaaaagcttgcggaggctaagcaccagtacagcatcgacgagctgaagcaccaggagaacctgatgcaggcccagctggaggacgagcaggcgcagcgggaggagctagagaagcacaagactgcgtttgtggaacacctgaatggctccttcctgtttgacagcatgtacgctgaggactcagagggcaacaatctgtcctacctgcctggtgtcggtgagctccttgagacctacaaggacaagtttgtcatcatctgcgtgaatatttttgagtatggcctgaaacagcaggagaagcggaaaacagagcttgacaccttcagtgaatgtgtccgtgaggccatccaggaaaaccaggagcagggcaaacgcaagattgccaaattcgaggagaagcacttgtcggtaggccccgagcctcctgaggccctccctgtctcctgctgcaggccctccctgctcttgccactcccactgtagggggactgcaactcctgtaccctctgatgacccctgaggccaatggttattgtccccatttgccagagatcatacagctaatcagtggcagagccaaggcccgccttacaccagcaccaccaaccacagctccccactgcttgacgtgtggcctgtgggtctttgtcacacaaagtgcccttgggattcaaggtcggccctaccccccaacttatcatcatcgttactattaataacagtattagtatgaccatta

SEQ ID NO: 597102 - DNA, 151 bp, Homo sapiens
ttacccctaatttctacagtgctacaccctagaccaaacctactgccaaaatccatttcactcatcatatacatcggcgtaaatctaactttcttcccaacaaactttctcggctatccggaatgctccgatgtaactcggactacccgat

SEQ ID NO: 597103 - DNA, 332 bp, Homo sapiens
  misc_feature (129)..(129): n is a, c, g, or t
  misc_feature (179)..(179): n is a, c, g, or t
  misc_feature (186)..(187): n is a, c, g, or t
cacgatattggagcgtgcgatagaccaggcggagattgtctattgggtgattactgtcaggattagggcatgtgacttgtgcaggggagcattggctgtgatatgtgtctatgtatttgttctcccagngagaagagtgaggttacggacacaagaactctactaatttaaaaataggngctatannagaatttctctataaagtaagtttttagatagctttttgtttggaagtccttaagatatggggaattttttttttttcactttttctgtcagagtaatatgtgtaccaggttcaacaagtcaggtatttactagacttataaaga

SEQ ID NO: 597104 - DNA, 149 bp, Homo sapiens
atgcccttgttgctctgatatataaggcccggatgttctgccagtattccttgagcaagtggttccaagaatttgacagccaggtgattgttatacacaagctcatcgtctgtcatcttcatgtgaccaacagctatagccagacataa

SEQ ID NO: 597105 - DNA, 755 bp, Homo sapiens
  misc_feature (114)..(115): n is a, c, g, or t
gagcggggctttcccgtgaaggcaggcaggcagcgccggcctccggaggcggcctgggcgatggcggcggagttttgtccataacctgggcaaccgcgcagctggaggatggcnncactcggttttgccgcagctggggagcaggcgtcgggggctgaggcggagcctgggccccgtggggacgacgcacgccgccactcacgcgtcctctctggggcccctgaatcccccttgacagcgggaacctcatctacaactggcaggcgagcaatggcgtcgcctgaaggagcgcttcgccattcctcttcaacgtcggagctgcgtgagcgatgtgcgcttcagtacatgggcaagggtcagacggagccgacagacagctgggggcaccaggagcgcaatccaccagaacacgcgacttcgacgactggcggcacggcaagcaggccggtcttcacggacggcccaatggttccaaccagtgcgtggcatgggacaaaccgaacggtacgggaccgaagacatccgacgccctggacagagacgttggcacaaccacgcggagcccattaccattgggcctgcttgccattgacggactcatgccgtcacttcgttcccacgcagttgcaaacggttaccaacagatcggcatccccagcagcaaccgcggcgctagtggaacgccagagtccttttacataccggggcccacagggtaaacagtcaggcgcacgtagagccaagacgcttcggac

SEQ ID NO: 597106 - DNA, 861 bp, Homo sapiens
tgagaagaggggacatgggtcagcaagactgctgctttttctggttgcatccatgtctgagttagtggtgcacactcgaccgacaggcgggactgtcagagctttagtgtgggtctcctgggggccctgcatacacactgcaccaggttagctcttggattagattgttgttcgctgtcagggttggagggaatctgccactgggtgctcagcagaggagctccttctgaactggatgggctggggagctgctatggtgcaggccaggtggagggggtctgacagcaggacctgctgagccacagggcccgagccgaccccacaagcaataacagatgtggagtgcggtggatgcttggccttttctaaacaggttacatttaaacacgagtttctatttttaagatacagcttatcagggggtgtgtggccgatctcactgcgcattgtctgcttctgtcccatgcccacatgtcagtggccagcactgtgcatgtttcatggtgttcatagttcccagccctggggctccaggggcacctgtgggcaccttgtgctttccttctcgggggagcccagtctgtttgaaacgcaacagagtctggtgttgggaggtgcggaagggggttgtaccgaaatagtattgcaggccactgagatgaagggctctctgttagaagtggtctgtgtggggtgatgtgcacacacagagtggtcccgggcatgtgctgtgcttcaggcttcctgggagtgggggagagagaggggtcctttgcaacacagtattttttctttgttttttcatggacaatttccgggggccccttcgggagggaatggggggaaaaaagggggggttcc

SEQ ID NO: 597107 - DNA, 134 bp, Homo sapiens
  misc_feature (124)..(124): n is a, c, g, or t
attccgggcaagtgagccaagagtaatgcttttccacattccttacattcatatggcttctctccagagtgaatccatatgaatgtaaggaatgtggaaaagcattctcttggctcacttgccnggttacgcag

SEQ ID NO: 597108 - DNA, 635 bp, Homo sapiens
agggagtgatcatgttggctgagaagtcctctcgaccagtcaaagcagcaatgcattagtctgtgtctaacgtattatgtgtgcgtaatatataccggaattgttcagtctttaaattagatgtgaagcataataaaggtggcggtacgtgtaaaattcatcccatctagaggcccaaacttaagcggcgccaggttcattatggtacaaaacgtggacccggcaacaagaaggcgtcgctgttactacacgctaggccacgagagcccaggctgttatcaccaaataggttcgatgaccttagtgtaaacaagctgtaataggcatggggactctatctgtagacgagaccccttaacatcgcatggaaggagattgaatggacaaactacgatggggaaaccacaactggtagcgacaaaagaagacacaattttagaacgcgcgtcttgacaagtgcaaaccaattactctagagcacatcatcacaaacgctgttactaactgtgttcacacccctcaggcctggcgaataatgacatgcagactgctctatgcaaacctgtatcaggcctgatcatgaccataatgcacttgctggaccaccttgtaatccacgagagaacttaggtcaa

SEQ ID NO: 597109 - DNA, 231 bp, Homo sapiens
tcagccggcccgctctcgtgagactgagggcggtgacagagcccatccgcagagcgtaggatggcctccgagtaggccgtgtgcaatgtggtgaatgaagctaatacatacattttttcagatatggaatattagccatggtcattaattaaatgaaagaataaatacgtgaaggttaatctactgatcaaacttaaaacaatcctctggtttcattcttgacaatccttg

SEQ ID NO: 597110 - DNA, 120 bp, Homo sapiens
gcgtaatgtggtggttgatacacggtacaattcgcacaaataccaccaggtatttgggaaagttggtatgaagattaccattccaaagaggcaacagagttctgacccaatgtccaattg

SEQ ID NO: 597111 - DNA, 304 bp, Homo sapiens
acttttccattggaaaaaaggaaattggagttattccagtgggaagtattggttgaggttaagaggcttaatgacttacaccgggactcaattgacaccgccaaagggggcacatttgtttaaagggaagattgtgaacttgtaaagtttaggaattaagaatgtagctgggctcgttggctcgcgtgtgaagtcccggcacactgggaggccgaggcagggtggatcccttgagctcgggggttcgagactaccctgagcaatatggtgaaaccctgtccctgcaaaaaatacaaaaaaaaaa

SEQ ID NO: 597112 - DNA, 205 bp, Homo sapiens
cgaatgtgggtcgcaggcacttactcccaaacgcgtcaggcattcgtcaatcagttgctgctgcccaagggtttcctcaaatgtgctcgtcgattcgcgcctttagttgggggtaattctccaggcgctcggactgtgccttgagcattttctcggcctgttgctccatcgcatgggcatcacgtagccagtcgagcaggttttc

SEQ ID NO: 597113 - DNA, 191 bp, Homo sapiens
gtccacatatgcgcagtcgccgtccagcaggttgcgcatctgggtggtgttttcagcagcgtcgccgccaccagcgcggtcagcatcaccaccatgccgatgctgatgaacttctcgccgcggccgatcgctttcaaacctgagatacagcacgccggcggcgggcacgaagaacagcaggctgcccagcg

SEQ ID NO: 597114 - DNA, 136 bp, Homo sapiens
  misc_feature (74)..(74): n is a, c, g, or t
tcgcacccggacaccggtgtagagtgcggcgcgcatcagtgcgcagaatgtgctaccaggtatggagcctggtntgcaagcgagcaatttccacctctgtgtgtgtacgagctcatgaaggtgccgatgaatagcg

SEQ ID NO: 597115 - DNA, 1010 bp, Homo sapiens
ggcggggccttgtggtgagggcttaaggaagtaaaatggcggaccgtggcgaacgaagaggaaaggagcagtggcttccggttgacgccaccaatcgctgatccacggccaagccccgcagcgcatggtctgccaagccagaagcccaaggagcagcagcggagcgtgcttcgcccggcagtgttacaagctccggcagccaaaggcgctgtcccatgactgtccccagcagtggcaccaacggtggtcaagccatcccatgcatgacatgcaacggaggagcatgtgccctgcatgcatcccctgacactgctgcatggagaagtccttccgaagctgccgatgaggagaacgagccccagaaacatgagtccagcaatgtcctctgacgaggaagcctgtgagaaaagagaccccggcacacagcaagcctttgtatttggggcagaacttgacgggaccacgagttaacgcctgataaactgagagcgtggaccgaagccgaccatggcagactgctggacacccccagcgcagacactgcgcaaccgcaacgaactatctcgtccagtatatcagtgacagctataggacgaactcaagcaatagtgccgacgcctcagcaacaaatcgtatctggcagaacatgagcgagcgagtttggatgacccccaagaattacacgaggtcagtacagtcttgcaacacgcgacaaatgccgctgcgagtcagggtctgaagtcctcgtccaggaggccaccacatgagaagagtcctggctgaactagcaggcctaaccaggaaacagacggcagcgctcgggggaaacacctgacagttctcccgcggatagcagcgcaaagccacgtgttcaccctgcccgtaccgcatgcatcgcgaccacccacgccatgggtgcaaaagccgcggcgctcacaccatcacgtcaaccactacagcatccgccacaataacgcacccgtacgtccagaccacgcgcccacacatac

SEQ ID NO: 597116 - DNA, 140 bp, Homo sapiens
cgactccgacgccggcaaggtttgggagagcggctcggtcgcgggacccgcgggcttacacccgcccagactacggacgggctttgccaccctcttccgcttgctgtccctatcttttccgcttccggttggcaattcca

SEQ ID NO: 597117 - DNA, 146 bp, Homo sapiens
agttctggcgggactacggctattgtgtagaacggggtcaggctggagaatgagggaaagttaagtggccgccagtgcgggatcaggcgagagtgcttcgtctgctaattgtaccagcaggtgctggcaggctctgaactgctgca

SEQ ID NO: 597118 - DNA, 202 bp, Homo sapiens
gtagacatctggggccaggtgtgagtagtggcacacggggctcaggtctgtgggtgaggagtgaggactggactgtacttggtggagaggatagctggtctgagttctagtattcttgctcgccagtgagccctggcactgtgtagtctccagtccccacccaggtcaggagtcagcttggtctaggaggagaggctggact

SEQ ID NO: 597119 - DNA, 810 bp, Homo sapiens
aacagtggctcacgcctgtaatctcagcactttgggaggctgaggcaggtggatcacgaggtcaggagatggagaccatcctggctacggtgaaaccccatctctactaaaaatacaaaaaattggctgggcgtggtggtgggcgcctgtagtcccagctactcgggaggctgaggcaggagaatggcgtgaacctgggaggcggagcttgcagtgagccgagattgcgccactgcactccagcctgggcaacaaagtgagactccatctcaaaaaaaaaaaaaaaaaggtgggtttccttaaaaaggtcctttaaaggcaatttatttttaaaaggtgggataaaggggcttcacaagggtttattacctcttaattagggtaattaaggacctttttctaaggtccagaggaccaatttacctttcttagaaccggtttacataatttgccaattcggaattaccggagattgggggtcacgtggtacccattgggaggttatacattaggcttcgggcacatccgggtgtacacataacttttaaatatccttgggagagagggacctaaaaaggtttccaaagggaccaaaacttttacgcggcaaccattttcctatttaaattacctaggggctaagtgggtgctactaccggtggtgctccccattttaacctcgggacagtaatctaaagtcctccggaacaaagtgggggtactaatttttgcccacacaactctcggggcaggtccaaagagggacttgggcaaggggaccccccaaatacgggttacattttcatttgg

SEQ ID NO: 597120 - DNA, 242 bp, Homo sapiens
taaccaatatgtagaaaccccgcctctactaaaaatacaaaattagccaggcgtggtcgcatgcctgtaatcctagctactcgggaggctgaggcaggagaatcattgaacccaggaggcggaggttgtggtgggccaatatcacaccattgcactccaacctgggcaacaagagcaagagtccatctaaaaaaagagctgtatataccactttaaactgtccttggccttgccatatgcaa

SEQ ID NO: 597121 - DNA, 373 bp, Homo sapiens
  misc_feature (51)..(51): n is a, c, g, or t
  misc_feature (59)..(59): n is a, c, g, or t
  misc_feature (161)..(161): n is a, c, g, or t
  misc_feature (233)..(233): n is a, c, g, or t
tcaagaaaatgattgggtgggtttccatgtgatgccaaaagaatttccccnatactccngccctgttttcctggatcaccctgtccccccagaaattgccctgaaaacaaatcacaggttgaaactagaaataacttcccctctccctaggcagcttgganactggccaccctgtttcttggtttggtaagaatgttccagacacaaggaggggagcaacacacactggggcntgtcgggggttggggtatggggagggagagcattaggaaaaataactaatgcatgctgggcttaatacctaggtgatgggttgataggtgcagcaaaccaccatggcacacatttacctaagtaacgaaactgcacatcc

SEQ ID NO: 597122 - DNA, 142 bp, Homo sapiens
ctctgctcatatctgtctgtgagtagtcttctccagcccaaagcctcagtttcccccatgattggtgcggggtgcacagcgacgctccttgcatgaaagacaggggccaggttgggagaacttgggcatggagatggatcct

SEQ ID NO: 597123 - DNA, 753 bp, Homo sapiens
gggagcgatccctccatcgtacggctgctggagtgcgacgccagcagtgccattcagttctgatcgatcgccccctggagcagttgcgagagaaagcagcaggcttgtcgtgccgtgttaagcctttgctctgcgaggaggtggaatgcccgcgccatatcgttacctgcgtctcctcgaggccccgcggtcctggtggcagtgctgttgcggcactgccctgggccaggtgggctgctggccttgcctcccgtccagtctgatccaagcgacgcagattccgtccggcctcacgacctggcgccgagtcccgttccatggtccaacgtcccagcgcagtgtgcgtgagcatgccaggggttcagcggtgttctttgagttttcacggcacgctcgccggatcattggggtacgcctcagggagggtcgccattgcgcgtaggtaggaaaccaagaggccgtgtatccctctacctgaagaggcttgctggcgccagcagaggccaggccccaagaggcggttgtctgttgaagttcgccaacggttggaacctcttgttgggagaacatggggtgggcgtgaccagaaagagaccgtcagggggatagttcagtatttagcacggtggaaagcgctacacattcggccacagttttgcatttgtagtttggaattccaacttaccagggtatcaaattacagcaatccgaacgactattaacggtcccaaggaatttggcaagaacatcttg

SEQ ID NO: 597124 - DNA, 356 bp, Homo sapiens
gtcggacagcttgatggctgactcttatagaaggatatctctggctacttggatcatccattgatactcagttaggcaacactctgctgctttacataagtgccaagaaggcgccagagagaagagcaatcgtgttccaaggaatcggcagtgactatatcttggcctttctggatgaaaggatctgtccattcacagagcacaagaaatgcaattgagacactttttttggcagctggcctctggtcaatgtagttaaccacacttgtctcctgccggaactccactgcttcccgcccatcctcctccttggtctttaccagtgacatcttgacccaggtgcggaagcccccaga

SEQ ID NO: 597125 - DNA, 398 bp, Homo sapiens
tatagaaacggagttacactctatcgcccaggctgaagtgcagtggcgtgatctctgctcactgcaacctccgcctcccgggttcaagccattctcctgcctcagcctcctgagtatctgggactacaggtgtgagccaccacacctggccaagggggcacattttttgattgcacagaagctccatatgggctagcagcagctctagggggctattgccctccccagctgtacttgacactctctccaaggtagggactagggcgtatttatcttggtatcaagattatccagtacagcaagtctcagtgaaaggttgataaacagaatttagtacacttggtcttccaaaatgaaactatttgactaaggaacttaatgaaagacaaagggaaaca

SEQ ID NO: 597126 - DNA, 199 bp, Homo sapiens
gggggaaatatctcagaagtaatgctgggtcctcctgggtgcatcaggaaattataaaaatgtgttctagtgtaggggatgttaataaatcacttgggtgataaagctttctgacacatttttttcaatatagaattaattatttttctcttcaacaacaagtatctttatggaggtggtgtggaattaaccaaacaaa

SEQ ID NO: 597127 - DNA, 203 bp, Homo sapiens
agacgtcccttctatgcatggacaacacgagctagcatcccggtccctaaacaacgcaatgcaacagcaacaggcaagcaaagcagcagcagcagggcacaggcaaggcaagcagcagcaaaggcacagggcagcagcagcaaaggcaagggcagcagcaggcaaggcaagcagcagcaaaggcaaggcaagcaaagcaaagc

SEQ ID NO: 597128 - DNA, 520 bp, Homo sapiens
  misc_feature (19)..(19): n is a, c, g, or t
  misc_feature (31)..(31): n is a, c, g, or t
ctcaagctttatacttcanatacatgtgganagacagtgtggcattctcaaggatctagaactagaaataccattgacccagcaatcccattactgggtatataccccaaggattataaatcattctactataaagacacatgcacatgtatgtttattgaagcactattcacaatagcaaagacttggaaccaacccaaacgtccatcaatgttagactggataaagaaaatgtggcatgtataggccaggcatggtggctcacgcctgtaatcccagcactttgggaggccgagaggggcagatcatctgaggttgggagtttgagattagcctgaccaacatgaagaaaccccgtctctactaaaaatacaaaattgcctgggcatgatggcatgtgcctgtaatcccagatacttgggaagctggggcaggagaatagcttgaacctgggaggcgggggttgcaatgagctgagatagtgccactgcactccagcctggaagtataaagcgttgag

SEQ ID NO: 597129 - DNA, 1301 bp, Homo sapiens
  misc_feature (52)..(52): n is a, c, g, or t
  misc_feature (115)..(115): n is a, c, g, or t
  misc_feature (142)..(142): n is a, c, g, or t
  misc_feature (146)..(146): n is a, c, g, or t
  misc_feature (221)..(221): n is a, c, g, or t
  misc_feature (263)..(263): n is a, c, g, or t
  misc_feature (522)..(522): n is a, c, g, or t
  misc_feature (527)..(527): n is a, c, g, or t
  misc_feature (693)..(693): n is a, c, g, or t
  misc_feature (770)..(770): n is a, c, g, or t
  misc_feature (781)..(781): n is a, c, g, or t
  misc_feature (854)..(854): n is a, c, g, or t
  misc_feature (877)..(877): n is a, c, g, or t
  misc_feature (1134)..(1134): n is a, c, g, or t
gaaaaaataaaatattttttattatattttattataattatattagtattangagtttatatattataatttattatttttatattattatataaataagatagtatcttttgtnattaattttgacgtctatttgatcctntganttaacgttctattatatattaattaagattgatattacggagtgggtcaatattctcttcagacatgtacgcgcnacatcctcgaggatgatcactacgaaccagcgatgacgacanaagcaccacgaggcaggaagcacgcgtagcccgtaaatatgagaatacgagccttacagtgtgcgcaacgtgtgctctgtggtgttgtgcgctgtaggagtagcgcagtctcgccataccatgtactgctctgtcgacgccatcgcgcctctgcgcgccacgcaagagatacgcgcagcgcgccgatcaatgatgcttagatagagagagacattgagagataatcaaacgtcaatataggtgtagagtcaagatgaanagcanacgagagtacactcgacctatctgccactacacacccacgcacctactccaaacgccccttcgctacattcgacactcgtctcaccaatctcatttctggtgtccgcgcatctcaccgccgcggcgacggcgtcaggcgtgtcgtgtagtggcggaatgcgtagcngcagcctagtgccactcgtccgccgcgtaagtgacgcaccacagtatagatctcgtacggagtcactgcgagatcanatcgcgtcctncgagtatgacgcactacacgtagtagacacggcgcgtgcagcgatgttaacaggacgggcgcgtgtcgagagncgcgcacgagtcgtgttagcgtnggcgtacgcctatcgcgacacaacgccgtgctgcttggcgcgcccgcctatcacgacctcgcacgcacaaacgggccgtatcgccgtcgtcatcgcgtataatcgcatatacaatagacgcgcgagtgcgtcacctgactcgatacgcatgaacgttgcagcgcgcactcacgtagttgaggtatagtagctactgacgcgcgcctcatcaccgtgctcgcttcactctgcgcttatactgagtgactgtctctcanatcgctcattgcgtcgcgaccgagtacgcgcaccacgtgtctcatgtacgctctatgcatactgcgtatcccgtacgcctcgtccagccgtgtcgacgctcagacggagtactcgccactctgacgcgcagcaggcgactgatcgctctgcggcagcctccattcag

SEQ ID NO: 597130 - DNA, 101 bp, Homo sapiens
acccctcagagacatcatacctctggaatcaacctactttctaataccctacttggaaaaatgagcttgcccctacctaccagcatctcctgcttatggaa

SEQ ID NO: 597131 - DNA, 744 bp, Homo sapiens
ggggaggaaagaacttgcatgttgggtgaaggaagaagtggggtataagaagtggggtgggaccacagtgaaatctatggtacaaccaaactggcccaaggtgtctctgcaagctgtaatgcagtttaatcacagagccatttttttttatgttcaaatgattttaattattggaatgcacaattttggggatatgcaaataaaaagcttaaaatcttacaaaaaaaagatttaaagggtaccatccttttggaaacaaaatgcttatgaaaaatatttgttggcggtttcggcctattcacttttagattcagttagcttttttgttgcggctgcattctcggtttactagccaatttagacctttagaaggccttttaaaaatcaagtgcccggccattaaccacgtcattcttgggaaacccgcgagggacccaaatttaatccctttagagaaaaacccctttgcggcgttaactatttctagaaaaggcccaccttattcccattccaactttgcaaaaccgggtggcaatggaaaagtggagcactccttctttgtaacatcaggtttaatttaaggaaaacggtgtttttttccccatgggccgaaaagggaaattccttttttcaaaaaaaagaccgaggaagggggttttccaatttgcccctggatccccttgaagcccgtttttcccccctaaggggcttccttaagggcggtccctttggccccccctttgt

SEQ ID NO: 597132 - DNA, 141 bp, Homo sapiens
gcacaaatgcaaaaatgaactgctcacccgtcaggataatctccctgcaccgatattctgtgctggctgtgtagttaattgcaactaatgtgtggtgtgtcgtttctcctcaccagttatttccttgtaacatagcgttta

SEQ ID NO: 597133 - DNA, 1132 bp, Homo sapiens
tcagtggtagctgtatggagctgcactgaaagtgaccataggatcttcatgaacacctgcgacccatcctctctcacccagcagatggttgtttagaacacagcgcgaactcaatcagtctatggaaagaagattctaactaggaacttgatgacccatcatgtcccctatggccaggaccccccagggctctggcactcactgcaaacttccctcatttccaaatcgagaagagcatgaggccaccatagttgagcgtccactacagttgtaataacgcgttgcgtcgtgccacaatagcgttccacccggatcgaaccaagaggctcctctgactatccaaccggggcatcgcccagtcgtcgccgttggactcccttgctaggcccgcacatgcagttcagacgtgcgcggctcaacgtgctgccacacgcagcgcgccatcactctcgcaaacgccacgtaggcgacacctacatagctagcggctcagcccacgccacgcaccgtcgcctgttatccaacactccccctctggccttgtgacccacatccacccgtggcaacacgcaaacgccccacacacccacaccaccgacccccactattcgtatccacacacaccatatacgttgcatccaacctatacattttgcctttccccgcccccttccgctagcaccccaccttatcacatcgcctatgcctcccgccaccgccccacccaccctccaccatcctgccctaaacgccccttctcacccagcgcccaccacaccccccaaacccacacaacgccctggcaccgtcttccccttggcgccgcatacgagcactatcagccccctccaaaccacctcccccctacccatcactacgtcgcgccccttgcgcttccccggtaaccccgcttcgtcactgggcgactcggcacatccatccagcgcaacaaccgcgcacctacaccggccggcgttagcaaccacctctctgggcccccttgcgctccccttgcgcgaggcgccccacgcgcactcctcccgccaccgcgtcaattcccgcactctgccccctagcagtcccacacactcctgcgctacccccacgcaacccactctaccgcgacccaccc

SEQ ID NO: 597134 - DNA, 142 bp, Homo sapiens
ggatgattgtctgtgatcacgtcgcgctgaaacagcaatggccgtttgaaagccgtataagagtctcgttacaagttcccccattttacctgtcctaaaaccagacaagccttacaagttagttcaggatcttggcctcgtg

SEQ ID NO: 597135 - DNA, 623 bp, Homo sapiens
  misc_feature (169)..(169): n is a, c, g, or t
  misc_feature (532)..(532): n is a, c, g, or t
ggctaatgacattcgatgtgtcggggcagcatgcaggctctggccttggggatctgagggctgtgtggcacctctggacggagttccccggagccttccttgcagccctcgtactcccgctgagactgagtggctttggcagtgtctgcgttggactcactggcctccntcgtggagcgtggagccagggacctggctgacctcgttgtaccctcgatccctgtctcctagatcactcgaactggacagcacgtgtgcattcgtgctggattggccctgcatgccaacttctgctccagactcccagggcgagcaccacccgtggatgcagtagattctgcgcaccatgaagaagggtgggcttcagtggggcgtatgcgcccagagtccccgacagccagcgctgcggcaactcagatatccctgacaggactcaagggaggtcagaacagctgagagttgtgacaggcttcagccaggtcactgagtcaccagtaggacgagaagaggaagccatagtctccacagtggntattctaacgaaagtaccgcaaggtgaccatcaaatattccagagctagggctggaggactttgacttcaaacactacaagtaagaccttc

SEQ ID NO: 597136 - DNA, 495 bp, Homo sapiens
  misc_feature (33)..(33): n is a, c, g, or t
aggcccatttgagtattttgttttcaattaggnagatagttggtattaggattaggattgttgtgaagtatagtacggatgcaacttgcccaatgatggtaaaagggtagctagctggttgtcctccgattcaggttagaatgagtaggtctgcgactaggagtcaataaagtgattgtcttagtggtcgaaatattacgctttgttgtttgaatatatggaggatgggcattattgctagcatgagcatggatagtaatagggcaaggacgcctcctagtttgttagggccggatcggataattgtgtagccgaataggaaatatcattcgggcttgatgtgggaacgggtgtttcagaggttggctagggtataattgtctgggtcgcctaggaggtctggtgagaatagtgttaatgtctttaagaacagaagctagataagtaatccgagtgcgtctttgaatggtagtacgggtggcagctgcttgtatc

SEQ ID NO: 597137 - DNA, 707 bp, Homo sapiens
ggagagagagaactagtctcgagttttttgtgtttctcgaatagtaaacaacctagttcttattatttgcccaaggccggctgtgaaaagcactggaggccccaaaatattccaaaagggaaggggaggaggggcaaagcacgtggtgccaaaccagggtgcgtgccgtgccccgcaccagtgctgccgtgaaggcacgtggaaagggacgaagaaacgggacatacgacgcaatcaaagaatctcccaaagaatacacagccaatataaaaatacacagtgagagaaggacggacaactgtgagagccaaccagaaatcaccgagcaaggaatacgaaaaaatgaaataagatccaaacggataaacacatatactcaccaacccacctcaatagtcaaaaccccacaaacaaaaaatgtgaaggagtgaaaaaacaagaccaggagagagagaggatacacaagagaacagccacaaatcagtgggcgagagcaccatgataagcaacaacgaggaggacgacaagcgcacacaagcaccaaaaggaacaccaaacgaggggacataagagaagatatggcggagcagaaagccacgaacaaggagcattgatcaacaatagccgacaagaaacccaaagaaaaattcagaaagagcaagaaagagtaccgaaaggaaaacaccaaccaacaacgaaacaaaaca

SEQ ID NO: 597138 - DNA, 846 bp, Homo sapiens
gcggcgtcaggcgaccagccgcggaggccggagggcatggaccttcaggccgccggggcccatgcggcatgggggcctgcggtagcctgtcttcggcggtgcccgtctgactgccgtagcagtcgcggtgtgggctgcccgctcagacccggtagtgctggggttttggctacagcttgaccacttccggttcaggtagcatagagcattgtctatggctactgcgatctgagcgttaggccccgtgtgaaacgagcagcagtcagttcctaaatgacaggtgcctggcccggtggtgacgggtcgacccagttctgcaaggagcgaagcgcttctgcccatggcactgagggcatgcgtacttctgcagtggaagataccttgtagatacccctggggtagccgtggtgccagggatagggcgcagcgacacatgtgagtcacaagccccagacgcgtgatacccaagagccttggcctgagaatcttttggtgcccattgggaggacactatgggggcactttcgtgcagattctgcaatcagaccagggatccacagggtgacaatcctgattcattggaatgtcttagcacgggaatacgtcactaggaggaaagacgccaactctatgtgcgtaccacatgaggacttttaaaacatcccctatggagagtttgattgctttggggttgccctcactatccacattgcgaacgacaccaattgaatttcctgatatgcaatcccacgcgaaggacctggaagaaagcccatttgcccagccccctgctcaaacttgaattaacccccttaaattcacatttgcccaaagcaatagggttct

SEQ ID NO: 597139 - DNA, 487 bp, Homo sapiens
cacacttcctgcccaagtgctgatggactgtggaaacaatgactaccatggaccactgtttgaagatgtagtatgctgaattcccagacatcaacttaaaaataaattctgctcatgaaaagtatgcagggcatgtttctgcttaaaaaaatgtcctgggaaaaaaatctaaattgaattcagaagatagagtaccatgtaaaagagtggccaagttataggaagtatttattttttacctttaattaggtattttagcattcaaaaagctaatgcattttgtttcttagacataaataaatacgtagatcataaatagaaatgtttcagagatgttttatttaagagagtcaacaatagtaattaaattaatactaataaataatgctagctcctgacactttaccattgacactttcaccagtatcttacatgaacctcatagcaactcatagctcatgtctgtgaaaactggggcacagagttg

SEQ ID NO: 597140 - DNA, 744 bp, Homo sapiens
ctcctaaaacatgtgcacctattcctttccttgtaagacattcctaccctttcctattaagagtggtaaaaattgggttaactaattaaaatgagatacaaaggttacagtcttacaacgtctttgattgttcacaatctcacaagacctcaggagtagttaccctaaacagatcaccttagaaaaaaggtgggagatggagtttaggctgttctaagccaagaaagattttgaaacttttttttttttggaaatggagtctctggctcctgtcacccaggctaaagtgccaggggcgtgatctcgggtctctgcagcctctgcctccggggtccgggcgattctccgtgtctcagcctccaaattagctgggactgcaggcttggtgccatcatgcctggctagttttcattcttagtagggcaccaggttcccctatgttgcccagggtggctctcggactcctgacctcgggagacctccgtgctttgacctcccaaagtgctaggatatacaggctatgagccagcacaccctggcttgaaaagattttaatacagtccctggtaatgaggggcatcctgtgagtatatttcccagaaaggcagagccccagaaattgaccttgactcatatcactaatttaaggactagcacgtcggggttcatgatccaagtttaacaccaacatttggctctatagaacccaggatttctaaaatacagcggcgggtcacgacgcac

SEQ ID NO: 597141 - DNA, 346 bp, Homo sapiens
  misc_feature (116)..(116): n is a, c, g, or t
  misc_feature (123)..(123): n is a, c, g, or t
  misc_feature (247)..(247): n is a, c, g, or t
  misc_feature (278)..(278): n is a, c, g, or t
  misc_feature (285)..(285): n is a, c, g, or t
agaagtcagtgaagcagaaagcccagttcttgacctcaaggacatgacttctgtcttgttagcacagcacgagtggttaggaattggcaaatgatatgggtgctgcaggaattcanaaggaanagtaatcacaactggggttgctgggaaagagcctttcctgccctttctgctggtctctccatctgcccataccaccatttgggagggtgtctttagaagctgcctgataatgtgggaatgtggnatctttagatgaaatcctggcaaagcagtgnaagtatncaattgagctttcatgggattggttatggcaacgactcttaccgaatttttggggcatgtg

SEQ ID NO: 597142 - DNA, 801 bp, Homo sapiens
gtacttatgtcttacataactaggaagtacttcttgggggctcctctggcctcccctcttatctcccccaaaccaccatcctgcgaaggcaaggaagtggctctccctccacagaggcaacggtgagagggagcactgtggctgccatcccagttacctcttcaatgcgcaaacagacacgtgtgactcaaaccctacagtatggagggtggcgttgcattgaaattccaggcctgagtttgatagtggatttaatgtagtagtcaaaggtatgaattcatgttttataactgtagcaggcaagcaagttttgtcatttatataaaaagtttggagagaatactttataagtttctgtgcgagcaaagtggctaagttactcattaacatacaggaaccgaatgtagtactctaaatccagctttttcttacctctggtacacttcagataccttacctaatacatatgagggcctttcaacccttagtccatatcaaattttctagtactaatctatttgacatacaactaattgcacaaagaaccaaaaatgacttcagaagttccatagatggatctgttgccccttacttaatttttctaccacaatgaaaacatttagaagacattggcagtcaaactgtcttatgaccattgcaagttgcttagtgctaagaagcagagacgatcaagggcctggattaaggtggtcaacaatgatgatggggtgagaaaactggtaagaggaacagtgaacggctggagtgcaattaaaacagacggctgaaggaaagaaaacg

SEQ ID NO: 597143 - DNA, 183 bp, Homo sapiens
tagatttcgtttggttttaactggctctgtcagggttccccaaacagctcaaccctccatttacattataatgcaaaagctcttccctgtggtcccaggcctgtggggaaaatggaatccggctcaaacccaagatccaaagctaaagtgcccccaggttgtgctgcctgacagttttataga

SEQ ID NO: 597144 - DNA, 620 bp, Homo sapiens
gcccagccgtgcccccccacttctgctacctctcccaatgcagtggccgcctgaaccccaacctgtattactgtgtcgacaggtgtgtcagcctcctgggcaccctgcgcttcggaacacgtgcggaccacgagacggtgcacaatgcccagtccagccattctccacgcgtgctcatctccagtcccacccgtctcgatccatggtcacaatgaaccatactaccatcggaagcccagagcttccgcacaccgttgacctgagggccctgccaccggaacgtgcctcatgcaacaaacatgatccgcctgatctacaacaatgcacaactgggccgcatacgatcccgcgctgctagccagctccaaatgacactcaagcatggctgccgcgctgagaaccccccaacggaagctcctacacagacgacacgcagtcagaactgacgcgacaaacgcaacctacttagacaacctagcccttgtgcactgcgccgcctcctggagctgacacccacgcataactcccaacgattcgcctgcaccctgagcaacaacccccaatgcaccacgtgccttgccgagacaacagaccccagggccaacttgccccaaaccagg

SEQ ID NO: 597145 - DNA, 348 bp, Homo sapiens
taataatttcaacttgtagtttagattctgagagtatgtatgccagtttgttgcatggatatattgctgaggtttgggatatgaatggtcccataacccaggtggtaagcatactaaccactagatagtttttaaatcctaccctctgccccactagtagtctccagtgtctgttgtgccatctttatgtccatgagtatgaaatgtttagctcccacttataagtgagaacatgtgttatttggttttctgttcatgcgttaattcacctaggataatggccttatataatgaagcccagctttcaaaaaccagaaattacagacacatttttttttaaaaaaggtc

SEQ ID NO: 597146 - DNA, 842 bp, Homo sapiens
  misc_feature (76)..(76): n is a, c, g, or t
  misc_feature (349)..(349): n is a, c, g, or t
  misc_feature (387)..(387): n is a, c, g, or t
  misc_feature (438)..(438): n is a, c, g, or t
  misc_feature (451)..(451): n is a, c, g, or t
  misc_feature (550)..(550): n is a, c, g, or t
  misc_feature (707)..(709): n is a, c, g, or t
  misc_feature (711)..(711): n is a, c, g, or t
  misc_feature (715)..(717): n is a, c, g, or t
  misc_feature (719)..(720): n is a, c, g, or t
  misc_feature (723)..(723): n is a, c, g, or t
  misc_feature (726)..(726): n is a, c, g, or t
  misc_feature (729)..(729): n is a, c, g, or t
  misc_feature (743)..(743): n is a, c, g, or t
  misc_feature (758)..(758): n is a, c, g, or t
  misc_feature (768)..(768): n is a, c, g, or t
  misc_feature (770)..(770): n is a, c, g, or t
  misc_feature (774)..(775): n is a, c, g, or t
  misc_feature (779)..(779): n is a, c, g, or t
  misc_feature (783)..(783): n is a, c, g, or t
  misc_feature (794)..(794): n is a, c, g, or t
  misc_feature (805)..(805): n is a, c, g, or t
gggaggtgggagggaagggcttgggaaggggatgaatatctctttttacctttaacagacttgtttaatcttctcnatgtagatgtttatgtaggtacttcacattgcaaacgccttttattctatttacaagctcagatgtctctgctctcctgaatcttgggcatgcctttctgtaaccaaaaatccctgtaggcgtgctagcaattccagggtggtccgggtttggcagatttgatttttaaaaaacgtattatctttaataaaatgttattatgtcaaccagtgaggctgccctgaacaaaaaaaaacaaaaagaaaaaaaaaaaaagggaaaagaaagaaactngttaaaaagaggctttccaggccccttatgtttttggntgggaaaaaggaaaaagaagaaaaggcaatctcgcagtacattgttacttngtcggaaaaaatnccgggacaaggattaccctgtgttttatggtttccaggtatcctggaaaataccagtgtgtgggcagttctcgcagatgttacctaaaactggctgaanttgaccgggcagaatggtcctggccgttttctggctccctcgacacttgatgggagggctgtcgacctctcctcccgtgggggcttccccagtgcctatcttctctgatagtcatgggagaggttaccctaatttcatgggagatgtaagtggtggnnngnaagnnngnntanganaanttttttactttttnatagatatctatcgntatagaatangnttannaaangagngtttagaggangcccaaattcntgtttaaatttttatggaatggaagttctggtccggg

SEQ ID NO: 597147 - DNA, 293 bp, Homo sapiens
ccaagatcatgtcattgcactccagcctgggcaacagagcgagactccatctcaaaaaaaaaaaaaaaaaaaaaaaattggaattattttactattataatttaaaagagagggtattatatttatagcagttaatcacgtgaagggttattttatttattccagcattttttaataaaattaggcctggttagagggtttccctaaattatatttattttacctaattgcaacagcaattttttttggaatttttttaaaattggattgaattgacatttggttacattatt

SEQ ID NO: 597148 - DNA, 414 bp, Homo sapiens
  misc_feature (303)..(303): n is a, c, g, or t
cacatgcttccacataaatcagcaaccgaggcctgtcctttttgttttggtttagtttatttcttgttcatgtaagactcttaacctgacaaaattttagcaaaaagggactaacgaaaaaccatttcttctgtccattacttgcattttgatgaaccacgagggaaaaaatagttccaattcaccaaatcatgtatgtatggattaataattttgagacaggtttcattttattgcccaaactgcagtgcagtggtccgatcaataatcactgaagcttcaacctcctggggctcaaacctnttttccaccccaaactccaatttttttaagttttttttgaacagggttttggttatgtggccaagttgggtttattaacaggtttgaaccaactttgcccggttttttttt

SEQ ID NO: 597149 - DNA, 696 bp, Homo sapiens
  misc_feature (1)..(1): n is a, c, g, or t
  misc_feature (31)..(31): n is a, c, g, or t
  misc_feature (47)..(47): n is a, c, g, or t
  misc_feature (128)..(128): n is a, c, g, or t
  misc_feature (133)..(133): n is a, c, g, or t
  misc_feature (171)..(171): n is a, c, g, or t
  misc_feature (205)..(205): n is a, c, g, or t
  misc_feature (217)..(217): n is a, c, g, or t
  misc_feature (225)..(225): n is a, c, g, or t
ntacacactcaatctggattcaaatgactcntgcctggttccagtgntgggctgttcccctgtctgagctttggtggcttttgattgaccccttccctgcccaggcatgaaggtggagtagcagaagngaagnatgcgggtgtataaagatgtcatcggggctgtctgtgnatggtgggtaaagagacagcacctgtcatggtgnaaggccacaagnaagcgtgnaggctgtttctggggccacctcctgcctccaggaggaagcagggatcctcctgttggcatcttggtcccatcaggtgtcttggatggggctggggctgggagtgtttctctccctgagcatttaagccaaggttcattatttagaatggaaccatttataggccgggcgccattattacattattcctaaagtgttaggattacaggtgtcatgcctgtaatcccggcactttaggaggctgaggtgggtggatcacttgaagtcaggagttcgagaccagcctggccaacatggtgaaaccccatctctactaaaaacacaaaaattagctgggcatggtggcacacacctgtagtcccagctacttggaaggctgaggcggaggactgcttgaactcgggaggtggaggttgcagtgagctgagatcgcgccattgcacttcagcctaggtgacagtgagactccatct

SEQ ID NO: 597150 - DNA, 283 bp, Homo sapiens
cttagtcttccccacaggttatatgtggcttctgacacataattcttaatgtcaagagtttttaaaaagctacaaatttaacacaattacagaattggtagaggtatgaaacacagactgcaactatcacatctgaacaaagttataatcccagcactttgggcggctgaggcgggcggatcacgaggtcaggagatccagaccacggtgaaaccccgtctctactaaaaatactaaaaattagccgggcgtggtggcgggcgcctgtagtcccagctactcg

SEQ ID NO: 597151 - DNA, 1080 bp, Homo sapiens
  misc_feature (409)..(409): n is a, c, g, or t
  misc_feature (523)..(523): n is a, c, g, or t
  misc_feature (665)..(665): n is a, c, g, or t
acatccgccttggtgctgatcttcatgaatctgtacaaatcccataagactgcatctatctactaggaatgagagttgcgagttgcactctagcaaaatcatttctctagtactattagtcacatcatctgtgtatttgattgttggttgcatcaggaatttggctagatagtcgtgtcgtacgttgtgtcatagtcctcgtagagttaagcacgccacagtcccgttgagacgaaatcggtcgattgtcactctttgagacttaccttctatctgtttatacttagtgggacctctaccactttgacggtactgttctcctctcagagtcattctctgggaacgtgcttattgtgtatctctgaagcccattaacatatcagatgcgttaccttggatcaccaaccgngggtaagggcactctgatatggagtgcggaattgagcgcaacgatatgaaggacactgcgctagatgtgccgtttccaacgtaccgatgtggtgatgcccgaataatcgcaganaggcgaagttgtaaggttggggtgtaagtttgacgtcaccagtgagctttatttccccgaagtgccaaggacttcacagtaaggattctaatatgcgacagggacaagttcccctaggaacccaaattgttaggtacccaanggcgggccgttcttggcccacgagtggtaggtacccacccggaggcgtttccggtgaacgattccttgcagcagcaagagcgttgtcaaccgtagttgtgttcgttccagcggcaacgtggacttctgcacgaatggggctcttcccacccaccaattagggggagaggcggcgaggtctttggagttcgcgccccttcgaagcgggggcagcgccttttagaagttttgtgtcgggcgccactgcgttcgttaccgccgctgccggcgttatccctttgaggaataactgggagaggcttgcctttgtgccccgagcttgttgggttgttcgccttttaggggttcctgggggacccctttcgcgtgggctttttgctttcgttatgcgcttgttggctcgccgttggggcccc

SEQ ID NO: 597152 - DNA, 495 bp, Homo sapiens
  misc_feature (18)..(18): n is a, c, g, or t
  misc_feature (37)..(37): n is a, c, g, or t
  misc_feature (54)..(54): n is a, c, g, or t
  misc_feature (68)..(68): n is a, c, g, or t
  misc_feature (191)..(191): n is a, c, g, or t
  misc_feature (198)..(198): n is a, c, g, or t
  misc_feature (211)..(211): n is a, c, g, or t
  misc_feature (216)..(216): n is a, c, g, or t
  misc_feature (344)..(344): n is a, c, g, or t
  misc_feature (419)..(419): n is a, c, g, or t
cccctaaaaacctcggcnacaaaggctgttggccaantgtaaaggcctgccccnctgtgtgtggtttnaaagtaaaactggaaaatgaagaacaattggaccgtgcctggctccctcccagaaggtcctgccacactcccacttccacatgcccgttgaactcctccacagtcctaaagaccttccagggnccgggancctttgtcccagncctgncacagtaagagtgaggcctgccctctccccgcccaggcattgggatccccatttagaaacggcattcacttcagaaggtactttttaactgctcagtttttgactattttaaatagtttgctgaaacncctgataacacttgctacatatcatgttttaattgcttgtacagttaacctttaattttatttagtaaagtgtancaaagtaggactttttgaattgtaaataggtggttttattaaataaaagtcaatgtaaaattgttaaaaaaaaaaa

SEQ ID NO: 597153 - DNA, 184 bp, Homo sapiens
cctatgctcgttcatggcagcggtactcctcatcaaaggacagcttcataacagcacaggttgcctggcagatctgcggctcgatggggatcgtggctgtgtggcacagtgaccagatcagagcccccattcccaggaaatgtcccagcccagtgcttcacatgtcctccccagtgcttcatag

SEQ ID NO: 597154 - DNA, 432 bp, Homo sapiens
ggtcaacaaagcaaaacgcacctggagagcctggtggccggccctgcagcacagtctgcagccgacacctgctttggccgtgggaaaaccatttaaatgggaggaaaaacccaaaagggtgttacaggggggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggcaaggggtctgtgtcttgtattgatcccatcagtgcccggcactcccttcac

SEQ ID NO: 597155 - DNA, 416 bp, Homo sapiens
  misc_feature (166)..(166): n is a, c, g, or t
  misc_feature (168)..(168): n is a, c, g, or t
  misc_feature (170)..(170): n is a, c, g, or t
  misc_feature (177)..(178): n is a, c, g, or t
  misc_feature (180)..(180): n is a, c, g, or t
  misc_feature (259)..(259): n is a, c, g, or t
  misc_feature (272)..(272): n is a, c, g, or t
  misc_feature (334)..(334): n is a, c, g, or t
  misc_feature (346)..(346): n is a, c, g, or t
  misc_feature (355)..(355): n is a, c, g, or t
  misc_feature (375)..(375): n is a, c, g, or t
ctcccgagcgtagatggaaggagcagatatgacataaatcccttgagggtctacatcttcagggcgattccaatctacggacgagctcggaccatccccggaaccctcctgcgtccttaggttgttgagtgcatccgggagtgcgtggactgacggctccggggtncnanccagcanncnagacccagcatcctgggagtggcacggcggcgcacgtggaccagcaagagcgcagcgccgccacgccgcggccacgagnagtcccagaccgnaggcaaaaggtagcgctgagggttcgcctgagcccgggccgcgggcaagcttgcgccgtcgnggtgcactgggnactcacacncgctcccatgtagccggganaagcgcagacgaggccggagaagtgggcgtagcagaggtcc

SEQ ID NO: 597156 - DNA, 340 bp, Homo sapiens
gaactctagctcggtacccagccgcgtcgattgccccaccaacaacaccagagatagcagaaacaacagaaccagccgcgccttggataccctgcactagaccagcaatgatttgtgaacccattgagaccatctgcccggcgatacctgtaatggtgctaatgatctgtgagcccatactgataaatgaagcgatgacgctttgaacgcctgctgtgactgcgctcaggaaattggacatagctgcactcactgcggaaacgacagatgagaaaatactcgatactgtggaaagtacgctagaaagcacgctagagacgacacttagcacggcttggaa

SEQ ID NO: 597157 - DNA, 233 bp, Homo sapiens
ggtccatatgcagtcaagcaagtttatcccagtgatcgaacaagaagatgcttggggaaaccagattcatcacactctttaatcatgcctgatgaaatccatagaccttgtggctgatgaactcagccctggaaggcagacatcacatgaattcacacagcaaggcattgtttcctagatttcttacacccattccatcaagtgggatcctcatagatgtctgaccttgcagt

SEQ ID NO: 597158 - DNA, 104 bp, Homo sapiens
ggctgtaggacatacttctaggtgggcactagtgcggaaaacttgaggatgaaatcagtgagctagcatgcacttgaaagcgcatggccgtgtctcctacacta

SEQ ID NO: 597159 - DNA, 432 bp, Homo sapiens
ctgatgacggagaccacgaggtaactggaaattcccaaattgcgctaaagaaaaatactacgagactagagaattttttaacgtaacttactaagtgtaagatgacaaaatttgactttcgggatattctagcgttaattttaccgtccgcctaaatgtgggcaaaaattcacagcttacgttatattaagcaaatattaacagtggctattatttgctgggtggtgaaatttgataaaaaaattaaaagttaaaaaaaattgtttagatctttaagtgtcacattgacttatctgggacatcgctttatttaatcctcacatgagatttggctaagtatatttttcacaatctgttaatctcacaaaaactaaagctgtataagcacagttaaaacccattctgcagggctaagaaattcatttgtaaggc

SEQ ID NO: 597160 - DNA, 852 bp, Homo sapiens
actaataaaccctttgatacttttagccagaaatcagtctcataaagctatcttctgagtatagtttgtgtaaaataaaccagtgtttagcttcggtgaactaactttccacaagcctgaacctcccctctagcaagcaatattctcttcacggtgcttgttactctctacttactgcgaccttccagactactgcaccttgtttcgtgacacactattctcccgctacacacctttctcttcgttattcttctgccatcttgaaaaagggtttgtggtgtactgttcgggtctgtacactttaagctctgcagcactttccacccctgctgcttagcctctcgtacaacatccaaacaataatacggttgttctattggttctcctggtatatcgtcactctccatcgtgcaggctctggaccctggtaaatccccagttgatcctttcctagcgtaccactcgtcattctctctttccaactgttttcacaaagaacgcaacggacggtgtgcacctatttccagtgacatgctggtttaacctaactccctgttaaccgaagattgaattctcatgttccacccagcaaattcacatctatgttttccccgctaacacttgatgataccaagtcgaacagcactctccactcctggaaccttcgacagacctccaccactttaacggctcccacaagtggctctactcagctgaacctctaggtactaccttctttacctctcgttcaacccatttgcggcgctcgtcagctcttctcacacactgcttggcacattggcccttcttactctactgtcgccctcgcccctgtacgggacggcttacaac

SEQ ID NO: 597161 - DNA, 752 bp, Homo sapiens
  misc_feature (588)..(588): n is a, c, g, or t
ggcctagaaataaacatgctagcttttattccgagtgctaaccaaaaaaataataccctcgtcccacaggaagtctgctcatcaagatattgtcctcagcggcaaggcaaccggcagtgccatacatccttctaagtagactagtcgctctatcaatgcaagtagttactcctccgtgaacgaatgggaagacaatagaccaagtatcgtaaccaagtcagatagcatcatcagtctaaatatgtcataaatggggtatagacaatgaacagcgtaggaatagactccccttttcacttctgagttcccagaggttaccgaaggcacccctctgagcatccggaccgtgccttcgttctcagcatgaggaaataactagcccccatgtcaattcatatatccaaatctctccctcactaaaacgtaagccttctccgtcactgctcgtcaaatcttagtccactcactagacgaggtcaggtgacggtgggatgaaacgcgaaagtccagatacgcaaaatcttagcgtactacctcaattgcccacatgagggatgaataatagcagttctaccgataaaacctaanattaaccattgcttgaatttaacggagtttatattatccctaattactaacggaattcctagtactgcaagttaaagtccagcgacagtaacctactaatatctggactgaaaggaagtaagagactaaaacccttaattgcatcaaccttctctgcctaaggg

SEQ ID NO: 597162 - DNA, 431 bp, Homo sapiens
attgtaacagtccaggagttcaaggttacattgagttgtggttatgctgctgtactctgtctcaaggggaaaaaaaaaaaaaaaaagggttgaaattgtatttgtattttgcgtatgtacttaaaagctaacttgagtcaaatgtgactcctggagtaggtaattccagttaccacttacagggtttttctcctgccccaggcactgtgcaaaatcccttttattcatttttaacaggcaaatattatccatattttgtaaatgaacacactgaagttcaaagaagtttcataactttccctgtttgggcacggtgggtcacacttgtaattctagcactttgggaggccaaggtgggaagattgcttgaggtcaggagttcaagttcagcctgggcaacataccgaggccctgtctctccctatcccccc

SEQ ID NO: 597163 - DNA, 625 bp, Homo sapiens
  misc_feature (49)..(49): n is a, c, g, or t
  misc_feature (95)..(95): n is a, c, g, or t
  misc_feature (102)..(102): n is a, c, g, or t
  misc_feature (110)..(110): n is a, c, g, or t
  misc_feature (112)..(112): n is a, c, g, or t
  misc_feature (135)..(135): n is a, c, g, or t
  misc_feature (182)..(182): n is a, c, g, or t
  misc_feature (184)..(185): n is a, c, g, or t
  misc_feature (191)..(191): n is a, c, g, or t
  misc_feature (210)..(210): n is a, c, g, or t
  misc_feature (231)..(231): n is a, c, g, or t
  misc_feature (240)..(240): n is a, c, g, or t
  misc_feature (257)..(257): n is a, c, g, or t
  misc_feature (293)..(293): n is a, c, g, or t
  misc_feature (297)..(297): n is a, c, g, or t
  misc_feature (302)..(302): n is a, c, g, or t
  misc_feature (351)..(351): n is a, c, g, or t
  misc_feature (353)..(353): n is a, c, g, or t
  misc_feature (362)..(362): n is a, c, g, or t
  misc_feature (364)..(364): n is a, c, g, or t
  misc_feature (376)..(376): n is a, c, g, or t
  misc_feature (396)..(396): n is a, c, g, or t
  misc_feature (405)..(405): n is a, c, g, or t
  misc_feature (407)..(407): n is a, c, g, or t
  misc_feature (533)..(533): n is a, c, g, or t
  misc_feature (611)..(611): n is a, c, g, or t
ttctcttccttgagggggcttcttaacgttttccaagcgcagtgcagtnagcgtggtgggaggcgtgcgcggctggtgccgtgcgcgaacagctnccaaatngactgccnangccacggtgcttcttgtgtcccncccagcgagctttcggttgtggcaggcggccaggaagggccatgagnanngtggcntgaatgaaaaccgagggcngaagccgagcgtgactccctngcctaagcnggggctcggtccgaggnacacgcatgggcttggccagacacaaaccaagagantgcnatganagatagagcagaaacctcccgagcactgtgttcaagctaagctttcctnanatgggcttntnaggcgagatgtnatatcagataccgtcgcatnttacttggngngaacagagacgtgcgggccacagcggcccaccaaaggctgccatccaagctgagttccgcagcctcacctgcagctggagagggaccttgccctgatcctcctggtaggtacccgctaagggattnaggacagagcgtcacactgcacgcagggtcctccgccaccaccatccaagaaccccggggggctggccacgcgctggnaactgacaaggagt

SEQ ID NO: 597164 - DNA, 857 bp, Homo sapiens
  misc_feature (361)..(361): n is a, c, g, or t
catctcacgaagctccttctgcatcttggggtctggaaggggtgtaccgagagaggtaggatgcatctccatcccacaaactagcctaaacctaagcaactatccaaggagccctccaacgcagctggaggcatcttgcccggagggttgtggaaatgcttcggtaattccaacatctgtatgcatgctgctgttaagccaactagctccgcgacgtcctgggaggtgcccttgaagggtttgggctcggaggtgagggcttgctgcatggagacgactcgtacgtaccctcgttgttccccgaattcgcggaggagatcatggggcttaatccatttcttgatccagaagtcaacccaanaaaacacaaggtccatggggacaaaaggttccgcatggcttgtatgtccgtaagaaaatggtgggttgttaattagttttggccggcgaagcccatctgattgggaaggagtgccaggaccttcctagggtttcaagagcccggagggacccccttgaaagaggaaacctcggcctaatacggagttagtacctgcgtaggtactctaaacagaaggcgcgatcgtggtcagagaggcgctttcggttgaataatcgccataaataccaccaggtagcacgtgtgtgtcatcgaccaacgcaacgggtaattggagataagtgcgccagtccagcgggtaaaggggccgggagactttttcgatcccgaattcccttttacaatctggatgaacttgaataagataacttggataaccaaaatgaaaggggagtgcttgtgaacgcttggccccctcgtttggggggaattcccggatgggggaccccaaattctg

SEQ ID NO: 597165 - DNA, 291 bp, Homo sapiens
aatcttttaatcaatcgaaaccttaataattaggactgataatagtgatcagtgattgaacctttattatttaccagctaatatagtaggcccataaataggttatatcattcgtagtcacaataaccacatacatcacacaccatgacgtagcgctactacccatacctgctagcagtcaaggttcagataatcataacacgcccaacatctcattgatagtgagttatccaaacaggaacaatctcaagtttatatctaaagcccatgttcttttgcttaatattagag

SEQ ID NO: 597166 - DNA, 346 bp, Homo sapiens
ttaataggcttctcgcctctaagatgtacaaatgcacctagcccacttctataccacaagagcatcttagcgccccttatcaccatactagttattatcgaaaccgtcagcctactcattcgaccaatagccctggccgtacgcctagccgctaacattactgcaggccacctactcatgcacctgattggaagcgccaccctagcaatatcaaccattaaccttccctccgcagttatcatcttcgcaattctaattctactgactatcctagaaatcgctgtcgccttaatccaagcctacgttttcacacgtttagtaagcctctgcctgctcgccaactcat

SEQ ID NO: 597167 - DNA, 190 bp, Homo sapiens
  misc_feature (135)..(135): n is a, c, g, or t
  misc_feature (149)..(149): n is a, c, g, or t
cctggaaggttgaggctgcagtcagctgtgatagcactactacactccagccttggacaacagatggagaccagtcctagctactcaggaggctcaggtaggaggatccttagcccaggagttcaaggctgcagngagctgtgatagcnctactgtatcaagcctgggtacagggtgaaccccgtctcca

SEQ ID NO: 597168 - DNA, 139 bp, Homo sapiens
ggatcccgcacatacttcgtccaccatgacttgacttgaagaagtgtatggtcattcggcgtgtgcagtatggaccctcggcgtcacgccgagggacctaacacttcttaaggtcaagtcacaatggacgaagttgttg

SEQ ID NO: 597169 - DNA, 352 bp, Homo sapiens
tgacgtgcttataattttctagttctttctcccatttaatgtatgttctactttctacgatttcctctttttcttccagtatatctatttagcattttagatttgtccatggttattttaaatttcccagagctgttttttttttcctcctttaaaatttgtaatatgttcttacttcataaatggagtatcctctcattcacctgcttttagtttttgattgtgctaaaatacactttatgtaaaataacatcaccacctagttacataactttttcatcatcccagatagaaaccctatacctgttaagcagccactgtcctttcttccgtctccccaagccacggtcaa

SEQ ID NO: 597170 - DNA, 1013 bp, Homo sapiens
  misc_feature (315)..(315): n is a, c, g, or t
aggtgattatatcccgtgttcgtattgtgtgtctctgaatgtggtttgttgtgtatgttgtgctgcgttttgtttgcgtgttcggttcttctttggtttctctatgtgcttctgctgagcacgggtgtgtcgtgtgccacagcttgtcggtacgcgtgtgggggagccgggtcccgccgtggctggttagcctccccggattgtgttatccgctccctatgggccctttttcccccccttccggtattgcgtgtggtccgtgagatactcttggtgcgggggtaatccccccgccataatctcttctcgtgttgngcgaatcactattaacacgaggttttaccacgtcgtcctgggttcccgcgacaaattcctccgggtttttcgtcttcctctccctcccgggggtctttttgcaccccaggatgttccgccgctggttcttatcatcagcaagttcatcatacacaccgcgcctgggtcagctgcaattgtacaccaccctcagacacagttgccgtctttctccaggtaaggtattccccctcatctgttccccgcctcgcatcagttctcgcctcgccacgtattcaacgccgcgctgtatagtcggtgccgccctctcttcggttcaggcattgatatctattcagaagggtcctccgcttgagtagcgagatctcccacccatcagcgcaccaggaggagggtcgatagacgaataagcgagcgacgagcacacatacagtggccgcagagggtggcacaccacgccgtggatacacagagagacacatactctgaatgatcagccccagcgcacatagcggggaacatagcaacgctattgggagttctcgcacgctctggcccacaccctattcaggtgaccaccccgccccaccacatggggaggtagatatccctcaacaccctcgggggaccaccgcgcgaagtattttttttgtcggttattttttccaaaaatggggggacaccccccacaagataac

SEQ ID NO: 597171 - DNA, 852 bp, Homo sapiens
acatatcttgtcacagagatatcatcagcatagcagaggatgaggacctcaggatcactttgaggaatccagcaagctagaagaccatgctgcggaaagtgcgcagccaaggagaccaggaagcgagcaactcagcaggttaaagctgaagacacaacaaagatatagtgatctctgtgggcatatataatctggtccagaaggctctcaagacctcctccaataaagctctatcgggaaacaaatgaaccagtgaaaaccaagacccggacctttaatacaagtacaggcggtagcattcatgccataacgataccaagaggtctcagatctatgggagtcgatcagataactacatggagaaagaggaaacagacagacgctacaaacggtaagaatgatccaggaaaagacagctccatgggctacaaacgccagaggtacagcatgaagaaaactaccaattacactgaaggaccatcaccatgtatcgatgtatccacatgagcgagatcagaattggatgaatttggggagctcaacacgcgttcaagatgctcttgcatcaatcaaagtgataatagggaccgacagagaagaggaagacaaccacatggtgacaaaaatacaaacaacacgccagaccagggaacaatcacgatccattaataacaaggtgggacaatgggacgacaaaagggaagaacgacggaaggacaatgaccaaggatacaactcaggggtgaaaacaacaagaggtcagaaaataggactcaataagcaaccatgcctggaggaatcaagagaaaaaagacacaataaagaaacacaaatgaacaacacaaaccagag

SEQ ID NO: 597172 - DNA, 274 bp, Homo sapiens
aaatccttcatgcaggtagaagcccaacgcttgcgggttttgttcgatgacgtccaggtactcggcattcagttcgttgatggcatagcgcagcaggcgcttgccaacaccctggccacggcgggtaggtgcgacgaacagcatgtccacccgcccgttggcgaccccggcgaaaccgcagatccgttggcggtccttgcagcaaatcagcatcactgcgtcgaggtagcggcgcagcacgtgttcgcgcagcagcaggatgtagccctctggc

SEQ ID NO: 597173 - DNA, 1130 bp, Homo sapiens
agcgggactgaaggttcgtgccctggcaccgccctgagtccccagtgcgctagctgactggggtggttgggaccgttagctcgtgcaggctggcaggctccggggcgctactccattggcggcctgggatggagactatgcgagcgcagcggctgctagcctggtgtgggcaccagcggcgaggggcactctccaagcgctgcggcccgggacggtgaactttggggtgcccagctgggctttgccccaacctggccagcaaatctcgcattgactagagtctccacctgtcccttctactcaacacacgccactgacctcgcgccttatccccacctgtctactccccactactatcacccaatacgccgggggtcctgccacctcgcttgtaaacactccttaggccacctctctgtacacaccccacaacccccgccacgtcggcccaaacaaggagcacacgcccccccgccccccccgactccaccacgaaatcgcagtgcaccccccgaccataacgaacgaggacgcccgcacgacccgcatccactaccacacaagtctgtccctacatccctctaccaacattcactcctccaacacctcaaaacctcacctcgcctaataaacccaccctcaccaccacattacacccgcaacagaccacccaacaacatgtctctcgtctcaaaccttacacaccgacaacacacgccctctacccccacgcctcggcataaccagcagtcggagacactaccagccaaatccttcttaccccaactcgtcgaggtgctttgaccaacgaccctacccaaacttgcggtagaccgaacaactacatacctcatgacacaatcacgccgccacctaagcacaactccccatctgacatacctagccaactgggctaccacctgcttcccagacaccataccgccaccagactctctgtgtcacaacacacaccccaatcctcaccactgacttcttcttagacgagcaccagacacacacctgtcccaacgtcacgcccagcacaaacaaaacacagagacaacgacctccagcttcggctcactagtcagatcaaccaccacacataccacgactcactgtccgcaaac

SEQ ID NO: 597174 - DNA, 476 bp, Homo sapiens
gaggatacacagtgaaaagactataaggaggaatattacatgctcaacaagcgtacgtgcatatggtttaataaaaaaaataaaaaaaggagaaaagtgttaagctgtaaacgagtggctccatatgccatatgtagaattccatccctctctgtatgcagccattgttgactatttttttgcatctttcccgatattgattaattacatgggcatatagaattatgtatcacatataaatctttataggtttgctgcatctgactcccccgatcctatttaatatcgtgtcaggacatacagatgcattttgttaatcaacagtgctacctttgcacttgcttatggcacaggcacaataggagcagttaagcagtagaaccatttactattttgagcagactgtttcttcaaaaggatgatgaactgatacgttttctttacaacctgttacgtttaaaaattctgttgacttc

SEQ ID NO: 597175 - DNA, 815 bp, Homo sapiens
  misc_feature (147)..(147): n is a, c, g, or t
cgcccttccccttcccgcccgctccccttttcccctcagtcgcctcggccttgcagtttttggctttcacccccaaccagtgaccaaagacttgaccactcaaagtccagctccccagaacactgctcgacatggacaccggtgtgnttgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagagggacataagcagctctatgaccaatagcacagctgccagtagacccccggtcaccctgaggctggtgggtcccgctagtcagtgtggctctctcatcggaccaaggtcggcatgcaccgatcaaggacaactacgagagagtacaggggctcaggtccacggtggcagggcgatcatgctacccaactcaactgaccgggccatcacctatcgccggcatcccacacagtccatcctcgcagctgtcgctcacacaacagcatctgcgtgcgtcaatgacgcgacacctctctccccagtcacccccaccgaagggccgtgaacccatcccacctaacacgggcccaagcacgcaccaagcatctcacgagatacatcatcacgccagagtggcgtcagcgacgcgggtacaaggcacacacgccagcgaccacgcgcaga

SEQ ID NO: 597176 - DNA, 846 bp, Homo sapiens
atgcaaggtcagtctggatgattactgtccttctgaccaagttgacactattcaagaaaaggtcctcaatatgctacgtgccctctatggaaatctagacctccaagtgtatgcagcagagtctcctccatcttgaaacaaacaaaacattaggctcctgtgtatctggtttagtaacaggcccttaattaacttatttgtacatgagtcttccagagaacactgttttatattaactttcagttgaaatctttcagatatttgaatctctgaacaaccatagtcagtgtgaatgatggtaaatttttggcatcaagtctcataaccccaactgatagaactgttgcttatctgtcttccttaagtatttttatagggttatagtgataaactaaaatggtacggtagagtagggttggtcttcacttttcccccaggtctgttgagctgtatgagattcattcatacttcatttattcattcaactaatatttgtcggaacacttacatgtaccagacattacttaagtgctgggatatatggtaatgaacacgaatcgacaaggcccctgccccttattaggggagacccgatgacgacagtaaataaccgggtactgagaacacgtaatgaaggcaaaggaccgacaaaccgaccatgtcttagaaactacaggcaccaggggactttatacggacagaaaagaacgccaacctctcaatagagcgacgccgaacaacacacaagcagggggccaccaccagaaagcccggcggcacaacgccggggcacaccagacaccagatcaacaccacaagcccccactcaaacaacaaccacacaaa

SEQ ID NO: 597177 - DNA, 143 bp, Homo sapiens
gttccctttttaaccatatacaactataaccttcataaaatttctcttcaaattctgtctgttacttttcagcacagatttataaaatagcatcctaaatttctgttttcatagcctctgttcctgtccatctgacccatctt

SEQ ID NO: 597178 - DNA, 584 bp, Homo sapiens
  misc_feature (147)..(147): n is a, c, g, or t
cgcccttccccttcccgcccgctccccttttcccctcagtcgcctcggccttgcagtttttggctttcacccccaaccagtgaccaaagacttgaccactcaaagtccagctccccagaacactgctcgacatggacaccggtgtgnttgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagagggacataagcagctctatgaccaatagcacagctgccagtagacccccggtcaccctgaggctggtgggtcccgctagtcagtgtggctttcattggaaggtgatcaagacaaggaatcgggaagtcagggcctagccagtgcagggtattcccactacttcgggcatcttttcggatcccaccttattgggttaacgatctggcattgg

SEQ ID NO: 597179 - DNA, 1287 bp, Homo sapiens
gattgacagcaaggcgtggcgggagactctgaccctgcagaagcagctgcggtacctgctttccctgagctggccagacacctgacacctgctactgggttcagtgttcatgccacacagctggatttctaccaccagctggggcagctgtgcagtggcccataaacaaggcagccgcctggcaagcgcagtacaggtgcttacaaggagccggcgcgtgaccaaggcatatacctggcatatggtaatgacctgcatgcgggaggacacaatccagggagacgccgggtaaaccatcagaccatgccatatggcaggaaacagcacggagggccgggacccacaaccatgtgcatcgagggctcgacaggattgtgagaacccgaaagccaagcctcacagattctcgataggtactggaacaaagggactgtacgacagagcgatccatgtcatccaaagatgcccgctgcacgccggctccacggtgcctgtgacaacaccaagaatgacgcagtgcactggcagttgacacatggagccaaacaccagttgaaaggggcgaacgctgacctaccggagaagtctcgaggcccggagagggcccgggcggatcagcagatggattgtaggagacagacattaaatacccttgcaggcaattccacccaagttggaccaccagaagatgtgtggaaggtacatgagacgccttggaaccaactaccatgacactaccactgggatgccctgatgaggagcccaccagcaaagtgaggccagatccagcatgtaggaccaagctacagtgatgccaaggcacataaagaggacaccaaacaacaagataaccagtgtaacacccggagggacaaaagagagcacaaaggaagagaacgcaccaaacgcgaaacatccataccgaggaagcacacaaacggcacagataccaccgaacaacaagaacaagataacagaacaacaagaacacaccgtacagaacaagaagcaaggacacgaaccgagaacaccgcaagagaaaaccagggcagagcgacggaggcgagctcacacgaggacacacatagaaacaggcaagagaggaagagaagggactacggaaagcaaaacgagaagaaggacacaggaagcaacaagaaacaaaaaaaagagcaggaagaacacggagaagaaacagaaggagaggaacaagacggcaaaggcacaaccggtagagacagaacgataaacaaaaagagtagggagcaccagcggcgcgaggaaaaa

SEQ ID NO: 597180 - DNA, 478 bp, Homo sapiens
  misc_feature (40)..(40): n is a, c, g, or t
ggatcacactgcaacagtgtgatgtcagagcatgttacanctccttgtgactggttgggtgtgagcacctgcagtcgtgtgatgtccgaggatgttacactcttggctgactggttggggtgagtacctgcagtagtgtgatgtctgaggatgttatactcttgtctgactggttgggacgtgagcacctgcagtagtgtgatgtctgaggatgttatactcttgctggctggttggggtgtgagcacctgcagtgagtgtgatgtcagaggatgttactactcctgctgacgggttggggtgtgagcacctgcagaagtgtgatgtcagaggatgttacactcttgctgacaggtaggggtgtgagcacctgcagaagtgtgatgtcagaggatgttacactcttgctgactggttgctgtgtgagcacctgctgtagtgtgatgtccgaggatgttacactcttgctgacaggttg

SEQ ID NO: 597181 - DNA, 360 bp, Homo sapiens
ccctcctccttttttcccaagcctttttccctgccatggcaaatttgagtggcttctttaagcatctgctgggacaagtcaatgtggccccatgagcttcatggtggcagaaaaaacaatagtccttagctttcctcccaggacaccccctacttggccagtttgtaggccaacaaaaaggttcctttacccccatgcaagacccttattagaacccattacaaaatggctgaccgtggaggatgagtggatccttaaaggttgtccccaactgttgatttggaaaaaaaataagcccataaataaccttattgtgtgttgcatggaaaggaactgaaaacatttgcctttaagcatgga

SEQ ID NO: 597182 - DNA, 236 bp, Homo sapiens
tcgcgcctccaggtcctgaatgcgtacgactgacggtacacgaagcagctggcgcagctcgacggcacattatcacccatcgcagttccagcgcgcaggcctggagaatagccaacagcaacaccgaggtgctcaagaacatgggctatgccgcccaggccatgaaggcggcccatgacaacatggacatcgataacgtagcatgagttaatgcaggacattgctgcccagcaaga

SEQ ID NO: 597183 - DNA, 1077 bp, Homo sapiens
ccacgcgtcgccacgcgtcgggcaggtgttcccatgcctctgctgctcctgctcatcatgggaggcatggctcaggactccccgcccagatcctagtccacccccaggaccagctgttccagcggccctgtgcacctgaccaggatgagctgccgagcctcaggccagaccaccatcccaccataccgctggttgtctgacatgggcagcccctgagcatggtgccccgcagagccaacaccacctcctgcctgatgggacccttactgctgctacgagccccctgcccggggacatgcccacgatggaccaggacctggtccacagaccatgggtgtctacacactgtgcaggacagcaaccaggccttggccacggcaggtcagacacgagtgcgctcagggctgtcatcgtggcatgtccatccgggacgcattaccagatccagacacatcgggacatggatggcatgctgcgctgcagtgacgccagcaatacccctgcgacatgctgagcgccggcccactggaagcccaacccgagagaccacacaagaacctcactagcatcggaacaagaatagggacacccccactcgacccatccaagaccccgggaacgcgaccacacgcaggtgtacacacaaggcgagcaccacacaggccaggaccgtggcccacagacccacccagcacgacagaaggtgcacgaacaacgggacgcgaccactggtggacgcagcgcaccacaccaacaagacgccaagaacacaccacgaggacgacgcccgacgccccacccccaaggaaaccagagccacacggaaacccccaggaccacacacgacgaacacacaggcagacaacgcacaccacgacgccgaagccaacactaccagcccaggcacaaacagacgacacacaaagaagcaccctccgacaacctacaaaacgggagccccaacgactaccccagacacacagcgacaaacccacagggcaccgcaccaaagcaaaccgaaacgaacgacacgaacaagagacaccaacacaaaccaacagcagcaaggcaccacac

SEQ ID NO: 597184 - DNA, 137 bp, Homo sapiens
ggaactatgacaaaaccattactctttcaggtcagaggtgcaatgactatagattatttaaaaactgaaaagctaagcttgagtggcccaaggatcagcaggaagtggtttatcttttttcggttggttggtttccc

SEQ ID NO: 597185 - DNA, 213 bp, Homo sapiens
gaggacttaagcactgggtaagcactggggaggaatctgagcactggtgacagggacgccctgcgccacgtgcagcccagtcggtctgtgccccgtgcgagtgcactgctggatcacagactccaagcatcttctattcgtgcgccgtctgtaccctgtgcgctgcgctttcccctagccgtcagcgagatgccccgtaaataatatgaaagc

SEQ ID NO: 597186 - DNA, 932 bp, Homo sapiens
  misc_feature (93)..(93): n is a, c, g, or t
  misc_feature (95)..(95): n is a, c, g, or t
  misc_feature (98)..(100): n is a, c, g, or t
  misc_feature (110)..(111): n is a, c, g, or t
  misc_feature (114)..(114): n is a, c, g, or t
  misc_feature (116)..(116): n is a, c, g, or t
  misc_feature (163)..(163): n is a, c, g, or t
  misc_feature (174)..(174): n is a, c, g, or t
  misc_feature (176)..(176): n is a, c, g, or t
  misc_feature (187)..(187): n is a, c, g, or t
  misc_feature (195)..(195): n is a, c, g, or t
  misc_feature (201)..(201): n is a, c, g, or t
  misc_feature (214)..(214): n is a, c, g, or t
  misc_feature (218)..(218): n is a, c, g, or t
  misc_feature (226)..(226): n is a, c, g, or t
  misc_feature (231)..(231): n is a, c, g, or t
  misc_feature (238)..(240): n is a, c, g, or t
  misc_feature (243)..(243): n is a, c, g, or t
  misc_feature (289)..(289): n is a, c, g, or t
  misc_feature (306)..(306): n is a, c, g, or t
  misc_feature (311)..(311): n is a, c, g, or t
  misc_feature (320)..(320): n is a, c, g, or t
  misc_feature (324)..(324): n is a, c, g, or t
  misc_feature (329)..(329): n is a, c, g, or t
  misc_feature (333)..(333): n is a, c, g, or t
  misc_feature (339)..(339): n is a, c, g, or t
  misc_feature (343)..(343): n is a, c, g, or t
  misc_feature (351)..(351): n is a, c, g, or t
  misc_feature (369)..(369): n is a, c, g, or t
  misc_feature (383)..(383): n is a, c, g, or t
  misc_feature (403)..(403): n is a, c, g, or t
  misc_feature (410)..(410): n is a, c, g, or t
  misc_feature (419)..(419): n is a, c, g, or t
  misc_feature (434)..(434): n is a, c, g, or t
  misc_feature (455)..(456): n is a, c, g, or t
  misc_feature (493)..(493): n is a, c, g, or t
  misc_feature (498)..(498): n is a, c, g, or t
  misc_feature (509)..(509): n is a, c, g, or t
  misc_feature (525)..(525): n is a, c, g, or t
  misc_feature (857)..(857): n is a, c, g, or t
  misc_feature (867)..(867): n is a, c, g, or t
  misc_feature (884)..(884): n is a, c, g, or t
ctgcagcaccggcaccgtttccaggaggcctggcggggtgtgcgtccagccgttgggcgctttctttttggacctcggggccatccacaccgngnccnnnccctccggcnncgntncccgcctcccccgcgggccctccccgcggaggtccctcccgtccgtnctcctgctctntnctccgcgggcngcatcgcncgggcnggcgccgcgcggngggngaagctgnacggnttgagannnacngctcttttcctctgctccgggctcgcgaggccacgcgtcgccgctngagagatgatgcaggangtgtncagctcgcnagtntcgcnggcngacganagcntgagcaanagcgaggaagagccagancggcagcagctgcngagcggcaagcgcgggggangcaagcngcgcagagnaggtgcaggcgggcngcggcgcggggcccggcgganngggtgggggcgtcggaggcggcgacgagcgggcagcncggcncagggcaagcncggcaagaagtctgcnggctgtggcggcggcggcggcgcgggcggcggcggcggcagcagcagcggcggcgggagtacgcagtcttacgaggagctgcagacgcagcgggtcatggccaacgtgcgggagcgccacccaccccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctngaagatgganggggcctggtccatgtncgcgtccactagcaggcggaccccccaccccctcagcagggccggaga

SEQ ID NO: 597187 - DNA, 350 bp, Homo sapiens
ggtcgacctttgctcaaaggacaagggaaaagggagagacaggcaacccagtctaatacaatatcatatgtgttatagtaaatacaagtacaaggttaactactaggaaggcaggaagcagtgctgcttagttctttcagggcatactggatactttcacaaagacaaaaagacaagaattttgtttctgtcttgaaactaatattcattgaggactgactgtgttgaacactgggcacatatggtcacatgtgactgaaaggaggagcaggttatttcagagaggggagcctaaataaaagctggacaatttcagtgtatatttttactccaaagtgctgttggatttc

SEQ ID NO: 597188 - DNA, 379 bp, Homo sapiens
gcttattctgtgtagctagaacagatccaacagaaatcctatacagaaatccttcaactgaaaaaaataagaaagggcagaattcagctgtgggccaattcagactagcagtcccagtttcacccttcaagctgaaacaactaagaaaaccaacatacgacatggaaccccagctcaagccactggacagcagagggaggacggcagggaccctggagaggctgcagacgaagcaagccccatgctcccggctgctggctggaaaggggcccatgtgaggagggctggggccacccagactgtgcacagccacagaagaacacaggttctaactggaagctgctgctcagatgggtgattaaacactgctctaacctaa

SEQ ID NO: 597189 - DNA, 145 bp, Homo sapiens
tacacaccccaccatgtcagcctacacacccctccatgtcagcctgcacagcctacacaccccaccatgtcagcctacactcccctccatgtcagcctacacacccctccatgtcagcctacacacccctaaatgtcgtcgacgc

SEQ ID NO: 597190 - DNA, 370 bp, Homo sapiens
agatccccctttccatccatgtgttctcattgttcaattcccacctatgagtgagaacatgtggtgtttggttttttgtccttggtgatagtttactgagaatgatgatttccaatttcatccatgtccctacaaaggacatgaagtcatcattttttatggctgcatagtattccatggtgtatatgtgccacattttcttaatccagtctatcattgttggacatttgggttggttccaagtttttgctattgtgaatagtgccgcaataaacatacgtgtgcatgtgtctttatagcagcatgatttatagtcctttgggtatatacccagtaatgggatggaaagggggatctgggtaccgagctc

SEQ ID NO: 597191 - DNA, 108 bp, Homo sapiens
tgctgggattacaggcatgagccactgtgcctggacaaaagtgtcctcttataaggacatttgtctttacatgtagagcctacctaaaatactccagggtggagagag

SEQ ID NO: 597192 - DNA, 818 bp, Homo sapiens
tcttcaagcataattacttactgacttttcctccaaagattggcatgatatcttttgaaatttgtttccagatgcacacttaagttgagagcattgagtgtcgtgctttttcttttttgactacagctgatagtttgtcaaccccgacgacgtgggtgttcccggcacctggtcttggtgcgacttgggatgtctcctacgataggttggtcctgtggtagtcgacagcccgggatcttttggcgcacctggattgaattggccctttttcttggacgcttgacttattgtggagccagtgaacggatgtgatggacttgccttgttacacatggaaaacggggaaataccctctgtgtttccggcatcagacgggacaccaaaatcttctgggtgcatctcggggggcaccccctggtaacataaaacgttgtataaaatcacttcaaatcactattcgcgcggtggtccaccaaagaggagtcgctaacatatagaaggggcgcagttcttttcgattatattttaaagaacctctttggaacatattatcgacgactttattttcctaaacattacgaaagctaataggtcgccgggcataccattttcttcaacgccttctggcggcgagtctaactctgcgcggtgaaacccccaggtgttacgaaacttgaatgtgactcgtgcacatgtgggtgttatatcgtacgtcataaattggtggacctgtgcgaccctctttgggggccagtgtctcgcgcttggggcatttggcgccatttccagacttttacccctggttgtccctcggagac

SEQ ID NO: 597193 - DNA, 527 bp, Homo sapiens
atattggcttggacgagttgtggatgcagcgcaccagcatggcacatgtatacatatgtaactaacctgcacaatgtgcacatgtaccctaaaacttaaagtataataaaaaaaaaaaaaaaggaaactcatctcactgcttgtgcttataaaggaatctaattgagacaaagactaatggggagtccataggggagagtccataggaagactgcaatttgagcgatgtttcactatgagtgtccttctgcttcttctttctcagtccctcttcattgacaaatgactttggtaaaatacgggactcacattagggaagcatcccaaaaaaatccccatgcctggttaatcatcacgccattaaatcagaatctctgtgggtccaattatggcatcaatagttataaaaggccaggagtgttgactcacgcctgtaatctgtttaatcctagctgtgctgccagttgattagatggtgccacccaggttgagggtggttctgtctctcccagtccaccaatatgggt

SEQ ID NO: 597194 - DNA, 145 bp, Homo sapiens
  misc_feature (89)..(89): n is a, c, g, or t
  misc_feature (108)..(108): n is a, c, g, or t
  misc_feature (134)..(135): n is a, c, g, or t
cagtgcagaggtatcactgttgccagcacttgatctagaatcctagattctaggtctggttagtagcagatttactaggtggtagatcntgaggctacctatagaacnttcccttggcagtcataattagctcnnagaaactaca

SEQ ID NO: 597195 - DNA, 100 bp, Homo sapiens
tgctgaggtctcggtggactactcagtacaagcaaactggattggatcaacagcccccggaaagagggaggcttgggcccctgaacatccccactgcttg

SEQ ID NO: 597196 - DNA, 488 bp, Homo sapiens
agaattcaccctggctggcgcgccagcctcatccccaacatatcaacaggcacacaagatcactcagtgtgcaaactgtggctgatcccttgagctagatcctctaggatctcttgcctggtcaaagtataagcatgctgttttagcaaaagccagggttggcattgacagtacctgcataccactttaaacactgaccttatgtcagccagaagaacttggaaaatgccttgtatgaggatcctacggtgaaataaaggtataagtccggtaaaacatggatagaccacatgcaggataatgggatcggcaatatacagggagagaccaaaatgaacatatatggtcactgtgttccatgcgccgatggcctagtgcctgattccagctatgattccctctgttacaggaatcaggagaaagcttaatttaggctctgtcactcaggcctgattttctggcgaaagtagcatctgcgctgagccttg

SEQ ID NO: 597197 - DNA, 940 bp, Homo sapiens
gctggggtcgcgggctgcgcgctgtcgtttctgatgtgggcgccccgccggtattttttgtgggcccgcagacgagtgtggccggcttgtgggcgttatgtgcttctggtgttggggtgcccgccgcggggatgcgccgctccatgagggctggttacccgttattgtattcccccccgtgggctctttcgtgggcgaatgtacacgcagcggttgtgtagtgcgggggcgtggctctcaccaatcgagtgcggtcgcccacggtttgtcgtatagtgattgtctgcgtcctcgaccagcttgtcgacttgtgttgtggagtacgcactgtcggtcgtcgtggtggggcatcaattccaaagaattggagtggtgctctggagtgatgcgtatctgcccgcgcggtagtcggttcaacgacgcggtgatagtatttgttggtacagaacaacgcagattcccgcctggagtgtgtgagacgacgccgcacttagttgacggttgtgtgatagtaagctcactagagccgcgctcctctctccgggcgtgtgtgttgttacgacccgccacgcgctcgggtattaaacgcgcacgaagtgcacttgctttgttagttgcatcaagagttatcagtcatcgaacagtttttgtatgaaacaaggcagcaggtcttctttattacaaaaaataatatagaggcaaaagaaataattattcttcgttatttctaacatgtctgtgtgataagctttcacctccggatcctattggtccctgatatattcgtgtatccctccccacttattaatgacacacacgaccccattgctaaacaacctgtctttcccacacatccctccccctagtctcaaccccttccggcggtcccccacaatctcttaccacctctgcaaaaaacaaaaaacaaacaaacataaca

SEQ ID NO: 597198 - DNA, 469 bp, Homo sapiens
  misc_feature (290)..(290): n is a, c, g, or t
aaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacgggngagggcgtaccctgcataacggtaaattgacccatccttatcctgctgagccacagctgtttacctccttgcataacttacatggaatccttactaattaagcatttcctctggaatggccgtcccctggtgtttttttattgatcagttattaaaaaatgcaggtttccccctgtgcc

SEQ ID NO: 597199 - DNA, 785 bp, Homo sapiens
gcgcgcgcacctaccgaggcgcgggcgctgcagatggctcccagcccaagcctgagcctgagacccgtcccgaggtcctggtcccgtccgtctgggtctcttcgccggtagccgtcaggatgggggacgagatgtattcacaagggactcatcgcacagagaagaacgacatgggcatgggcacccagcgcgcgcgaaccgtgggatgagctctcggacgcacaggcagggtggattactggactgaagccatgacagcatgcgtctgctgggatgaggctcttgacggcaccactaccactgcatgccgtgtctgcttccggtgcgacacgccatcagggcaagacaggcccccccggtgatgtactctcgttgtgcccacggcgaaattgcgggcgcgtgacatcgccaacctaccaccggtcgctaatccgacccttaaccctaggcccctcccacggtgggtctcgacagtcctctcgagccgtactgggctccttgtcagagggggacctcccgtacccacgttgccttgccctcgttggactacggcgagtgccctaacttcgctcccttgggcgtttgcccttgagctcatcaacgtgcggtaacttcgccatgtgccaggggccaagcgctggcgagggacccccagaccgcgcgtcctcgcgtttagcaccgacagttcgtggctctgcgctttgaggtcactttacgctgggcgtggccctgtgggcttgtggggcgttgtttgccatcttgcttggggtctccgatttttgccg

SEQ ID NO: 597200 - DNA, 280 bp, Homo sapiens
gttttccagggcagccttgtggattgggaccacttcctatatgatccttggtcttcccgttgtctttgagacggaagaggttgcaaatggaagcaacagcagcaactgcaggagcggcagatactcctgaggccccacacagggtctctcagggaggaattcccaagggctctaccctcactccctcggaaagatctagattgttatgcgtgctttgagctgtctcagtgggtataggtttgaaattacaaggtgtttgaacctgctgataattgtggat

SEQ ID NO: 597201 - DNA, 257 bp, Homo sapiens
tggggggggccttttttttcccggggccccccgggggggggaaacccccccggggcccccccccccccccgcccgaggaaaaaaacctttcttctctcttggtgttgggggggagaaaaaagaagggagaggagggggggagagcaagagggtccctttattacttattcaaaaaaacaaacaacaacaaccataagttattgtgtagaggaggagaatataattaaaaaaacaaaaaaaaccaatgaaactaacaa

SEQ ID NO: 597202 - DNA, 151 bp, Homo sapiens
  misc_feature (45)..(45): n is a, c, g, or t
gcaaggcctggccgacaacacccttattgctaaagtaaataatgncgcgcggggcctggaccaccctctggaagaagattgtaccttggagcttctcaagtctgaggatgaggaagctcaggcagtgtattggcgctttagtatcacataa

SEQ ID NO: 597203 - DNA, 299 bp, Homo sapiens
agtatggatttatgtgtatgtgtgtgtgtagtttatcctctctctcatctttatctagagattgactgatacctcatgctggttgtaaaaccagccagtaatttctgtgcaaccttactatgtgcaatagttataaatcctgagaaatgtatgcatctcgttatcggatagacaactttctttagttctgcacttttccaccttgtaaaccatatgagtattaatcctatggatacatattaaaacaagtgtctcatacaacattgtatgtgtgagaaatctaaatattaacaacctga

SEQ ID NO: 597204 - DNA, 259 bp, Homo sapiens
accctctgaaccgttaaggtcggttcatcgctgcctgttgttgaagcgttgaaactaaagagcgtcggcatccttgccggtgttgcctggcctccctgccatcgcttcgatggcgtccttgccgatgttgcgtgccttccttgtcttccttggcagcatccttgccgcctccaccaggccttgttggctggcttgagatgaagaatatgcatgtatgcatatacagtcaatgcacaaatgcatttatttttgctatagg

SEQ ID NO: 597205 - DNA, 276 bp, Homo sapiens
taccgcccacacacttcaagagaaaatgaaataaattgcagagtaccctggaaagcttttataggtacataaaatattaaagtagtggattttatgaaaatcagctggattataagattgaataccattctgttaaaaagtggttttatggctgggcatggtggcacatgcctataatcccaacactttgggacgccgaggcaggcagatcacctgaggtcaggagtttgagaccagcctgaccaacatggtgaaaccgtatctctaataaaaata

SEQ ID NO: 597206 - DNA, 326 bp, Homo sapiens
ttccaatttaaagcccagttttcaaaccaacccccatttttttttcccccttttaaaggaaaagcaaacctgtggattaaaagggttttggccctggggattcaacccaattttccccccaaaatttccggggatttgttttaaaacccgccttccagggggccccaaggggcggttttaaaaaaaaaaattattatttttccgggaaagggattttgaataaaattccctttgcagcccgttttccaaccaaccaaaaggaacagggggccttaggttaacttttagggcttggcccaaccccctgtgttgggggtttcccggga

SEQ ID NO: 597207 - DNA, 1003 bp, Homo sapiens
cgtattatatgtgtgtgttttgttggttgatggttgtcttttgtatgtcgtgttgtgttccgtctgtcgcctccggttttatgagtgtgtgcgagaattttgctggcggcaggacttcggaccccgtgggggaccgctccgcctctcgggttacccgccggtttttacgcctccctattgggcgttcttcccttctggttgggggtcccatcttctggccggaccccgccccaattttttgtgcgccactatatcgaggttcccttcccggtcccggccatttcccgggttttctcccccctcccccgcggggtaaattatggacatccaacgtcaacgtggcaatctcaggcacggagccggcaatttaaatcagggtgaaatttgattgcaggcgtcgccaggtcaatcttcatgtcggggcagaatttagggtaggaaatttcaggggcggaacagaccaatactgtagcatgcaacatcagtagcaggggcacacattaaacatgcggcatcggtgagtcaggagtcgccctcgagcgttggcaatactacagagtgtcaagatcgagagaatatacgtcagtgactcatactcgagtcaggatacagagagtctgtttcataagtcaggtcacgcccacgaatcagtgcagcgcaccatacacagtgacacgagtgctcatgcagaggatcagtggtgaagtcgagttcaatcgaggtatcatacatcagggcaagctgatgagcagtgggcatgtcagtggagcaggagcgagagaggagcaggagcagacaatggtcaggggcagttacggtcagggaggagccatcagtcataatggcaatacatacaaagatacaatacatcatgtcgtaatgcaagattcagatgttcaatataattcagagtgtcaatggtacaataaataagtgagcaataatatgtgaacatgtacagatcaaaatcaagggcaagaaaaaaaacacaaaaaacataaca

SEQ ID NO: 597208 - DNA, 320 bp, Homo sapiens
aaaagtccaatccacggccgatatcttgggtgacgaagaaggagatctgttcaaagaaaagagccgtagcatcgccagaagccacggtgagtcagacagatgaaaatacagcagagagcagaagagaaagggttaccttatcttccagcaaaaatctcaagccctcatcagaaacaaagactcagaaaggcttattttcagatgaggaggactctgaggattggtttcctatctcaaagggcgagtaagttagaaggtgcatctctgcgggcgggcaagctccccaggtcggtttcccggttggatggaagcgtcgcgca

SEQ ID NO: 597209 - DNA, 135 bp, Homo sapiens
gtgggccggcgcgcaggtgtgcaggtcggtgtgtgggctgcgcaggccggtgtgccggccggtgccgggccggtctggggcacgggcatgtctgcaggccgccgcgccggtgtgtcccgcccgtgctgccggcat

SEQ ID NO: 597210 - DNA, 1010 bp, Homo sapiens
caccttctacaatgagctgcgtgtggctcccgaggagcagcccgtgctgctgagccgagggccccctgaatcccctaaggcgcaaccgcgagaagatgacccagatcatgtttgaaaccttcgagacaccccagccatgtacgttgctatccagtgctgtgctatccctgtacgcctcatggccgtaccacttggccgatcagtgtatggactccggtgacggggtcgaccgcaacgacatgtgcccatctacgaggggtatgcccatcccccatgcccatccatgcggtctggaccatggtgtggccgtggacctgtatctgagctatccctctatgaagtatacctcaccgtagcggcgggagcatacaagcttcaacagctacggtcgccagatgcggggaaattcggttgcagctgcaccactttatggggatgcacattctggtgactcaccgatcggtccccctgggaacgtttctgaggcagaggacgcattgggcctcgaccggtccttgtcgtctcccaggcgtcacttctccctggcatgcacatgatgactaccagaccgtcttgtcactgtaccgggcaagggtacattctaactccaatttgtgccaaaatcgcacgactgcggtctcgcaggcaaggcactcgtggaggagacagctgcctttgcccacgaccatttaccgtttccattggagacatttggtacgctccctgtttgaggcaatccacaggatataacatacgcgttccaagctcccatttcaaatgagatgtgttgcatcagtgagcacattcccaggcgatgatgatccatgtatctgccaaacaatgacgttcgtctgttgctcgcgggatgccacacgagggatagccccttgggcgatggccagaccagtggattgcccgatagggagaatcaacttggcccctggttaccccatgccacaaatgcacgaatccaaggatccattggctcctcactggagcgcaaggtactc

SEQ ID NO: 597211 - DNA, 771 bp, Homo sapiens
ggcagtctgcccgttctcagatctccagctgagtgctggaagaaccactgctctcttcaaagctgtcagacagggacatttaagtctgcagaggttactgctgtctttttgtttgtctgtgccctgcccccagaggtggagcctacagaggcagtcaggcctccttgagctgtggtaggctccacccagttggagcttcccggctgctttgtttacctaagcaagcctgggcaatggcgggcgcccctcccctagcctcgctgctgccttgcagtttgatctcagactgctgtgctagcaatcagcgagactccgtgggtgtaggaccctccaagccaggtgcaggatataatctcctggtgcgcggttttttaagcccgttggaaaagcgcagtattcgggtgggagtgacccaattttccaggtgccgtctgtcacccctttctttgactaggaaagggaactccctgaccccttgtgcttcctgagtgaggcaatgcctcgccctgcttcggctcacgcacggtgtgctgcacccactgacctgggcccactgtctggcactccctagtgagatgaacctggtacctcagatggaaatgcagaaatcacctgtcttctgcgtcgctcacgctgggagctgtagaccggagctgttcctatttggcatcttggtctccccccgtaatgtcttgataacatcttaacagcagaaaacggttgagaccagaaattggttgacccagatttccagggcggattttcccacct

SEQ ID NO: 597212 - DNA, 135 bp, Homo sapiens
ttgaacgagacgacctgcgcatggagccatccgcaggccagcacatcctgcgcagccagaagcctgtgatggtgaagagcaagcggaccgcccaccaagagctcctgagcccccttgccccaaagtccatgtttc

SEQ ID NO: 597213 - DNA, 363 bp, Homo sapiens
ttcatgcagtgagtcttgacttgctgagctgggaaatggggaataagggacaggttttggtttggtttggtttggttttttgagacggagtgtcgctctgcagcctctgcctcccaggttcaggcgatggtcctccctcagcctcctgagagtggctgggattacaggcgcctgccaccacaccgggctagttttggtatttttagtagagatggtgtttcactgctatgggacaggcttgtcttgaactcatgatctccacccacctgggcctcccaaagtgctgggtttacaggcataaaggggacaggttctctggaggtgtgaggtgcctgtccagttaggcttttggcacattttcag

SEQ ID NO: 597214 - DNA, 824 bp, Homo sapiens
tcgcagcgcggtcacactgccccgcaacggccgggaccaggtaggggctgcgaccctgtggagaggccccacttgttgggcctggtgcagggtgccagcctggcgctgcgggcctgcaacccgaccgcactcatccctctgcagcctgtgcctggtgtgccctgctgctctgtgcctcctgccagccccactgacgcctgtgcagcgtcacccgaagcgtgcacctgctgcgcccccgccggtgagcgcggggagcgccgcaatgcccaacgccgggggcagccccgctccggtgcgccgccggccggaggcctcgccggtgcagaaaaaggagaagaaggacaaggagcgggaaaaccgagaaggacgaagagtgccctaagccctgggtagcgcaggcctcaagaagcgccagtcggctgcccggctccccacgttgacccgcctctccggcagcaccgacctcttgagctcaggcccaaatccaaggccaggccatcctctccactccaaatcctggcacaggcctgcctcgcccttgcccaaggccaggaccaagggcgacactctgcctccaaaggccaaccgatccccccgaggtcaccattgaatcccccaaggcgggcggggattcgggaagggacagcgcaggacgcgcaaaggcaagagaccccgaggacgacgcggaagtgagccccggaggaacacgcgaccccgacacggaacgcaggagggggccgagctaaacggagggacggtgcagacaggacccggcggcatcaccgggcaccaaccgacgtgggccagcccgggccagaggcaca

SEQ ID NO: 597215 - DNA, 141 bp, Homo sapiens
tttctctaggtttttgagggcggtaataacccaggaaagaattctaactttctgatagaggttttcagaatgtctgtgttctcatctttatgttggctagatctgcattgaagttcatttgtccttctagatgattctgtc

SEQ ID NO: 597216 - DNA, 859 bp, Homo sapiens
  misc_feature (579)..(580): n is a, c, g, or t
gggaacatggtgttcaatgaacaagcacaagcattggaaatgctaaaattcagttttgcctcaagattggaagtttattttctgactcattcatgaagtcatctattgagccaccattcaattattcatctattaattccttgatccttcatttatccattctgcaaacttttcttgagcaccagcacgggtggccatttgtggacttctcttcattcctatgtgttttcttatcaaagtgatccactctcgaaaggctcctttccagtctgtggttgggttcaagtcatgccagggccagggggcccatctcctcgtttagctctaggcaaaatccaggggatctgcagtggggagcgggggcaggaagctggagggaaggcctgtgaagggtagggatgtggaaagacaaggtgacagaaggacccaataggacctttctatatctctggcttagcattttctacatcatattgtaatcgtcttatttgctagttttcttccttactgtgagtgactaacagtcatctttatcccagtgcctggtacataataagtgatcaataaatgttgattgannaaatgagtaaatagttaattctatcattacaagaaaagcagtggctaggcacagtggctcatacctgtcctcccaggactttgggggaggctgaggtgggtggcatcgcctgagcccaggagtttaagcactagcctaggcaacatggtgagcacctctccctggaaacaaaaaattagctcaggtgtggcggtgcacaccctgtagacccagctacttgggaggctgaccacagcaagaattgcttgcaccctgggcaggcagaggttgcagtaagct

SEQ ID NO: 597217 - DNA, 704 bp, Homo sapiens
gatgtcctcgtgactcagcggacggggaacttctgcatgggtggttcagatggtggctacatcatctgtgatgatggaaaccaaggccaccgtattgtggccagtggaaagacatctagatacttatcagcacttctgacaaatgtaactgctttactcatattaacctgaagtcgcagtttatactacatgttagtgtgggtgtctgatctagggtgcccacaactttcaatgcactttgacaaagaaggtcctaataaggaacccagtgtcatggtagcagtacctccctaaagcattttgaggtaggggaggtatccattcataaaatgaatgtgggtgaaggcgccgtaaggagttctgctttgattctctggagtaatactgtacgatactggtcttagcttgagtaatagaacatcgatgagtgggcgggacctttgatcttcctaagaattaaagttgccgaataatactgatatggtctttaatctccttgtaagtcgtttgatatatattacttgtcataagatggaaccgcatgagttgtctggctgttgcttggcatcccttgacacagcacatcccatctccagaccatagatgctatccatatcctcccgaccgatgtacattgaatcaatggtgcaggaccagaaaggccagtcagactattttccttctatcctcgcacacttctcccc

SEQ ID NO: 597218 - DNA, 113 bp, Homo sapiens
  misc_feature (75)..(75): n is a, c, g, or t
  misc_feature (99)..(99): n is a, c, g, or t
gctgctgtctgtactgtagacggtccatgtatcggatttaacaaagaaagaacttcttttaaagaaagaaaagangaggaccctcatacaactctgcanaaaacaccaacaac

SEQ ID NO: 597219 - DNA, 220 bp, Homo sapiens
  misc_feature (173)..(176): n is a, c, g, or t
  misc_feature (179)..(182): n is a, c, g, or t
  misc_feature (185)..(186): n is a, c, g, or t
ctcgtgcaatttcagcacgaggaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttnnnnttnnnnatnntgacctagatgggctctgtctggtcctgtgccgg

SEQ ID NO: 597220 - DNA, 226 bp, Homo sapiens
atgcgcaataaggcccgcaagaatgctcctggcggaccaggctgaggcccgcaggtctaagaccaagggaatgcacgcaagcgccgtgaagagcgcctccaggccgtgaaggaggagatcatcaagactttatccaaggaggaagagacaagaaatagaacctcccactttgtctgtgcatactggccgtctgtgattacatagatcagccattaaaataaaacaa

SEQ ID NO: 597221 - DNA, 439 bp, Homo sapiens
gttctctgaaatctacttaagaactggcggtattagaaatattgccaatgccactttcgcttcaacttccagagttccagagggaatatctttataaataaaaagcatgagcatcctttgtgaaggaacataatattctctaaaggttgggatccactcatcaaagatagctatccaaaactacatcataacagaaggcaccagaaaatacaggaacttctggagctctgaccaaattgaccatatattcatctaagaatgccctctctatcacacagcccatcatcatagcacaggaacgccaaatatgccttatacacttctcctggatcaacaatctttgaaaagtaagagatctaatttcacaggactaagtaaaaggcttatacatgtcccaaggatgtccatccaccagagccaaaatggacttcctgcaata

SEQ ID NO: 597222 - DNA, 108 bp, Homo sapiens
atgtcctgccgtagctggtgttggacagcagcttgaccacctgtgcccgcgccgccgtgtcgccctgggcggcagcgtcgtacagcggcttgatggtggtcatggcca

SEQ ID NO: 597223 - DNA, 257 bp, Homo sapiens
ttgattggtctgctaccccttcttgaaaatgcttagcgaacggcatgaccctctgccatcagcctgcttttcagacatatgaatgttctcagactcgaccaattagaccctggggaaaggtggagagacggtacctgcggtcgccattccccttgttatttctatttgagcgaaatatgttcaaacatccccttttactccgctgtggacaaaaattccctgtaatgttggtgtaacattttgcgtaattggggttt

SEQ ID NO: 597224 - DNA, 242 bp, Homo sapiens
tgagccgggtaggttgtatgggtttttataatatttattaaagaaaagttgttggagtttgttggaaggttttagttttagtggttgttaatttgggccaagaaatttgtttttttggttatttttaacaagttgttttaaagttttgttgaattttgttgtttaatttgggggttgggtaagggttagatttccggtggttttgtgtttaaaattaaaagaataagtgtccccttaaaatt

SEQ ID NO: 597225 - DNA, 221 bp, Homo sapiens
tacatacaggatcccggtcttggggcagtacggaataatatgaacagggtagtgttaactgtcgagtttgttagaacaatgccatagcctgtgtgctgccgtgactctgcagtgctttcctttctgacctggagaatgagaacagtgttcagaagccagaaggggaaagagcgtgtccctctcggagggcctgtcttctacgaggcctgtggttcctaagg

SEQ ID NO: 597226 - DNA, 352 bp, Homo sapiens
ttgacacacgcgaaaggtgtgctagactctagatatcagtgtccggctcgaatgggaggaaaagctgtagtttgaggcactttgcagggctccaagggggctacagagacctcagggaagatcacgacaagaggagttggttggacctaggtaaggcagccttatatttttgtgcatgtttttgccttctagattgaacaagaaaaaaaaaggatgtcaaccatgaaaaagtaacaatttgtgctaaaaataagtatagcaagttacatgagttgaacagtatttttttccaagtcatctcaggtcttttcattgtcatatttccaatctcttcacattgattaaaagcttc

SEQ ID NO: 597227 - DNA, 242 bp, Homo sapiens
aagtcccaggtgggcggatggtttgagcctgggagttcaagacccagcctgggcaatatggaggaacccccttctctactaaaaatcaatatcttggctggtcatggtggtgcacacctgcggttccagtaactcgggaggctttggtggggggatcgcttgactaggaggttgaggctgcagtgagccatgattgtgtcactgcactccagcctggacgacagagcgaaatcctatctcaa

SEQ ID NO: 597228 - DNA, 158 bp, Homo sapiens
cctcaccagccctggcagaagcaggaagcagccatttgcagaatcatgaaggcatgaagcagcgaagccacattaaggagctaggagatgggaatagctttgcgaaaaatgggcgcaatggccaagccagattgtatcatcacttgtgatggtaaaaa

SEQ ID NO: 597229 - DNA, 369 bp, Homo sapiens
cacacacacacacacacacacacacacacacacacacacacgggatctgtctctcgttataaccagcagaggggtgtttgatattgtgagagtggcacactgaccttgaattttctgtgcacgcgcttacacaaaaatattaagtggtttattatatcatggcctgagagcatctgtgggggtgacatacagagactgtatatgtccaacaggagagtggcgtgaccgcacagtgttgacagcttgtgagtgtcagacacaggtgttttttttctctctcaggagacacacctatgttagagagaggggagaggacacagaagacagggagagtctatgatgtaggtctgacaggtgcgccaagacaca

SEQ ID NO: 597230 - DNA, 1450 bp, Homo sapiens
ggtgtggtgtttcttgtgttgtgggtggcgagaaatatgtggtggtgtggtatgttttgttcgttcctgcgttgttgtgtcggcccccgtgggttgtgtgtcgcgcccccgcgcgggtctggtttgtttgtggaagggtgcgtgtgggggggggcccccgccgtcggcttcccccccccgtccgttgttttttgtataacgaggtggatcactactcaactgtcttccgctggatttgtctctcccctgcgctgtgtgttcgttggtgggggtatggtagcgcactctacgccggcgccctcgctacggtggtttgagtatggagttttttgtttttgtgtaggcggcccccaactgttttttcttgtgattaccgccttcctgctagtggtgtctgttttctgctgccagccattagtttttcgcccctctacttattggttgttggtgttgggaagaaagaggcaggggggtgtctcaccatgtgagggttcacctgccgacccgtcgcttggttgtttattaagtcccccccccccccagtccaggcgggtgggttgtttttttgtttctttctgtgtggagggggggggaggaaccaacaaacacaggaggggggggtggttggtggcttcttacttctggggtgaaggaaggagaatttggttgtccaccttcccccccccccccgcgggggggggagtcgcccccccccctccctcctgctttaatctgttgttggttctgttaatggagaagagggggtcgtcgttgtctcaccaccggctggtggttggggacaagcacaactagctggttgttcctccacctgcttggtggaggagggagctgcttgattttgtcggggcgtcgccgacaactcatcttcttctggggcgacacacttctggggtgttgtctttctctctctgtgggtgctctcaacacactgctggtgaggacacctctgctgtctgttgggtgttctcacagagggagtttgggggggttctctctgtgcgtctctctctgtggagggagagccccgtgggtcacactctctctctgggggcacactctgtgggcgcacacactctctctcgggcgacactctatagagtgtgttttccaccacatgatagagtttctccactgtttcggccaccctcgggcacagcgccccccagcgcgcccacatcccggattagagcccacaagagagagagttcttgtgcggccccccagagaagagagagagggttgttttcacccccagagccgcccctgtgctgttgcttgtagagggctgtgggtgtgacccgctcccataggttctaacataggagccacctgctgcgcttttctacctttgggacacttttgtcccaccccaagatgtaacatttggtgggcacatcccataaaatcattttggggggagaaaaaataa

SEQ ID NO: 597231 - DNA, 742 bp, Homo sapiens
cccgcgctgggtgtttccgcccgggcgggtttttgtggtgggtatagcccccgctggtcttcccccgcccctttatcgcttcgcttgttgtttgtaacgacgtggcgcgcgtgcccgccttggacgtagatctctgggtcttatatatcggggcgcctcctccctctttatatctgggcgcgccttattatgtttctgctcgctcgctccagtgccgtcgcgacgctcttgctctcgcgggcctcgctcctcccgtagaggtccctggttgtggtggctcgctgagtggtagacctcgtgcgccgcgcgatagatagctcttcctcgtttgttagtggctacgtccccttcttatgtatgcgcgatgttgttgtctccgctgtgcgtcgcgtattcgccgcgcgtcacacattgttccccgcgcggtgattttcttctgcccctctcttttcgcgcgcctcgcggtgatagttgcgataagatttctctcttatatagtgttagaagagatgcgccgtcccgcgcttaccccgtggggtggcgactctatctttgtgagtgtcccccctcctccgctttccccaccctcttctgagtaacactccgctatacatccacttatatcttctgtacccaacaaaacaagaagaagacttctgaccccccccaatacctgtggttctctatcacaccaaccccccggccctcccctagacagttttctcccaacaaataaaaaaca

SEQ ID NO: 597232 - DNA, 151 bp, Homo sapiens
  misc_feature (9)..(9): n is a, c, g, or t
  misc_feature (24)..(25): n is a, c, g, or t
  misc_feature (29)..(29): n is a, c, g, or t
  misc_feature (42)..(42): n is a, c, g, or t
ttatgcganggagagggtgaaaannattntgggtggtggaanaggagcaagcaggagtgtaaaagggcctgggtgtttatggaaatgtggaaagtgcagtgaagctgaaaagtcatatgtctggttggaagtaagatgaggctcaagaatg

SEQ ID NO: 597233 - DNA, 917 bp, Homo sapiens
aaggcagtgaggcagcgagcgtagtgtgctcatgtagaagggttaagctaatgaggatctagaaaaaatccgtcaaatcagtgaattacgactgtagaaagatagtacgattaattcgtcttaattgacaaatacttagtcaattggtgttatctagatgagtgctgtcattatacgttgctgtgtctgaatggaattgtaactacgcttacgatatgtggagaggtatcatgctgactgtagaagtgttggctgctgtgaatttatgatctgttaggtcagagtatggtgtagtcgagtgctatatgccatggtgtgctgagactgattcctgggggtggcacaagatctaattgctatgtttggaggaatcttatgagctgattgatgtcacgtggtacctttgagagagcagctaatggtgggagtactacgtggatgcaacatttgatttattagaaatccagcaaaggctgggaggctgaggtgggaggattacttgaggcccaggagttcaagggggcagtgagtcgagattgggcccccaagatctaaactgggggcacagaatgaagacctgtattatccaaaaaaaaaaaaaacacaaacaaaaagtttttggggggcctgcgccagaaaaaggtttttagaaccacttcgttgcggggcgggcccgtagtgtatgtggcacagtgcaaaggtggttctacgaggaacctggcagtcatggtgtgcgggtcttcccaaaaaaacaccgggggaccgcggttgacaaccaaagtggtctggggtcatcgggtctacggcgcacgagccaatatcacgcgcgcggggggacaagagaagaacagaaaaggcagcacacagaaacagaacacacctgacgcaagaacacaagaggcacaaacaagatgaac

SEQ ID NO: 597234 - DNA, 135 bp, Homo sapiens
ccgggttcctgttctactaaacacaaaaacggccaggcgcagtggcccacacctgtaatcccaggatttggggaggcgaggcagaaagatcgctggaggccaggaattcaagaccaacctagacaaagggaaaca

SEQ ID NO: 597235 - DNA, 418 bp, Homo sapiens
aaattaaagttttaaaaagaatattaattgtttaatactcaagtttagctgggctcctgaaattttcccccactaaattaagcaatgctaggagagaggcagagactccatctgctaagcacatgagtattctggttttctttttgattttataacagaatcgaacaagcatttacatacacctactaactcaatgagaaagtataataaatactactatgaaagtattgaaaaaaaaaactgtgctttcaagatactcactatatttgtagttctagactgagtctagttctatacctgagtctttcagctgggataattacttcaattcttagcttcagtttggaaatggtaatctgcttctttttatttattgatgtggttggatagaatagtgttccaaactaggtaagtatct

SEQ ID NO: 597236 - DNA, 248 bp, Homo sapiens
agcacgtgagcctccttgtgtgtgtctagtgtttgggccccagaaaattcctgcctggtgctatgcactgatacctccactcccttactcaggtcctgtaggacaggcctgggttgatctcagctcctcctgctcccagaagcccttgggcagagacaggtagccaggactctgtggattctagatccttgcccctcagacagcactctgctgtcagcacagcaatctctgggcagccaggcaacaat

SEQ ID NO: 597237 - DNA, 168 bp, Homo sapiens
agatatgtgcccatttcttgccaactcatggtgctacaccttgactaacgtctttacgtgggtacttgcgcttactctgtagccttcatcaggatttgctgaattgcatgcggtgtataggactgagcacagaggtggctgaggttgatcgcgggtttatcgacttac

SEQ ID NO: 597238 - DNA, 148 bp, Homo sapiens
ccccagcccgcctggctcatttaacagtgataatggacaccaaaaggctgtgtgtaatctgtgctcaagttgcttccattaaagagtgctgtttttaaaaactaataacttacaactgccacacgcaaaaaagaaaaccagtctccag

SEQ ID NO: 597239 - DNA, 848 bp, Homo sapiens
  misc_feature (524)..(524): n is a, c, g, or t
ctcctcaagcttggcgtggttgggggggtacacgcgggtttcaacatgcgtatcgaaaagtgtattctgtcggggcccatctatcctgacacggcatgatgttcgtccgcaatgaatggcaaggtgtccagatttgtgcaaatctaaatgtcataaaaatttaaaaagaagcgcaatcctcgcaaagttaggtggaccaaaagcattccggaaagcagttgtaaagagcttacagtgataattcatttgaatttgaaaaacgtagaaatgaacctataaataccaggagagctatggaataaaatattgatgcgatgaagagagttgaagaaatcaaaagaagcgcaagctaaatttatattgaccagatgaagaaaattaaagaggctacagaaggtcaggatatcaaagagttcagcaaaaatccattttatccgagccccttctggcaggcaaggggaaccagtggcagagaaatggtacagcagttaccagaggatgtgcacatggaagatgctctaaanaatctctgtaaccatttctttatgtactttgagaaatgcctgtgattctttgaacttgtaaattatttatttttacataagggccttacatgaaaggcgttaaagagattttcctggttgcactacgtagattagaattacggtgagtgctcacgcgtaacttacggagatgcttagaatatgaattatggcaacggaggaggggccacgcggcttggaaggcacggttgtaatggacatgggggaacattgggacctgtgtggggcggcacagtggatatcgggacaaggaatgtttttcctctttttatttattgggggagg

SEQ ID NO: 597240 - DNA, 179 bp, Homo sapiens
atcccgatttttaagttttgctattgtggtattttggtggagaaaaaagaaccgggtggctgtttttgaactgcctggaacctaagaccctgaatttttttcccccccaaggggaaaatttatatggaaaacatttattttaaaaaacaggatgaagtgaattaaaagatttaaatgca

SEQ ID NO: 597241 - DNA, 903 bp, Homo sapiens
ggatcgggccctttaccaatcagaaggacgggcaatcgcaagacctgaccccaccgggctttcgggcgcacccccaagtaccgggcttctgacaggatcaaaaggggatctccccctggcgcccggcccctgggagatcgagagtttcccacccccagagcgcaagtattcggtctggattcggtgctccatccatgacctcacaggcaaccgtcccaccggatatgggatttaccaccggagttacgacgaatcgggcccctccatcgtcccccgccaaatgctttttaacggactcagccagatgcgtagcatttcctgcatgggttaattgagcaatagaaaatttgccccctggccaaaagcacacacctcatgctagcctcacgaaactggaataacgcccttctgaaaagaaattggtcccttgaagcttgtatcttgatatcagccactggattgtagaaacattgttgctgattttgacccttgtattgaagattaacatggtcccctgtggtattaacagtgtcagggctgagtgttttgggatttctcttagaggctggccagaacccaattgttttgtcttgcgggtcttctaggggtggaaagtcccagccgtaggacacccagtttcctttcttagctgaagtctttggcccagaacccccgtgggctgttacttgctttgaattggaagcgggttgcatttacgcctgtaaaagtattcatttttaatttatgtaaggttttttttgtacgccattttcgattctttgaagagatgaccaccaattttgggtttctactgcttactgtgagaaccattaggccccagcacaccgtccattgtgtaaggaaaaataaaagtgctgcccggttaaaaaaaaataaaaataa

SEQ ID NO: 597242 - DNA, 1179 bp, Homo sapiens
gcatgaaaaagtgcctaaagtgccagaagagccaaagaaaccagtatccagaaaacaaaggttcctcctaaaagtcatacaagatggcaagaacctctccctagccaaagtgactagagaggcacatgcaaatttatccaggacgaaaacgttcttgatgctgtacactaatacaacagaggcgcctccaaaagcaagagtgccagaggcaaccgaaaaagagctgtcccaagaagaaaaaggttctgacaacctcaaaaactaaacagagcaggaggacaccacacaagcaaaacgtgacctgaaattacagacaacaagacgctggccaacagaacgcacaacaagcactcacacagcaacacgctacacaacacaagagcaaccctccaacccactcacaagcaaagctcaactacataacctggcacagcagaaaagaacacgggacattataacccataaaacagacggacagctgcaatcacagcaacaacaacgagagaacacacaatgaaatcacgacacgacacataatgcacacaacacatcctgtcacaacataaccagcaacactccggaccccggacgaacaacgctaccccacaagaagaaaagaaccataccagcaccaaaatcagcgcaacccaaactaacagcacgtcccacacgacacagcttaactgacacaagaccacttgccaccgcacccactcgcacaggccaaatcaccactcaagcaaggaaaacccaattaacaaaagcccaataatacccgatgacaataaaagaacactcggtacccaacgaatgacaacacaaggctatacccccgaacacaacaacaccacacaaggagcacaccccaagacggcataaacaggatgcatcgcactcacgccggtcttgtatcccccgacagacaaaacaaggtaacctaatgagccactatacactatactaaaccatcacacacaacaaaaataaacaaaataatacacctaactaaaacaaaacaaaacagtaaatagccgtgaataaacaacacaattatatataataacaacattgctaactaaacatcacgaatcataataaacacaattcacaccaaatgaccataaaaaacaaacaactgatttacacactacataaaaagtcatagatcatcattacaaa

SEQ ID NO: 597243 - DNA, 917 bp, Homo sapiens
ctgtgatgttctgcccacgtcgagacctgagtctgaaatgtcagacgatctcggagagcgactgtatggtgagaaccagtgcgactggagcaggtcagttagccgcagaaggcatcagatggtgaagtgagaaggagacacaaaagtgatgcagcatggagacaagttccatgttcctgtcccttctgtaggaaccaccacagaacggcctaaaacgaagtgtttggttggatacaaccaagaggaaagacaagagaataccaccagagacctaaggataccatgaatgataatgaagatatattactgatgttcttgcacaatatcagaaccaaaaccaggttacctgaagacctacagaagctggatgaaggactattatagcagcgagacggcttggtgatggaacttagaagaactgaacctgccagactcctgtttcctcaatggccaagtgatttgactcacagtctttcctcgatacctaaaagacattttgtcctaagtgggtaaaacttaggaagaaccacagtgagacggcaactcggtcctgatgctgatcatctgcatgctcggccgtccgagcccctggagcctcattaggtacgatgaccagtcattcagaggagacggccaaagtccataaaacttattctgcaacgccgcataagggtccacggcgcaggtacaagttgctgggagaaagcgtggtgagtgcacctgggtggtaaggaacctccgggggagcaattcaaggcaactttgttcatatgcagcgtggacctttaatttgaggccctaaaaatttctggatcttgacctggcactgggcgagattcgacacttgacccacatgatgcacattcccggagcaaagcaacggggattccaacttctgaacatggagtgccacctgg

SEQ ID NO: 597244 - DNA, 113 bp, Homo sapiens
  misc_feature (77)..(77): n is a, c, g, or t
ttttttaaccacttccctatgctacccatgaaacctagttggggctctgttgtgtctgatttcccctggcttattcnttactttttcctccttttccagactcaggtggtgtg

SEQ ID NO: 597245 - DNA, 662 bp, Homo sapiens
  misc_feature (662)..(662): n is a, c, g, or t
agcggtgcttccggtaggagcctcgcaggaatggtctccgggtagaggcaggtaaggatgtcccgggccggtggagaaggaagagctgggcgtgtggcttcgcttggaatccgaatcagagcttggaccagagccttccctgaggatgctgaaggtaagaaatcctggctcaccagtgccgcggaaggggaatgtctatagttttaggcctctgagtgcgggatcagcccttaggtgggtgtgttttgaatgcgtgaggaagtagggtttctctttgggctgtgtgttactgttgggacagcgacctggtgcgtgggtgtgctttagtgacagtgtgattgtgtgcctgatcatttgtgtaaatggggtttgtaggtgactgtgaccatgattgtgaatggctatttgtgtaaatctcatttatttacgtgaaagaaaaagcacatttacaggccgggagcggtggctcacccctgtaatcccagcattttgggagcccgaagcgggtggatgccctgatgtcgggagttcgataccagcctggccaacgtggagaaaacccagctctactgaaaatacaaaattggccgggtgtggtggtgcatgtctgtggttccagctccttgggaggctgaggcaggagaatcgcttgaacccgtgan

SEQ ID NO: 597246 - DNA, 1247 bp, Homo sapiens
ctgcgcagcgtatgcacacgaaactgcaaaatatggtgtgaaggttggcctgacaacattcatgctgccagccatattgtactggcctgctgctggcccgcaggcttctcaataggtttggccatggaccaagcatctcatgaaggccaagtggaggtgcactggtgatgaataccaatgtggcaaacgcattgatggtcagccagggtgccttcacctggctattttggatgcaggccttggccagaactaccactggcaataaagttctaaggtgccctgaagggagcttgctggatggcaggctatggtctatccctcaacagtaccaaacgatatccctggattatgattctgaaagcaaggaattaaaatgcagaagatacatcggaacgcacatccatgggccaggaatgttgaccgaattacattgcggctacttaaatggacacgaagatgaaagatgcttacagagaaacaggtactctcaatacattaaaggaacaagcgtaagatacaggaaatgatggagggagatgtcgttaacgacaaggctccatggctgggtactaccagcacaagacatccgaggtctactggagcacaaaaagcccccaacgaaacacgaacggtaacacacagcaagagcggtggacaacacggagcccaaaaaatgttgcccttggccaccaagaagcaccggataccgaggatagcctcaacaatcgacaggcaaagctttcgctcaagaagacacacggaaaagggagcaggaataaaaagcgtagcaacccaagcaaaatgccctaatgataataacccacatatacaactcacgttaaccgtgacattgacacacagcagagacaaagcaaaaaacagtggaggccagcaaaaagaaatagatccacaaagggagcccaagcacatcaccaacacaagaccaatgctgacaaaaaagggacccaaaaagaacaaacacacaaaacagcaacagagcaggcacgccgcaatacacacgctacaagaaggcgaaaaccagcacacaagggacaacagaagaggccacaagaaacaaaggggaaaaacataggcaaaaccacacacagatcaaaaaaccgcgagacaacacaacagaagtatactggtaacaagcaacaacgaaagcggcagaacggacgagccacgacaaactaggagagaagaaacaaagaagagacggatgacaaaagcaaagcacgaagcac

SEQ ID NO: 597247 - DNA, 716 bp, Homo sapiens
tgcagtcatttctttaaggttgcacaacgagcacagcccggactatgagttggagatctaaattctgatctgagtctggaactgacaagttgtgtgaccctcagcaagtcacttaacctatctgagccttaatttccttatttataaattgtggtggtttgaacacatgctcataaggtctgttcagtgggtatgtgtgttgagtgatatttgtgctttttcttgaaagattttcgggcatttagcaattattatgttgtacttgtaatcagaagcggttgagcccggtagcactaaataatgaaggattgaggaactggtgttttacattaaaaatttaatggaaatttatacagcagatagcgaaaatctaatgagtagagctcaaagaaagagagctaaacataggagtggttcttcttagcatgttctatccttctaagcctgttgtttcctaaatgatgaacggtatgtctgtcgtggaaaatacaagggctcttgtgatcactcagacccagagtgacactgttaggttcggggttgaataagtttggcctttgcataagttatttagtctctcttagcctcagttgtctatcggtcaaacgggtcatacgcaagtgttgacacatattgtgtacactccctaggactgatttttctaccccagtacgtcgtattggcaaggaaactgttatggtgttaccccatgttgg

SEQ ID NO: 597248 - DNA, 144 bp, Homo sapiens
gggcagggctggcacagacagacggaagcaaaaaggacagttggctgctgtgtttgttgggcacgccccctccccggacagcacctgccccctagaaacttttttagcaaaaaaattaataaaaacaaatccattgtcctttta

SEQ ID NO: 597249 - DNA, 243 bp, Homo sapiens
tgagtagcaggccgtggtggtcccgacatactagggaagatgaggcatgagaatcgcattgaaacccaggaggtacaggttgcagtaagctgatatctcaccactgcactccagcctgggtgacagaacaagattctgtcaaatacatacatacatgaatgggagtatttgtcacctaaaatgaatctgtataataggatttctagcggcgtaacaaaaaaagttaaaatattcacacagtcg

SEQ ID NO: 597250 - DNA, 796 bp, Homo sapiens
tggtttggaaacaggtcttaattcactagagcatttaaattacgggagatccccaaaagcagtttgatgagacttcagtattttcacttcccaggggtaggggataggggaaaatctatattttggtacagtttatttttaattaccataaagccttaggacaaaggggggggttagctcgtgctttagagaataaaggggagatgattttcaccaggggtgattgtcatatcgtgtgtgggattacgtggtacatcagtcagtgatgagtatggggtgggcaaagagtcgcgtggagtttgttttcggtcaaagatattttaaaatattttgggtaaacactcgttccagtgaggcctcatcgtggtgaagtggaaataacagcatatattttatatgagagaaaacaggtgaaattgagaaaaagtccttcaagctgtgggagtaacattgctcagccggtaaaacgattactaacaaataatcccagaggaaacggggttcgggtcggggccatttgaaaatatgccattggggcaaatcttctcattcggggtacctcaggtaatcccggaggaaaataaaactcggagatcgagtcgccctcccggacagggagttggaaatacaggtacttgggagagcttcaaactaacgtgatttttccatccataagtgtcaccctgtgcaaactgatgtaataaaaaatcctcttaataacagggtgggacccccaagaatgttgcggacgccgcggcatagagtataggacacctaggacaggagagcaggacga

SEQ ID NO: 597251 - DNA, 1222 bp, Homo sapiens
aataatgtcttttctttagaatatctggattatgaaagcaagcacttttttcattaaaaaaattatatactaggaaaaaaaaaaaaaaaaaaaaaaaaaaaaaaaggggggggggggtaaaaagatttcccttcaggggggcccaaaggttatacggcggtacaccaggtatttctgtgtacaaaggggggcccacttattaggagaggtcggaattatatataacgctaagggaatggggccagacggttaacacaacggatcggtgagacggggagaaaccgggagaacattgaggaactcatgtggtgagaaagggaaacctcttatactatctctgtggaggaggggtgaaccaaaatatgtgtggtgcgaccaagcagtataccccctataagagagagatattataagagagcctctattagagagggataaatttattagaacatttttataaagggtgtatataaaggtggtgtgttaaaaacatacagacggtgaaaaatatgtgtacgtgtgagagatgatgtggaaaaaagagtttagtggggacataaagagagagagattatatgaacctatatgagtgcagcacaaatttatatatatatcaacaccgcgggagagccacacagtgtgaaaaacacccgaaaaaaaaaaaaaaaagacggaaaaaaaagaacgagaaaaaaagcacaacaacagaaagacgaaaagaaagcgaaaagaggagacaaaggagacaaaaggcaacagagaaggagacagaaagaggacagaaggagaagggaaaaaaaggaaagaaaaaaaaaacaagacgaggaaacaggaaaaagacacaaaacgaaagaacgaaggaaggaacgagaagagacaacaaagacgaaaggaaaaaaaacacgaacaaaaacacagagaaagggacagcagaggacgagcgaaaagcgagagcaagagaagcaagacgaaagcaaaaaaagacagacaaaagcaaataaacggcaacaaagacgaggcggagaggaaggaggaaaaagaagcaaaaaagaccacaaacagaaggagacgaaaagaagaagacgagaggagagagaaggcacagagagaacagaccacacacaaaagaagagaacaggggaaaacagaagcgaggagaaagaagagggacaagaaacgagagcgagacagaaagcgcaggacgagcgggaacgaagggcgt

SEQ ID NO: 597252 - DNA, 2012 bp, Homo sapiens
  misc_feature (1301)..(1301): n is a, c, g, or t
  misc_feature (1320)..(1320): n is a, c, g, or t
ggtccggaacagttgattattattatattcttttatcttctttttatttattcttggcgggaggaagaccctccacgagggcacacacacaatagagtggcaaacaaaatgacaaatgactgcgtaaaatcatcacaaaaaaaaacacataccacacagagagagacaacacaacaacaatgcaaagcagcaagcaaaagaaggccacatcgaaacacagaaagaaacagaggacaggagacaaaagaatcaacaacaccaacaagctacaacaagagacgacatccaaacccaccacacaacacgaacacaacccgacgccgacaaacaggcgagaaaaccaaaaacacaagtgacaacagaaaaaaaaacaagagaagacagaagaaacaggcagagcagacaacaaaaaacgaaacagaaaaagaacaaacaaataaacccgagcaaacagacaacagaagaagaagcaaggggaagaaacaacagaaaagatacaaggaagacaagcgaaaacacacgagaaaagaaacgagagaaaagccaccaccacgcacaaccaaacaaaggggaaaaaagaaaacgcgaagaaaaaacaaacaacacgcaccagacacgacacgacgaaacgcaaaacaacaaggccaggaagacagaacagtcggagaaaagaaagaaagagagaaagcagaacgacaacaaagaaaacaacaacaaggaaacagaacacaacaaaatagaaagagtaagacaagaggacaaaaaacaacaacaagaaccacacaacaacaaaacatagccgcaacaacacaacaacagaagcaacacagacagagaaagcgcgagcaacacgatcagcacagcccgacaccaagacaaaacaacaacacgagacacgccgagcgagaaagacgcaaggacgcgagacacgcacaagggagaaacgaaacccagcgaccacaaagacacaagaacgacggcagcacaagaaccaaacgacacggcagagcgacaagaaacaccaacgcaagaggaccgagaacagagagaaacagagacaaaggacacgaagacacaccaacacgcgagcaaagacaagacggacacgcgaaccaaagccgacagagacaagcagcgaacagcgcaggcaggagacgacacagacggacgtcacgaacaacagcagcggagcgaaacaatagagacaagacgagacgtgacgcgaggagacgacgacgacaacgagaagagacaaaggacgacatagacgacacaagacgccgccgaaagagacacgacgnagacccgatcgaacatcantacgtacaagaacacagaacgaatatcgagagatcgaactgaatgcgcgacgacacatgcagacaacacgccgacgcaaagacgcagcaagcagacgacgcaacacgagagagagagacggagacgtcgacaggcagacacagaacgcagacgcacacgaacgtacaggacgagacacgaactaacgaccaggatacgcacgagtcgacaggctgcagcgacgagacacgaagcgaagacgaagcacaggacagaaaagagacagcgagaacagacgagagaacacgaccgagcgacgaacgagagagagaacatgaagaagacacagaaggtccgagacggagcaaccacacgcaagaagtagagaacacgaacgaaggaaaagcatggcaaggcatacatgagaagcaatcggaggagagccaggacgcgaggaggcgaacagaagcggcaggcaggagaagacaaagcagcagaagacaaagaggcaggacaagagtagaacagactagaacatagtagcagagcaaagaaaagaccacgcaggggacaacggaagagagaagcggaagagcaggaagcgacgccgccaacgagagacgagaagagagcagacaaacagagaagatagccagcagagagggagcaagagacagtcagcagcccagacagacacgagaagacctgatata

SEQ ID NO: 597253 - DNA, 451 bp, Homo sapiens
  misc_feature (57)..(57): n is a, c, g, or t
agaccccttgcacaacactgtgcctatagataacagtaccgtattgtacacttaaanatctgccaagagggcagatgtcatgttaagtattcttaccactgtattttttttaaatgacagcttgatgggttttccataaagttatgagtttgtgctttgtaattttttgctgtctaaaattctaagaactacaggtattaggaaatgattttgaaatgattttttctttctttttaaaaacaccattatttaccaaaatgaaaagttagaaatcctgaataatgtcatctcctctttagaaaggaatgcactcttggtatcagtgggcaggatacagcgttgtccagtggactaagaggagccgggacacccagactcctaccccacctctgcctcttactagccctgaaaaccttgggaagttactccagctctgtgggaactggcatag

SEQ ID NO: 597254 - DNA, 81 bp, Homo sapiens
ctagaagattcagcaaagtacttttgtgctcttggggataccccctactgggggatacggatgttcaccgataaactcact

SEQ ID NO: 597255 - DNA, 256 bp, Homo sapiens
  misc_feature (222)..(222): n is a, c, g, or t
aaacaccacacacattacagagcaaacaatggtgcctcatgcataaacatacatagatgtctactcaaaaagcacctcttcagatctcgagaacatgaaaaagaattgagtgcttttaaatactattaagaaagtaatcataaaagtaaatcgaatttcaaacctatccgacttctgttttgcgaacctttgaactatattcatgtgtataagggtatacanatacacacacgacatataacacgtgtacacatat

SEQ ID NO: 597256 - DNA, 142 bp, Homo sapiens
agcggaaccgacgggactcggagatcatgcatgcgcagccgacaacggcaacgagcagacggaggaacccacgtagctttgtggcttcgtgtcaaccctcttgccttcgcctgtgtgccttgagccagtcccaccacgctcg

SEQ ID NO: 597257 - DNA, 567 bp, Homo sapiens
gtacgtttgctgtaggcctggggaggctcagcaaattcccgcagcatgcttcctgtacaggctgcacaagtgtgagctatttccaccccttatccgttcaccgttcaccaatctcaggtcatttatccatactttttcgcggaatggcctaataatcaagtaaacagattattccaacacacacagagcagcactgtgacaaggctacgaggtcacaaagggaagcaacaaggaactctggctggcggtgagcagttttcagtgaagtaacaatatctgcactagggttttgaaaaatgcagcagaagctctgtgtcagatgaagaagcagcacaggaggccctccaagcaaaggacaccactcatgtcaagacatggggcaaaaagcagaggatgtcatttggagacacagagagtcacaccgaaggctatcattcaatcagtgcatagtcttcatggaggttaatatcaaaggcaacctgaatttcctcagacttcatgagctggcggtgaagggtgagatcacacaagcagtaataacccagctctccctggctcactgcttat

SEQ ID NO: 597258 - DNA, 201 bp, Homo sapiens
ccactgtggtactggtgttgtctcttgattcctcactgctcaacctgctcgtcgggatttcacttacacattcagaggaccataggagagggcatgaggggctagtgtgaagcatctgatgatgggggccatttgtgggtgaaaatgaatacctttttttgaaatttatgggtcattttcaacgtggatttacgaagggtg

SEQ ID NO: 597259 - DNA, 837 bp, Homo sapiens
gtctaatcgaggcttcctaccgaagtgctctatgtgtgggggcgccacctcgtggggctccctctctcaggtttgcccccaagtcggggtgaaaaaaacacgggtgaagttaacggcccccagtggagcaaagcgggcacttctggggagcgccgagcgtgtgcatcacccggtgtgacctccgccgggcctcaagccggagattaacccatggcggtccataatagagggtcgcacacacgcgagtgtcttcctaaaaagccccattaacgtctgtggtcaacacacaagacgaaccctgtcacaacttattccaaaaaatggttttccggagcacccttttgtgacaaaattgtggaaagggtaaaaggagatctttcggtttaatttacgaatggatcgaggtatacgcccttctaccctaacagcggactagatatcccgcccttttgaccccacaattgccgctgtttctcgaaaacccacacgtattatggacgattgtgccgccccgccgcgacgtggcggatcaccacagagtccccacccccttgcggggagctagagtgctgggcacagaacactagtatcctcacgtggatttagagaaccccccctggcacacccatggtgcaacccccggctgtgttcaagagcaaacccacatattactgtcgcttcatgacgaccgcaacctgtagtggcccgcattatagggaggtatattgggacgagtcatgcgaacgcctcggggatgaaggtcgccggtagaaggaccctgagttggagccccgacccccccacccaggacaacaaagggatccccccccaacatac

SEQ ID NO: 597260 - DNA, 558 bp, Homo sapiens
tttttttttcctttttttccaaaacacttaatactttaaaaaaaaaaaaaaaaaaagcaattccggggggctggggtgcctccaacccgggtccccctcggtctccagccaccctcgggctggggcttctggagctgggtgggccctgggcccaagaaggtctgggcgggaggcccagggcagcaagccatagggcgggggtggtgctctaacgaggggagaaggcggggaagcctggccaaccctacttcctgggcctaacctcctaactaaacacttcctgggcccatttgggcacccggtaaccaagggggctcaagggcacaagaaggggagctacagcacagtctggggcctccaagggcccccaaagagcctactcttcgagagcgctggtcgctggggtggcaagaaaccggccaagaagccaacccacaaaaggtgggtttctcatctggggggctccccggaggaaacctctctttatacaccttaaatataaaaggggtctccgaggcgaaaaacacaaacaacacaaaacacacaaagagaaaagag

SEQ ID NO: 597261 - DNA, 528 bp, Homo sapiens
  misc_feature (198)..(198): n is a, c, g, or t
gtgggtttggtgggtcattgtggcatttgtcaaggaaaagcaacattgccctctaaatgactcccacttctgttctggaaaaaacgcatcatcattcatgccaccatcccaatagacataggaagcaatttctcttcaggttttgagatggtgcaagcattgacttttctttctacagagggctgggatggggggtgngaggtggtggagaaactgttattctgtgagcctggctgggtctgcagatggaaggccttgttcaagtacagcagcatccttgtgctgcagttagtggttttacattttttaaaatccccttctgagggaaatctgtgattacatttttttctctgcacaggtgctagaatgcattgcgcaaacacaaacatcccacttcatgagaaaatttggaagtcattttccttccatctgtctgaagtagactgtgctctaaaactggccatccacccacccgttctcccacgcaccttctcagtgacaggaggagatggcattgtaagagaatga

SEQ ID NO: 597262 - DNA, 356 bp, Homo sapiens
agtatctagaggatccggaggtctcttcctcaacagtaacagctctaaacctgcatgctttttctatgagtgcctgtttcagagctgtctcctttcctttggaggtcagtggtctccggcgggcaggactgaaagcaataggactgcacatgtgcactgcctccccaaagcgattcctcactacagcaccacctcccttctgacagatggaaaaacagtctctggccaggcgcggtggcttatgtgtgtaatcccagcacttggggaggctgagggaggtggatcacttgagtccaggagtttgagaccagtctgggcaacatggcgaaacttcatcactaccaaagaagaaaaaa

SEQ ID NO: 597263 - DNA, 1272 bp, Homo sapiens
  misc_feature (517)..(517): n is a, c, g, or t
ctccgagtgatgggcatctctcgtggacaactggcacaagcgtccgcatagaagcggggtgcaagagaaatgccctaaccacaatgaatgcgtaagtatgagttggggcgctcagtctgctcaacagcaagattggccccctgccgctatccacacagatcccgtggtgctgacgtgaggtaacaatgaaatatccagtgcccgtgatcggtctgcgacgtggggaatttctccttgtgggctcagaggttgtctgtacttcggtaataacaagggagtcgatctggatgttgtcttacaactgcaagtacgtaagtaagcgatgcttgtgttccgtaccaaggatcccatggtgagagaattgctagtacgtgctcactcgatgagtcgacacccgtgactcagactaggctggtagctgacgtctcgcgagcatagtgctcgctgcacctcgtgagggggctctgacagaggatacgggcgcacgtcccacaaggtgctggaccttcccttggangcgcatacggtaacgcaggaatattttaagagagccatataccaagaagcggaggttctagtacacatataacacctctgcaaggaaaccgcaaaagttaagttgacttgaatacgcgcggaaagcaccaaatcgaaaattttcggcgcaacaatatccattccactagccacataattctctcttcggttcgcgaatgttcggattggccaacggtgtgttcgcctatagcaccactggggggccacatatggtccttatccgttcatgggccggggtacttcggcctaatggttccagcaccagtttgttccgaataaagagaggacctcccagagaagggggaagcccagagcggtttgcgattggagggccccctgggaaatgtgcctagagcacgccaatttaggggtccgccttaatgcttggagtatggcgcccctgtttaacgcacaaagggagggttggcgtcctaaaagagcaacaccgtagaaacagggtatatgtgagggcgagaacaacgccccattattccccaattttaaacctctccccagcttttatttaccgagcactgacgacagaatgcagccatttcagactcttgaccgaacagacacgtgcgggtgtgtaagcgccgcgcacgggtcgaccacgacgtcaagtgcaagcgaggtggggatcgctgacgaaagacagagggttttaaacgcacaccatatagtttgccgccgcctctcatatttgttggtgtc

SEQ ID NO: 597264 - DNA, 931 bp, Homo sapiens
acacagtgaataacaacaaaaacaatttaaaactgtcgtaatggtccaaaccaccatgaatggtgttctgacgagtgatacacggcggtgcaggtctgactcatgagccgctgtccgctgatgagcttgacattctcaacaatggaaatcccgaactgtgctcactgctagtgctgctgcaggccctcgatggcatggcgatccacaccactggcgtcaggaaacaacactccactagagacgcgtacaatcttagaattcatctacattccattctccgtcctggtacgtctactttcttctacaacggtcccagccgagctgaggtctgagctgtgctgctcaaggctgtacccatgtgaagtacagatgcggagacccgtgtacaggggctacacagcaggaagctgtgtaacccaggggaagcaagatacaacttgtggcacatatgtgcaaggagcaagtttctaagtactattgcactaaccaactcatgatctgtaactccttcgtcaaggaaacagaatgtatatctacgtcaaacttccatttcagaaagccgaggtcaaaataatgagtcctggggaattcaaacttgtgttaagaaacatgtgtcccagtgtgcaactggctgcaaacagcagcttccttggtagtgtatgcagccgtgtagtcgtacgggttgctctaaagggccttggagacagtcctttcagatggatgtacatgtttttgaccttgcactaccccagtgtaggctccaaaacaggcatgcgaggtgccttttggaaaggccccggaggcactgtggccaagttggtccaaggttatcatctccaatgctgcaccaaggcttgccgaacaaggaagcacgtgattgaggcccctgggacaggtccaaggttcaagattcgtggcttgcctaaagatc

SEQ ID NO: 597265 - DNA, 339 bp, Homo sapiens
taccagggtcataagaatgcacatggacggatctgcagctctggggtaggaagtggttggtccctttccacggtcatctggatggtcgctgggacctaccccctgccatccttacccatctggacaggctctgtagtgcgtcgggcaagcctcatccttgggcttcttgggctagagctactagagctgcgcaagactcccggacttcggcacccccagttgacgcgacatggaacggtcttgggcacagcatggcttgctgttctctctctgtggagagccatcctggccccggctgacctgggcactggtgatgcccccaatctctgcgtcgctgaa

SEQ ID NO: 597266 - DNA, 93 bp, Homo sapiens
atggaccccaactgctcctgcgaggctggtggctcctgcgcctgcgccggctcctgcaagtgcaaaaagtgcaaatgcacctcctgcaagaag

SEQ ID NO: 597267 - DNA, 161 bp, Homo sapiens
ctgctgactattgtgggaaaaattctaggctatatacaactacgcaaaggcccaacgttgtaggcccctacggttactacaacccttcgctgacgccataaaactcttcaccagttatccttttgtctttctgcatattttcaacaaattagtcagcagca

SEQ ID NO: 597268 - DNA, 212 bp, Homo sapiens
gcccaagggacccggagcaaagtccctgtggccccggaaaaccccagttgagctttataaaaccacggggccccccctcccggggcctcccccccaagcaaacccagatcgctcaaaaaatgggaaccccgggcaaattgtttgtgccccctcctgggtttattataagggtcccatgttttttataaaaaaacatagggggtttcccctta

SEQ ID NO: 597269 - DNA, 182 bp, Homo sapiens
aggatccttaaacgaccgaagaaactgtaacgaaagaatcaatcagtagtaaagaaaaggaaaaaatggaaacatgtggaccacgtagaaaagttcactactttgtagcaccaggcaagtgttcaatccttcatgatgaccctagaaagaagacagtagctgactacaagcattccattcca

SEQ ID NO: 597270 - DNA, 102 bp, Homo sapiens
tatggatatgcagaatacggcttacatatgtatagaaggcagtgctaggcttgggacaccggaagtgcacaacagaagaagtatcagactcaccatgaatag

SEQ ID NO: 597271 - DNA, 332 bp, Homo sapiens
atactacgctgttagaaacgtactggtactcatgaaaatgtcggtgatacaccatgggactaaaatttacaagccactgaccccgaatgaaagcctccagtggaaacatgtggattactgcttcatattacactcaaagacttaactatgactaacatactagaacactatcatcagcaccatcagagctttggtgatgtgtagcttactcattctacagttgatatggaaaaggtactgctgacttaaacatggtcttgaggaaaagaagaacaatacacgacgttacgttgatcttaccacgtcaaaacaggtagggctccttgtaccct

SEQ ID NO: 597272 - DNA, 1035 bp, Homo sapiens
ggagctcatctgccaggctgtaagtgctaagcaccgctgccgtcgcctgctgccattttgatggcagcgaagagtccggttctagggacagctggagacagatgagtggtagactgaagatacccctttaccaaaggaaagctattttgcgaactatcttctccagcggagatggccaatgtgctttgtatccagagccagactggttatcctatctcccaggatttggctcttcagttaacaagggtagtcaatcccaaatgcctttacagattgcaggatcatcaggtaccggattgagtctcagtgtgagctcgcttgcacctaccagatatatcgctcatcgaacagtgtggccctgcatgaaactatggaaccctttggacctcaacgatcagaggttccagacttcccttgggaacataggtacaagatctgtcacctcaatgggactgcttcacagaaggaaaagactggctcatacaactttgccttgatgtcgctaggcagaccctttatccatgttgacacgcaccttgacttgtgatgggacaatatgtgaactgaattcacaaggctaatgattgcacctgttcgacccaagaacttcaccccaggtgccgaacagcttacttttgcaaaacgtccccgacgtacaagttggtgcccactcacagaccatgtccaagacaatggctgccacgacgggactttgaatcacatgtaccaaacagtatactcaatggaaccaaagtgatcctgactgtcacgccacaaaactaagaatggcacctgtaccgtgtggccagtaccacactcagcaacctgtgacacagaaacgtgtcctctaaaaacgatcaccaaggtcgcgatcaaacgacatcgcctccagcccaagaaggtgaggaaagagccgacaatatgagagccacacactgtcggcacatgtgccccaatcataccaacccctttgaccacgtgagcatcgcgacatgaatcgacgtaaccggggaaggagaagcaatctgagccacc

SEQ ID NO: 597273 - DNA, 102 bp, Homo sapiens
gcctcggacagcgccatatactacagtgcgagacatgaaatccatggatgttgtagtttatcctgtagagtggggtcctggttcgacccctggggtcaggga

SEQ ID NO: 597274 - DNA, 268 bp, Homo sapiens
taatgccggaacattagaaaccctgtaccgcgtagtggccattcccaattcacccttcctcttatcccctagcaaccaccaatctgttttctgtctttacgaattagcttattctgggtatttcatataactggaatcatacaatatgtggccatttgtgtctggcttgtttcatgtcacaatttttcaaggttcatctgtgtcgcagcatgtgatcaggatttcattgttttcttatggctgaataacattccattgtgtggattta

SEQ ID NO: 597275 - DNA, 566 bp, Homo sapiens
acggagtcatagtgttaacttattccacgtgtagagttttccagtgtatagatgataatcagtggtaatacagaggtagggagtataacgtgactgactgattcaaacagttcattgttcatatggatctaagtaccccatagtctcctaattgccttccttcctcccaggtgggttattctttacctccttaggttaaagtccaccaggcttttgtcctcagatctctctctccagagaagagagacgccctagataatatcttctagtcctgggggcttaaatgtcattgagatggtgataactcccagattcagttctgtagcctggacctctctctggaagtatagacttggatacccagctgccaattgaattctacttgaaggccaaagaagcatctcaaactacaagatgtcctacacataagtatggttctaatcccttcctgaccacccagagtggctcctccttaattgtaatcaattcttacagttgcctagaccaaaaatatgggagtcattcttaccttctccgctctactcatagcgcacatatatcaatca

SEQ ID NO: 597276 - DNA, 101 bp, Homo sapiens
aagcacgttactacatgacaccaggaacaaggtaatggagaacacagatgcggtggcacaggcacacaatggggaggcaggaggcaggacagcccatgtgc

SEQ ID NO: 597277 - DNA, 195 bp, Homo sapiens
caggcatagacgatatgagtatgaaagtcctcaacaggcagccaggctgcagtggctcacgcctgttaatcatcccagcacttcgggaggccgaggcgggcagatcataaggtcaggagatcgagaccatcctggctaacacggtgaaaccccgtctctactaaaaatacaaaaaaattagccgggcatggtggc

SEQ ID NO: 597278 - DNA, 690 bp, Homo sapiens
  misc_feature (192)..(193): n is a, c, g, or t
  misc_feature (198)..(198): n is a, c, g, or t
  misc_feature (225)..(225): n is a, c, g, or t
  misc_feature (587)..(587): n is a, c, g, or t
  misc_feature (591)..(591): n is a, c, g, or t
  misc_feature (595)..(595): n is a, c, g, or t
  misc_feature (599)..(599): n is a, c, g, or t
  misc_feature (606)..(606): n is a, c, g, or t
  misc_feature (612)..(612): n is a, c, g, or t
  misc_feature (616)..(616): n is a, c, g, or t
  misc_feature (619)..(619): n is a, c, g, or t
attctgcatacgccatctctgagagccatggagggagccacacccctggtgacttcatggtgctggatgggagacgctagcggatccttcagggccaagtttgataaataccaccgccatcattctgctcatcctcctcctgtttttttttttctcttacattctttttttcccggtttatactttaaaacnngatangattggaaatacttccttgcaattatngtgcaactcccaggggtgaacactcaaattagaaaagagtcatctctcgtggtagcaagggagggcttccggggtaaggactatagagtaagaggtggcagcaatctttcaagtgcccttttcagcagagggcacagaacagtagccgggacgtgccatctcgggcaagatttcgggtaaagaatctcttctaaatttctacctctccggttctcggaatcagcccataggtgttggatgaggggccactcttaaggagtcacctcagtatcaggggatctaggcgcttggtccaagggtcaaataaaaacctagtctcctttaatccaacgttgcaatccttagctagaaggaaattcagntatntacncttnggggacntaatantttngantagtaataacctttattagatgaaaggaagttttcatgacaacttaaatcaggtgaattccaggaaatcag

SEQ ID NO: 597279 - DNA, 412 bp, Homo sapiens
tcgcaggttaagggctacccatcagagctctgggtgaccaggtgcaatgagcaatgtcagtgagcaatgagtagtattttgaacggaatcttttattctgagctacagtctcaacagtggacttaaaatattcggcaaaccatgttgttaaatagatgtgctttcatcaaggctctgttctgtttgtactgcacaagccagagtagatttagcttatttcttaagggccctacaattttgggaatgataagtgatcattgttccacttggaagtcaccagtagcattggctcctaacatgctgagtcagcctatcctttgaagtttggaagccaggtattgacttatcgtttctagctaggaaagtactacatggcttcttcttccagtagagagttatttcatctcaattg

SEQ ID NO: 597280 - DNA, 1010 bp, Homo sapiens
  misc_feature (1010)..(1010): n is a, c, g, or t
cttaaagtattacgtgtccctgggaatattagatgtatgcagaacgcacagtgaacggagtgacctttctcttaaaccgttcatagatgtcactgacaatttactctcaagctattacgaaaagatcacaatatattccagcagtgtctagctaatagctctttgatacatgattcgatattatccatctgttcacaatctgtggactcagtcctgacccgaccgacatcgaattctcctctgttgtacaactgatgctttcttgtggtaattgttcatgttcacacaaagctgtaaaatataataacatccaggtaacctcttcgatagcgaggtttatttgttcagtatttctggaataataataatccataaacgtagttaaagcttcagtatacaattgctgtcccgagtaaatttctttacagtccttgatgtttttgtggtttacaacgagacagggttatttcagctatgatgtaactggtttgagatgtgtactttaaatgtccttgccctcgtttagatgtgcctctttgaacattacggagctgctcaccctttatttggggcaaccacggcaagaagctaaaatggcaataagggaaattgacttacaaacagcaatgtggatatttctaactgaaagggccatgtgctgatttcggtcgtccataggaaactctggttacatatctggtaccaagtaattacccacttagcaaagtggttactcagtgcctggcgtctttcgcattttacaacaagtttattttggaacagttgttccctccggcgaacgcctgtggataccccggtgcggtaggaaatgggggcgtaagaaattaatatttgcgcagaaaccccctagaaaaagggtgcgcccttcaatcgcgtgctgtggaaacttcctgtcctcccaggaccaaaatatcgcaaccgggaaaaaacggggaacttagacacaaagcggttccacagataccggcaacacaagctccggcgtaacn

SEQ ID NO: 597281 - DNA, 156 bp, Homo sapiens
tgagcatacccccccgacagaaaatatgttacgctaagagaaagttagcagtgcgatccagcagtcattacttgtgatgagctactccgtgggtcatgagaaggcccctgccttcagagactatgtggctgtggcacgaggaagcaaagatctttg

SEQ ID NO: 597282 - DNA, 419 bp, Homo sapiens
  misc_feature (8)..(8): n is a, c, g, or t
  misc_feature (26)..(26): n is a, c, g, or t
  misc_feature (62)..(62): n is a, c, g, or t
  misc_feature (106)..(106): n is a, c, g, or t
  misc_feature (111)..(111): n is a, c, g, or t
  misc_feature (227)..(227): n is a, c, g, or t
  misc_feature (279)..(279): n is a, c, g, or t
  misc_feature (373)..(373): n is a, c, g, or t
  misc_feature (381)..(381): n is a, c, g, or t
  misc_feature (410)..(410): n is a, c, g, or t
taccttanagttccattaaaaataancctcctaaacccatgttagggttaaaaccaaaatgncccatctcacaaaaacgagtttagttgaatgctcaattccttanaaaancttcatttaaggctgagtgtggtggctcatgcctgtaattccagcactttgggaggccgaggcaggaagactgcttgagcccaggagttcaagaccagcctgggcaacgtaggaanctccgtctctacatagaaattttattataaaagtagctggggatggtggcanacacctgtagtcccagctactcaggaggttgaggtgggaagattgcttgagcccaggagtttgaggttgcagtgagctgatcatccactgtacntctagccntaggcgtacagagcaggaccccatctcgnaaaaaaaaa

SEQ ID NO: 597283 - DNA, 218 bp, Homo sapiens
  misc_feature (153)..(153): n is a, c, g, or t
actgtggtgtaccgtcccactgagtatccaggatgaaccgcaactcatggttggttcctagtcagattcgttaacactgagccaggaagggaactcccaggaccttgtacctttgagggttattattcaaagtactacataccctctccaggnatgacaagggaacctttttggtttcagttttgttttcttgaacaaagggagcaaaatagtgcctt

SEQ ID NO: 597284 - DNA, 544 bp, Homo sapiens
gcgtgctctgtgcggtgagcctggaaagaccgtgaacggctggtagctggagcgtaggctgaatttccttggtttccagtgtcacggggatcatcgtgttcattagctgaagtccactgggtggtagatcatggtataatatatgtggtcggtatgctttgaggttgtatcaggcaagaaggtaaatcagtactggctgtccattgtggccagaaggcagattccagcagagcttcagcaccggctgtcgactggcaggaatgcatttctaccccgtttgcttaactgcttccttctcacccttcattactcagggtagccgtctctgcctcagggaaatcttccgcgggcccattatagatcaaattcttctgtgtaatcatagaactctgtttgcttacaccatatatctgaatttataattgtcatttacgttgtgttggttcctcacttcacttaaggctacaatgacagtagaggtcttatctgtttcatgtgcagagcttagtaagatgtctcccaacttgtagggactcagtgcata

SEQ ID NO: 597285 - DNA, 366 bp, Homo sapiens
tttttttttttgtaagagaagatgtctcattttgccacgcaggctagtgcaatcatagcttaagtatcgaattcctgggctctcaagggatcttcccgcctcagccatcccgagtagctgggactacaggcgagtgcccgccaccacactcttttaatttgttcatttttggtagagacgggggtctcaacatcttgcccaagctggcctcgaactcccgggctcaggcgatcctccagtctcagcctcccaaagcgctgggattacagacacgtgccacctcacctggccgaaaagaacttttatctgaggaatgagagtccttttaaattatcaggcccagatggctgggcgcagtgttggtgc

SEQ ID NO: 597286 - DNA, 143 bp, Homo sapiens
cacactaccacactccagcctgggcaacaaagcaagactctctctcaaaaaataaaataaaataaaagcaataatacagtgtgtaacctctttgggacagccttccactcagcatactttcctcgagatttatctaagctttt

SEQ ID NO: 597287 - DNA, 507 bp, Homo sapiens
  misc_feature (26)..(26): n is a, c, g, or t
  misc_feature (104)..(104): n is a, c, g, or t
  misc_feature (107)..(107): n is a, c, g, or t
  misc_feature (148)..(148): n is a, c, g, or t
  misc_feature (179)..(179): n is a, c, g, or t
  misc_feature (229)..(229): n is a, c, g, or t
  misc_feature (269)..(271): n is a, c, g, or t
  misc_feature (279)..(279): n is a, c, g, or t
  misc_feature (292)..(292): n is a, c, g, or t
  misc_feature (319)..(319): n is a, c, g, or t
  misc_feature (386)..(386): n is a, c, g, or t
  misc_feature (492)..(492): n is a, c, g, or t
gggtggaagctaataagaaatgctantgtgctccactatttcacactatcacactatacttgttgttttatgatattaaaacttatgctacttggtaaattatnctntgattttaaaatatgcaacttagtaaatcactgactacctnttttcttaaagattatggctttttcataacnaatatcgaaatcttacttttcactggccattgtctcgtaacccctggctntaaagctgtcattttttttaatgatcgcggtctctgctcnnnatatttcngaatgtctttttntgagtcttacaagggaatcagttttcntgtggtctttaacccgttttccactaatcggcttttgcgaagcttgctgtcctattttattttaccngttttttgtttccatttttccttttttccaaaaattcaaatttcattgcttcattagggcaaaattgttatttgattcatttcacgattacttcaaattaagaagnatagtttatattgag

SEQ ID NO: 597288 - DNA, 1329 bp, Homo sapiens
  misc_feature (259)..(259): n is a, c, g, or t
  misc_feature (617)..(617): n is a, c, g, or t
  misc_feature (709)..(709): n is a, c, g, or t
  misc_feature (1242)..(1242): n is a, c, g, or t
taaatgttaaatttcgggtttttttccccccatgatattgggatgataatcttttacaaagcaaccttttttagctcttcagaagtagggatttggtgtcattcgtgggccaaaggcctggccatggaaactatgggcttccagcatctggtgctggctctaacgtgggctcctggacaaaaactctaggaggggtcttcaaaaaaatgtatatggtaacccctgggtggccccaggggctggtcgctagagtctccanccaggcttcattcttggggacaaagtgtgtgttggtcccacccctctcgggtcgggaaaggagaaaactccattaagggtggggtcaataataaggggcccaggtccaaggagaactcttggtggtgagaggtgtgtattacatatagggatatccctctcacactatcagagatctcccgcccagtgtgtgggatctgtagaaaaggtctaaaatattccctctgagtgtaaagagagaaagatgtgtgcatctctctcacaaaagctctcgcgtatctatctctgttgtgtgccccaaactctcatactatacctctcttggggggaataatagtgagacccagtgtcgcaccaanaacacacagagggggggccgctttcatctgttgtgggccccagtatacataactcaatatcctccttttgagtaacactcttctcaaagacngcaccaacgaaaaaaaatgtgtgggggagagtatgtgagagtcgtctcagaggttctcagagagactctccctgtgtgtcttctttattcaaaaaccctttttttgttggcgcccctttgtggggagaagagggggtgtctccctctcacctccttaacaacccactattaaccacaaatactggtgttgtcggcggctggggagaagaagtaacgctctgcaggtgatgtagtcaaaacaacttgtgttttttgcagaacaacagttgttgaggcaacccccgtggggggaagaaataatttatatattaatcaccacccccccgtgggggaaaaaacatttttttctccaccaatatgtggaccacatgggcgccgacaacaattagataagtggtgggtccatacaaccaaagagaaaaggcggcgataatattttctcccccccctattaatattacatataagagaaaagaggagcgtcttatattacacccaccttttttacagtggagaagttccaacggagcccnctttcatataatataatctcacattgttttgcccccatataaatttgtgggcgataccacaataaaagaccccttgaggtaataggg

SEQ ID NO: 597289 - DNA, 844 bp, Homo sapiens
  misc_feature (31)..(31): n is a, c, g, or t
  misc_feature (703)..(703): n is a, c, g, or t
  misc_feature (709)..(709): n is a, c, g, or t
  misc_feature (739)..(739): n is a, c, g, or t
gaagaaacttgctaaagactcggcataaaancagatctccaactaaagacatggattcagaagagaaggaaattgtggtttgggtttgccaagaagagaagtttgtctgtgggctgactaaacgcaccacctctgctgatgtcatccaggctttgcttgaggaacatgaggctacgtttggagagaaacgatttcttctggggaagcccagtgattactgcatcatagagaagtggagaggctccgaaagggttcttcctccactaactagaatcctgaagctttggaaagcgtggggagatgagcagcccaatatgcaatttgttttggttaaagcagatgcttttcttccagttcctttgtggcggacagctgaagccaaattagtgcaaaacacagaaaaattgtgggagctcagcccagcaaactacatgaagactttaccaccagataaacaaaaaagaatagtcaggaaaactttccggaaactggctaaaattaagcaggacacagtttctcatgatcgagataatatggagacattagttcatctgatcatttcccaggaccatactattcatcagcaagtcaagagaatgaaagagctggatctggaaattgaaaagtgtgaagctaagttccatcttgatcgagtagaaaatgatggagaaaactatgttcaggatgcatatttaatgcccantttcantgaagttgagcaaaatctagacttgcagtntgaggaaaaccagactctggaggacctgagcgaaagtgatggaattgaacagctggaagaacgactgaaatattaccgaatactcattgataagctctctgctga

SEQ ID NO: 597290 - DNA, 454 bp, Homo sapiens
ctattatgaatatgcgatatgaatatcattatcagttttacatcaacaaatgttctcatttctcttgggtatatggccagcagtgggtgggttatggtaattctatgtttaaccttttgaggaaccaaaagactattttccaaagtggctatagcattttatatttccataaacaatttatgaggttttcacttcctccatatccttgtcaacattggttattgtctttttaaagagacaggttctcgttacgttgcccaggctggccttgaactcctgggtttaaatgatccacctgcctcaacctcctgagtagccaggaccgtaagcaaaacccaacacctgactctaatcatttttaagtgtacaattcagtggtattaagtatatttatattgttgtgcaaccataaccgccatccatttccagaactcttttcattttgcaaaactga

SEQ ID NO: 597291 - DNA, 869 bp, Homo sapiens
taccaaatttctggtattctacagaaagcttaaaatttacccaatggatacatggagaaatattattatacttgcctttaaaacactcaaatgatggctagtttatttagtacagaagtgttaatagataagtagtcacaaatgttccctcctccacaggaggatttcttgtgattactggcttttactcaattcctcccatttttctctgctcacagagaattaagcatttccccagtgcctgaatatgtaactgaataaataaatggggtattgaggaagaatatgggaaatgtccaggctcattggaattcaccttgaggatgctgtaatactgctcaggttgaaggggaagaaaagactagaatctgaagagaagatgtagatgaaagaatagaaagcttgttagatatctgactacaattcaaatatttttttttcaaatacaaaattttttatttaaatttctgacttacaaaaagctgtacataattaatatgtacaactacatgagtctggagataaatatacacccatgaagccatcaccacaatctatgccataaacctatttatcaccttttatcagctatgtagcaagttgcatcttttggattttagttcaaggacaagaagttaatttttaaatgactactctcaaagtctatgaaagtcttagacaataaacaaaaaaagggcggggtcaaagtatccttgaaggccaggttaggtaccagttttgtaaagtggcctagggggtggatataaagaaggaggcgcgttaaacgtgggtggaaagtactggacttggaagactttggtggattggaactgagtagtcggtaatagtttggagtgtggggaaggata

SEQ ID NO: 597292 - DNA, 425 bp, Homo sapiens
  misc_feature (23)..(23): n is a, c, g, or t
cggcctccgaaagcgctgggatnacaggcgtgagccactgccctgggcctacaattttcttaactagggttgaaggctctgaaaatatgcagaaaatcatataatggccttatgaaggttgtatatatggcagaaggattctgtttttctggacaataaagataaaaaagtagaatatattactgacatcagtttagaaaaatgtatagtagtgtagtgtacatacaggtaattgaacaaagaaatatcaataacaattggtaagagcatttttttttttttttgagacagagtctccctctgtcgcccaggctggagtgcagtggcaagatctcagctcactgcaacctctgcctcccaggttcagcaattttccctgcctcagcctcccaaatagctgggatcacaggcgcccgtgtcgacgc

SEQ ID NO: 597293 - DNA, 1314 bp, Homo sapiens
attaaaaactattgccattctttctgaggattacttcattgtcagcacacggagcgacttaaagttagaaggagggcagttgttcctaagttaggaaacgttgcacaggtttctgagagtgatagagcatcaacttagatcagagttgactcgatggacgcaacatactacatctaaacatagtgatcgtcttgtcatgtaggcgtactgcgaatcagtgtagggaacgaaccaatgaagagtcgacacttgagagggagccattgcacaaggctgcatgatgtgtagcatgtccttgggttaatccacgagacacatagcagacgcctttaccacgacacggcatagggcacgcgcaaagtcgaagggaaagctaagcgcgtagcgtctcgtaggaagagaggggacgtcttttgggtattaacccaccaaggtgtcgcacagcacacagcaagtctcttcatggtagttaaaccctttcatagttgcgtcggtgcgaacaatctaggattggataacacgatatagaagcctgtggcacccggcatatatgacagatcaagtcttgaggagtcttaaggccatggtgcctcttagggtaagagactatagattagaactgcgaactctgggagaaagttggtttgccaatgcctttgccacacacattaaggcagttgccaaggcacctttattgctccgagatagaactgagaacggcgaacgctcggagtacttcgatgcggatctgaaaaccgaatagaaggcgaagttattgggcactcgcaaggggcaacaaacaatcggttgagcactttagtctccgggcatccccaggttggctacacaacgtgaatgtttacttcgttttcgggacaggagggtttggaaccacctgcttgggaagcttcatagatggaggtacacattctttgctttggctccctttcgcagtccgagagctaacgaataggaactggggtccccagggtgaagaggttagccttcgaggcaacatggggaacacggaaagtagaatgcctgaagtgccgcatgaattttagcacccaggggttactagcatgcgactggttataatggcacagttgggcaatgaattccgggaccttggaacgtttatagaccttcgtcatgggagagcgccttggtgcagggcacgggtactgagcgcggggagtataaggtcccactctgaagagggtgacactgaggccgttggaatcccaggccaacacttcatacgagagactatgtgcaggtctggatccccaccagcgtgacgctggactgtgg

SEQ ID NO: 597294 - DNA, 177 bp, Homo sapiens
agcggttctagaccagcctggccaatgtggtgaaaccctgtctctactaaaaatcaaaaaaaaaaaaaaaaaaaaagggctgattccagagtcatttccaaggtttaatttctgtcattcagcccaaactcattactttatggttacttatggggaaccctcatctaaaaaagcaag

SEQ ID NO: 597295 - DNA, 143 bp, Homo sapiens
gctggcaagggtgacattgtctataaagaccttgcattttccacttgagcccaggagtccagggctgcagtgagctatgatcgcaccactgcactccagcctgggcaagagagtgagaccctgttgcaaaaaataaaaaaaaa

SEQ ID NO: 597296 - DNA, 433 bp, Homo sapiens
gggaaccacttccgcaaaggggatactttaaccaggtgtgaccattcgccagagtcccagtctttaagggttggaatcttgttttgagatgcctggattacaacccgtgaaagagaaatgtcccacaagagtggacaaacagaaatacagaaaaacagaaagaatagctatatttgcagtgaatacaaataagaacaagcatttgaataaacaaggaaatatttgggcaaatttccacaagtgaaagaataatatttaaaatatgtgtttctataattatattccttctggccaactcaggagtaaactcacagattttctgtctctaacccccaattaaggtgatgcttgtcactgactcacatgtacagggagtgttgcactgcaccctggaaattcattttaatgaccactttatagtcctatagtttat

SEQ ID NO: 597297 - DNA, 516 bp, Homo sapiens
actactttccacaggcgtactttataaaaatggccttctgaaaacatgagcggaatatcttttctcccagttgctgcttaccctggactggtttatggtgctctctgccatgaataagttattttatcacacatagtcaattgcatcaaatttattagttaggacataaactcagctactattaaaacaaaaatctaaacatagcaatggcataacataaccaaatgaaccaaagttcatttctttctcacacacaaaatagtctgaacactggaagtccaagactggtaagatgtttccacgatattgggaagccacactctatttatggttcagccatcctcaacccatggcttccatctcatattctagggtgacaggtccaaatctcatccaccacatccacactccagccagtgggaggagtagaaaggaagcacagagcacaccccatttctttcaagagtacatcatagacgctgcatactatgctcctctcagatccccctgtggggg

SEQ ID NO: 597298 - DNA, 323 bp, Homo sapiens
  misc_feature (18)..(18): n is a, c, g, or t
  misc_feature (61)..(61): n is a, c, g, or t
  misc_feature (138)..(138): n is a, c, g, or t
actccctgaccctcaggnccaccccgccttggccctccccaaagtgcctgggattaacagncgtgagcccacccatgccctagcccacccacattttcctttatcccagtcaacccattaatgggcacccgggttgantctgtgtctttgctgttgtgaatagtgctgtgataaatacacgagtgcagatgtgtttttggtagaatgatttcttttcctttgggtatatacccagtaatgcaattgctgggtcaaatggtgtaattttagttttttgtttttttttttttttacttttcagtagccattctgactggtgaccc

SEQ ID NO: 597299 - DNA, 943 bp, Homo sapiens
caaagagcgtgtctaccatgggctctccgtgacaaggataagttttgaatttttctttatggcgtgggagaggccacagccggactccatcgactccccggaatcaggtgcgaaggctttgcctcccgggttcacgccattctcctgcctcagcctcccaagtaacgtgggactacaggcgctcgccaaccacacggccggctcatttttctgtattttgagtagaggcatggtttcatcatgtgagccaggatggtcttcaagcttctgacctggtcatccgcccgtcttggactcccaaagtgctgggattacaggaatgaggccaggcgcgccatgggcccttggaccatggtaattgcaggaaccagagtctgcgcctctggtgcgccccaggggtggcagtgcacgcagcgccaccgttggctcaacggagaaggatcacgaccttccctggctcaaagcaagtactggcgatcggaccaccccaggaagtgggggctcaccgggtgggtgcataccccaggccccgggcaaatcgcggaggtccccacgccaccagacggggggtcccacaccagtgtgttcgcccaacgaggagtccaaaactcgcggcctccaacatgacccgtgccaaccctgggtccccacaggggggcggaaatacacggcgcacaccgccatggacccggctacactaactgagctgcaccacacaggggcgcaaaccaacgtaccaggatagtgtcacccggacaacggcctcaacgacgggcccaaacatacaaccctacgcccggcgccgacgacaaccctgcgacacactgtgagcactgtcgcccataacaccacaacaagcgcgacaccgacactccgcctccagacacgagccacacagccaccacgcggcggcaccgcaacaagcagacgcacccggaaagcg

SEQ ID NO: 597300 - DNA, 365 bp, Homo sapiens
cagctctcactgatgcaagatatgggctcccatggtcttggaaagctctgaccgtgtgcctttccagtcaggaacacagtgcaagctgtcagtggatctaccattctggtgtctggaggatagtggccctcttctcacagctccactagccagtgtcccagtgggcactctgtgtatggattctgaccccacatttcctttcagtatcgccacagcacaggttctccatgaaggctacacccttccagcaaacttctgactgcacatcctctgatatatagtcaaaggctcccaaacctcgatttatgcttctgtgcacctgcaggcgcaacaccacgtggtagccaccaaggcttggggcttgc

SEQ ID NO: 597301 - DNA, 208 bp, Homo sapiens
ttggctctgatggctccagacttggactgtgtcacattgccaggcttccagtgctccaactttgcagacggccttgttgtggtgacatgtctcgtgtaatctgcgcaaagcacaccatggcaagaccgtgggggaaacacaccagtggttttatccagccctgatgatctcttgaacaactttcatctactcagctgttgtggatgtg

SEQ ID NO: 597302 - DNA, 462 bp, Homo sapiens
cgttttttacagaattcagccagacaagactcagttgagagcttttctttttcccctaagctttcaaggctctcccttttggtttctaattacaagaataacaaaaaatactatcattaattttttgttttgattttaaagcttatgtttttcttccagctggatgttagtgagacacaggcctttttccttttttcatgtgtgatgctattcctcacgcctgagctctcacctctgaccataggcggcctgcagccaagcgcccactcctctctgtcctttctatttctgtgcgaattgggcttccctaggaagctccctgaccacagcactcaacacagagatgggggggcgggaaggtaccttctactttttggttttaacctcaagtgaagtgtaatatataatacatacctccagataagacatctggccctataagtgaccagctccatgaatgtt

SEQ ID NO: 597303 - DNA, 474 bp, Homo sapiens
ccaaagagcccttcagagcacaacgcaagaagatccatcgcagagtcctaaagaaaaaacagtgagaaaattgagaatcatgttgaccatcaacccatatgccacgaccatgcgccggaacaccattcttcgccaggcccaggaaatcacaagctccgggtggctcaggcagctgctgcagcagcggcactacaagccccatcagctgagaaggctggcggttgcaggccagaagcctgtggtaggtcagaaaggaaagaaggctgctgttggtgttaagaagcagaagaagcctctggtgagaaaaaaggcagcagctaccaagataacagcccctgacaagcacagcctgcggagaagaaacctactacagaggagaagaagcctgctgcataaactcttaaatttgattattccataaaggtccaaatcattttggccagcttcttttgaataaagacctgattatccagg

SEQ ID NO: 597304 - DNA, 772 bp, Homo sapiens
taagtaaacccggggttccaccatgtgggccaggctagtttcaaactccggacctcaggtgatccacccacctgggcctcctaaagtacggggatcacaggcgtgagccacagtgccgggcccactcggctttaataatagggagaaatttcacataagtataggtgagctaatatttaactttcttattttatataactaccatccatatttccaagatgtagaacactgaactaagcccggtgagagatgggaacaatacgtaagagtactctagacgtcagaatggttttctaaatagagaaatcaggagggggtcctagagtgagctagagtaaatctatctcaggcatctctacagggctatacgaacggtggttctcaaaatcctgggtctcaggactcccttgcagtctaaaattataaggaccccagagaggttctggtttcacatccatcagtgtcggccttattagaatgaacgtgaggcgggatggaagccttaaacctagtgttacttggtcacagtactataaccatttcattactgggaccttcactgtgaactcctttttcacaatctttcgcggagaggtctctaatttgaaccctttagggggcccgctaaggaggggatcatatttggccaaaggcctagtatggggcacaggtgggggaccgcaacgtcacaaggatggccttcacgagctaggaagggaaagacagtcgcttcaacacacagcgctcgcggcgccatcctactcccgccggg

SEQ ID NO: 597305 - DNA, 103 bp, Homo sapiens
cgacacaacacaggaagacagctcaaataggggcttggaaaggccctgtggttccccggagaagggcccatcagacctcagcagcccttcctctctgggacac

SEQ ID NO: 597306 - DNA, 153 bp, Homo sapiens
gttctccccctgtatgtataacctctccttctcctactccttaactgactaacgaaattctatgaattcatcgtgcacttgtgtcagcccacgaaccttactccatagagtccagcttgtctggaagtaacattgtcgttacccccatccttc

SEQ ID NO: 597307 - DNA, 773 bp, Homo sapiens
  misc_feature (150)..(151): n is a, c, g, or t
ggagatgagttcatgcgagcggtacttcgacggtgaggtcagaggcgggaatccagccctccacgcatataacaacaggcgagggagggacctgcccattatgaacctgtgagttatggtgaccttacgcttggacacgacgtccttagnnctcgacggagacgttgcttatcggcttccttgcgatatcccccatagaaaggtcttcactacaaagacaaaaagagccgctcttgtgtcaggtcattggtcctcgtgctagcacaatggactcataacgacacggttggcgtggcagctgtcatttcttgcgcttggttactggtgggcaaaattcttccgctccattttcccgcgacgccatagcgaacttacacatggaacccccgccgagaaacccttgcgggctactttgccctacggtaatatccgttgttatccggtacgcggcttgaaccctcgaacgacaccctgggaggttgcgaaggtttccgttggcctggtaatgcaccgccgccgcgttaccgccgttgcagtatgcggcggctaaaagggaatccccgtgggtgggttccatcttaccacagtgtaattggctgccgggtggggggccacagacacggttccattaccctgttggtggccgtcacggcacggggaaaccggtttcaaccaccattggtgagacggctatgaaacaaacgggccaaattcacaccggttccggtgaaccattgctggggggaccccagagcacgccgtaggattccata

SEQ ID NO: 597308 - DNA, 364 bp, Homo sapiens
attctaatcgcaatggcattcctaagtgcttaccgaacgaaaaattctaggctatatacaagtacgcaaaggcccaacgtgtaggcccctacgggctactacaaccttcgctgaggccataaaatcttcaccaaggagcccctagaacccgtcacatctaccatcacgctctacgaatcacgccccgagcttagctctcaccatcgctcttctactatgaacccccgctccgcagaaccgacccctggtcaactcgagctaggcctcctatttgttctgagccacctctagcctagccgtttactcaatcctctgatgagggtgagcattcaaacttgaaaaactaacgcccctgcattcggcg

SEQ ID NO: 597309 - DNA, 721 bp, Homo sapiens
agcgggggctccccgttgggcgggggcggcggtccgagcggctgcggcagcggaagcgggtccgggtcgcgcagggcgggggcggcgcagcgggcggaggcgtgcgtgggccgcctgggcagaatgtcacgatggacgagggcgtgacgccccgtgctcccccgacagcctggtctaccagatcttcctgagccgtgggcccggccgacgtgctggccgccgggcttggtgtgccgccagatggcagggccgtgtcgcgggacggagttcctgtgggagggagcagtttctacacgtactaccaggtggccgcggacgtgccccgaaacccagcggccatgtcctggtacggaggagtccagcggctgttatgacacggtgcccgtgcgtggaggtgcagaacgctgcgggaacaagacagaccaggtccgtgcaccctcagcttctccacattccggggtacccagttcgacgtccgtgagtccaaaggaactgccacttgtgaaggatcgtggagcaacgacccttgaacatctcgcatgatgcaacagcgcggacatgcggccctacaatgtgggagcctaacacacaagttctcccaggtttcaacaagggacgaactccgctacgtgctggcctcggagggtgtaccggggggccggcacaagtcctcatccgggcaaagattggtggcatcagcctaggtgagcacggcggctga

SEQ ID NO: 597310 - DNA, 578 bp, Homo sapiens
tcagatggatcacttgaggtcgagaattcaagcagcctggccgatgtggtgagacccatctttactagaaatgcaaaaattggctgagtgtgatggcgcacgcttgtgatctcaggtacttgggaggctgaggtgggaggatcacttgagcccggaaggtggaggttgcagtgagccgagatcgcaccactgcactccagcctaggcaacagagcgagactcaaaaaaaaaaaaaaaaggaaaaacaaaaacattaaggctcaaaaacacgggggctcatgcctgtaatcccagcatttggggagggcccaggggggatgggatcacttaaactcagggatttcggagaccagcctcccgagtgggctggggattacagggcggtgcggccaccaatacccggtctaattgggtataggggggggagacgagatttctccatggtgggccaggtgggtctcagaactctgagatccgggtaatctggctggcctgggcttccaaagtggtggagattatagggcatgagccatggggctgggccgaatttggatttcttatttacaagtcttagatac

SEQ ID NO: 597311 - DNA, 992 bp, Homo sapiens
gtaggagactagctgcacggactctaggaaccatagaacatatttagatcgaaagatcaagctattgatgcgcttttaaaattttactacataataaccccgtacaacgcagcagcacctagaagaaggtactatagcaatgttttagccctatatgtatagtatatgtaggctggctagcagggtgctctatgtaccataatggtacactacatattacatatacacggctaggcctagctagtactagcctatggggtctaccctagataattagatagatatataggctagataggccaacacctacataagccatagaaactatgaatcagataaagactaggagactatctatagctaggatttatgcatatccttataacatggagtatgggcctaggtgccccctagccccctagcgcacgctctctccgctcctctcgcctagtccaaccccccagccataccctactccccaccttgtccttcctcattagggggtcatctggtgagagttggaatctttttatctcttggcttttcattccctcatgtgtggcagcttcttatttgctcttggggtctggctcgggtagtcttaatctcttccttttccttagtgtgcaaggtgttattactttgtggcattgtcctatggcgtctctttggtatgtccttttggttatggcttattcctggttccttttccccccttgggtgtgtacatttggtatctttccgtatccttggggaattacccgatatataggggccttccttttcccagggggcggtaagacccgtgggtaatttggttggggggaccttagggctagtggtcctaattggttaggtgggggcctttcctgggtcccctcctcccctccgggcacctcacctccccccccctccccactcccctccccgcccccctcccgggccccgcccccctctttggcccccggattctcgggtgcgagttttctgaa

SEQ ID NO: 597312 - DNA, 370 bp, Homo sapiens
cacggggtactgggagaaagacacacacccaactgaagtcggcatgtgagccttggttgtggtgtctgatacccacagatgtttttgggcagctttcacagtgtgtgggttattgggctttcagtaaaacagtttgcagctctttcatggcctgaccctgttctttaaggtaatgacattggctaaatatctgcgggtatggcctttagaggttttacatttttatattaaaaaaacagagaagtcaggtggggcgcagtggctcacgcctgtaatcccagcactttgggaggctgaagcgggcagatcaggaggtcaggagatcgagaccatccgtgggtaacacggtgagaccccgtttccaacaggt

SEQ ID NO: 597313 - DNA, 930 bp, Homo sapiens
  misc_feature (13)..(13): n is a, c, g, or t
  misc_feature (32)..(32): n is a, c, g, or t
  misc_feature (83)..(83): n is a, c, g, or t
  misc_feature (89)..(89): n is a, c, g, or t
  misc_feature (130)..(130): n is a, c, g, or t
  misc_feature (192)..(192): n is a, c, g, or t
  misc_feature (493)..(493): n is a, c, g, or t
  misc_feature (526)..(526): n is a, c, g, or t
  misc_feature (544)..(544): n is a, c, g, or t
  misc_feature (547)..(547): n is a, c, g, or t
  misc_feature (568)..(569): n is a, c, g, or t
  misc_feature (571)..(572): n is a, c, g, or t
  misc_feature (576)..(580): n is a, c, g, or t
  misc_feature (628)..(628): n is a, c, g, or t
  misc_feature (694)..(694): n is a, c, g, or t
  misc_feature (698)..(698): n is a, c, g, or t
  misc_feature (703)..(703): n is a, c, g, or t
  misc_feature (707)..(707): n is a, c, g, or t
  misc_feature (722)..(722): n is a, c, g, or t
  misc_feature (724)..(724): n is a, c, g, or t
  misc_feature (739)..(739): n is a, c, g, or t
  misc_feature (742)..(742): n is a, c, g, or t
aggaggtcgctgngagctgggaacaggcggcngacagcggggaaatccaaatctcctcccaaagtgcccattctgattcaggncgatanccttcccgcggggcccccgtccacagatccgcatcctcaanagcgcctaccagcaacggtgtggtcagcagccccaactccaccagcaggcccacccttccantcaagtccctagcacagcgagaggccgagtacgccgcatgcgcccggaagcggatcctgtggctagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagacagcgcataaatgcaggcgaagaaaagatgccgccgttgctgccgtcaccgcctcctgggtcgtccgccatcgcgagttgcgactgccgtggcagacnagctggatcttgtagcagaggcgaacgacctgnacttactttgcactgttnatncccctttgctccgcccaattnngnncttnnnnncccattgccctgtgacctccccccttctcccccttcccactgtgattngcacatcgacaagggctgtcccaagtcaatggaaagggaaagggtgggggttaggggaaggttggngggnaccancaangactcagagagtcananagtgccacttggcanttnggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctga

SEQ ID NO: 597314 - DNA, 212 bp, Homo sapiens
tgagccggcctatcttgtcggggttgatacttgcaccaatcagcgctctgtgtctagctagaggattgtaaatgcaccaatcagcattctgtaaaaacgcaccaatcagcgctctgtgtctagctacaggattgtaaatgcaccaatcagcactctgtaaaaacgcaccaatcagcactctgtaaaatggaccaatcagcagacatgggcag

SEQ ID NO: 597315 - DNA, 102 bp, Homo sapiens
gggattacaggcatgaccaccggcgctggcgagatgacccagttgttataagcaagcatgcaggacagtctttgacagattctttgttttattactgttttt

SEQ ID NO: 597316 - DNA, 443 bp, Homo sapiens
  misc_feature (53)..(53): n is a, c, g, or t
  misc_feature (104)..(104): n is a, c, g, or t
  misc_feature (138)..(138): n is a, c, g, or t
  misc_feature (152)..(152): n is a, c, g, or t
  misc_feature (158)..(159): n is a, c, g, or t
  misc_feature (286)..(286): n is a, c, g, or t
  misc_feature (356)..(356): n is a, c, g, or t
  misc_feature (373)..(373): n is a, c, g, or t
  misc_feature (388)..(388): n is a, c, g, or t
  misc_feature (394)..(394): n is a, c, g, or t
  misc_feature (418)..(418): n is a, c, g, or t
  misc_feature (424)..(424): n is a, c, g, or t
gtccctcatctgcgtctggaaggaagtcatccgcccgtccctcatctgcgtcnggaaggaatcatccgcccgtccctcatctgcgtctggaaggaagtcatccncccgtccctcatctgcgtcctgaagaatcatccncccgttcctcatcngcgtcnngaaggaagtcatccgcccgttcctcatctgcgtcctgaaggaatcatccacccgttcctcatcggcgtcccgaaggaagtcatccacccgttcctcatctgcgtcctgaaggaatcatccacccgtncctcatctgcgtctggaaggaagtcatccgcccgtccctcatctgcgtctggaaggaagtcatccgcccntccctcatctgcgtccngaaggaagtcatccncccgtncctcatctgcgtctggaaggaagncatccncccgccgcgagcggccgct

SEQ ID NO: 597317 - DNA, 396 bp, Homo sapiens
atatagtagcacatactagtcatggatatagctgatgcagtcatcatttcacattataatgtaccacagctatatatgcagcaaaaaaaaaagttagtccctccagctgaaaagcggtcattactttattatcaccacagaattggaaagtgatttctggtagttaacagtcagatcttattttttaggttaactaaggacaaagtggaataattcactggtgagccaaattctttctgtgattccatctttttgggagcagtccatcatttatggagaaaaccagccttagaagggtgatttcaggtttcagggtgatttcagatagaattggtatttgggctcagcaaatggataagactgggggccaaggaaaaattttaaactttttttttg

SEQ ID NO: 597318 - DNA, 501 bp, Homo sapiens
agttcgacggagactctctgaatcccataactaatgacctcgagagaggctcctcctactttattaataagaggcgaggaagtataatccagcagtatgacaggtccgcagtggacgatcacagtgaacagaaaactcttggagccctcttgggcctgtgctttgaggcccctggctgccctggcatttctgggaccctgttgggttatcatggcctgaggcttctggatatcctccaaatgacaagttaatcacccaattgtcgccttcccatgggggactctccaaaaggactgatggtggctcggaaattagtcagagatctgggacagaggacgagcaaagcttcgtcttggggtctcatgggacctggggcatctcccccaagatatgtcgcagaggcgggactcagagtggtagcgggatgagtgttcagagttgtgtggcgtaggcatgttggaagggaagctcttagggctggaggtgggagggtgggaatga

SEQ ID NO: 597319 - DNA, 113 bp, Homo sapiens
gtgtggaggcagtcaagctggcgtactccatttagcccggcgctccaggtacacaggctgtagttgagccctacaactccatccccacaacctctacccacaacctctagaag

SEQ ID NO: 597320 - DNA, 735 bp, Homo sapiens
ctcctctttcacagtaatttctgaaggagatgctgccaatcccccccgcgctgcgaaggcgcaagcggtctaggtatacacttcacatggtttctttgcaggtcgcaacagcattttaatctgcgcccgacaattgcacaagtgcgcgcatgccttgtctgccagtggacgctccaatgaacaaaaagatagtaaattatgccaataaattggtgacaaagagctttgggatattttaatccaattattttatacaactataatgtgcttgaaagaattgtccaatgtgcttgaaaaatatgaccaaaaatacggaaggtctttttgctggctggaattgtgttcagtggacttttctagggtgctctacttttactccccccaaacaggtgctctgttgcgcacaagaaaactggaagcgcattgcttgtggggataaaagcgtctccgtggaccaagataacgcctctttcagaaccaaaactctcctcctgacattctgttctgccatcttatcgtagggaggatgggtccatcttaagaataaggttttcaaacaacaacaatagatgtggtcataatggactagggttgtcacaggaacagtctggtgtaacgtgcagaatttaaaatccccattattttgccattaaggctggtactcagagtgggtaattccaattccgaaagagttccctcccaagaaaaaggttttctatagaaagctataaccct

SEQ ID NO: 597321 - DNA, 187 bp, Homo sapiens
actgtactcactagcaccatctgacttatcagaatacaatatttcataataaactgccataactatccccactacatttacttaaacaatcacctaaaagagaacactgcatcagatgtattctggaaaaactttcattttcaattacagttattcccgccacccatcaataattccacttctaagt

SEQ ID NO: 597322 - DNA, 765 bp, Homo sapiens
ccaaagcacccagagtcaaagccaagatcatgctgaaggtgccaatggtgccaacaactccagaagctgacaacgatcttcctggacgacgaaacaattactggttacttccagcatctctagcttgaactgctcggacggatgtgaccagtactcttaccttttgagttggctgacagcaatctaagactcatgtcacgctactggctcgttctgagccattcaagactactgacaaggagacttcctaaggctcagccatctatggcttccgattggtcttgtgtcatactgcaatgacgctctttcatgcaaccatgacacaattcgcggcaaaagcactggtgagaaactcagttccacattgtgtaacacccactgggcgacgagtgtccaagaagaccatgggtattacttcgtggtttgcactctcgacggaacaagaaacaagttccgactaggtccgataaccttctgttgagacataatggcgacagaacttaaaactactcgaagaagctcggcggactgacagtttctgcgtgtggaccccaacgcgggcccacaatacacttctaatttcaggacaggcctagccaaacggcatcacatgagagacatgatcattaagcagctcccttggggttgcacctcttggtgaacaccccatagggctgctaacaagacaacgcgccgtaggacgctatcatttggtgtccaccattcggcccaataatgggaaccacaaagaggtgtcctatacag

SEQ ID NO: 597323 - DNA, 448 bp, Homo sapiens
  misc_feature (37)..(37): n is a, c, g, or t
actctgtcagcgatgacagagcagatcctcttcatanaaaaatgaattatcacagggaaatattgagtcactatgtgctcgacttgttggtaaaatcagagacaaaatattatgggcgggtcactggttcaggcctctgttctcagcactttgggaggctgagtagcggggatggcttgagctaatgagttggagaccagcctgggcaacatggtgacacccggtctgtacaaaaaatgcaaaaattagctgggactataggcgtgtgtcaccacacctggctaatcttttgtatttttagtagagacggggtttcaccgtgttggcaaggatggtcttgatctcctgacctcgtgatccgcctgcctcggcctccgaaagtgctgggattacaggcatgagccaccgtgcctggcctaatttttgtattttcagtggagaccgggtt

SEQ ID NO: 597324 - DNA, 438 bp, Homo sapiens
  misc_feature (3)..(3): n is a, c, g, or t
  misc_feature (56)..(56): n is a, c, g, or t
  misc_feature (140)..(140): n is a, c, g, or t
  misc_feature (162)..(162): n is a, c, g, or t
  misc_feature (164)..(164): n is a, c, g, or t
  misc_feature (233)..(233): n is a, c, g, or t
  misc_feature (284)..(284): n is a, c, g, or t
  misc_feature (289)..(289): n is a, c, g, or t
  misc_feature (297)..(297): n is a, c, g, or t
  misc_feature (319)..(319): n is a, c, g, or t
  misc_feature (347)..(348): n is a, c, g, or t
  misc_feature (354)..(354): n is a, c, g, or t
  misc_feature (410)..(410): n is a, c, g, or t
ccnccgctcttcagtttgcccgaagcttctgacgcgttttactaagttctaccatntaggccttttaacaacaaaaacattcaagccattgttaattaccttcagccatgtacctttcattgaaaattaaaaaaaatttnccctttaccaatctttcagatntnttctataataataaattataaatcattcatcatgtgaaaactttttagctattatttctctttctattnggggatttaactgaaggtatttttaccgcatctacaccttttgtattgttnggagntgttttgnattttcttccttttgatcattntgacacaatattcacttttttggaaaannattttnctacttggaaatcaaatacattctattctgctgggaaaaattacttactacgtatntgcaatgatctcctaagaagattttcta

SEQ ID NO: 597325 - DNA, 86 bp, Homo sapiens
atgcaaaggttgagccagaagtgaaagactccctgggggtttactgtattgatgcctacaatgaaaccatgacagaaaaaaaaaaa

SEQ ID NO: 597326 - DNA, 289 bp, Homo sapiens
ttaaggggcccccggggggcccccccccccccggggggggggggggggggcccggggcccccccgggtttaattttttttcctttcccccccggggggcgggggggggggggggggtttttgggggggtgggtttttttaaaaaaggggcccagaaaacccccctttttttttaaagggtttttttcccggggggggggggtggtttttggggggccttttttcccccgggaaaggggggggccccaaaaaagaaaggggttttttaaaattattttttttccccccca

SEQ ID NO: 597327 - DNA, 338 bp, Homo sapiens
aagatcgggcaactgtctatgtagcggagagctgcctccggtcagtaacatcatgattttgagtggtgtactctggactctacttcagtgtgtgtttggttgttggtgtttcttaaatttcctgttccacttctcttccctgttgccagtctactcatgatttctctttctcatgatgatcttcagaagagtgactggaagcgcactgctccactttcacagagctctgcatcattgggtatggagcagggcttgtgtagcttttgtctgcagcactttctaagtgtgacatgacataaccaatcagactacgtgattaagtgttgatggtacgggag

SEQ ID NO: 597328 - DNA, 473 bp, Homo sapiens
ccggcacccccgtagaacctgatgcgtcgatacaggtagagtgtcaacaatatatcattgcagagagtcatgaaaaccatcatcatattggtgtgagctccttcctcccctgaggcatcagcttggcaagcatacgctctctttgaaatctgggagttggtggggcgagggtcactgctaggcagcttcttcttgggcagacaaatctgcctccttctgagcagccaggaagatggctcgttccttctggaaagctggaagctcttctgaactgaggtccttgcaccacgcgaatgcccagtagaacgggcggacccgatgatggagcgtggctacggacgactagggcgtacatcctgcagggcaaatgcctcatgctgagctttgatgcgggcaatctcatacgcttgcttcagtgtcgccaggcctgccacctcttgccctgtttgccgggcccccttttcaatcccagc

SEQ ID NO: 597329 - DNA, 518 bp, Homo sapiens
aagcaggctcatcctgcgcagacttctgaggaggtgtacagtcctctgccatgtataaggcgatacatcaaggcgacggacaatgcagaagatggcaggaatcacccagttgataccagcaactagaaagacaccaaaagcaatgatgctagacatgatagtagcactgtggtggactcaaaatcttagccccttctaacagaaaattaccagggcatgtatttcttaactctgtaatgaatttagctgaaaaggcaacgtggattagctaaaagtgacatgagtgtaacacatgccctgctatactaggaatcactctgccctgctgacttaaatgagaaacctcatgccccacttggctgggctcaatggctcacgcctggcctctatttgaatctttaaattagattagaatcttaaaactatagatctatgacttaatttcttagcaaaatggaaattaatgtgtaggcttaagaaataggacttggcatacatatgtgtaacatagggactac

SEQ ID NO: 597330 - DNA, 918 bp, Homo sapiens
ggaaaggccgaggctagcggatcagctgagctcaggagttggacgaccagcctgtctctactaaacaatgatattacaattgagctgggaggtcacggatggagcgcctgtaatcccagtctactcgggaggctgaggcaggagaatgcgttgaacccaggagacagaggtggtagtgagctgagagtcgcacgcaggtgcagctctagccctggcgaacagatgcaagactgtctcaaaaacagcatcagtagagcaggacgtgagacttctacctgctcactcagacatcatttctgcagccaacctatgggccacgtttgtggagctgcagataccgaaagccatagatgcccatggtgggcctgggcagcttggaagtctcctcttgggaacgtgaaagaagcagtgaaggtggccattgatgcacggatatcggcacattgactgtgcctatgtctatcagaatgcaacatgaagctgggggaagccatccaagagaagatccaagagaaggctgtgaagcgggaggacctgtgcatcgtcagcaagtcgtgggccactttcttgtgagagaccccttgtgaggaaagcctgggagaagaccctcaaggacctgaagctgagctatctggacgtctatcttattcactggccacagggattcaatgtctggggatgaccttattccccaaagatgataaaggtaatgccatcaggtggaaaagcaaagttcttggatgcctgggaggccatggaggacctggtggatgaggggctggtgacagcccttggaagctccaaattcaggcattccagatcgagaagtcttgaacaaacctgggactggactatagaccagtgactaaccaggtgagtgtcacccatagttcaccacggagatactggtcagtactg

SEQ ID NO: 597331 - DNA, 371 bp, Homo sapiens
aacggttaaggggtacggggtccccatgaaaaggtcgggaacgggataggggggagggtggcacaacatatacatttcaattttaaaaactaaggagaaaatcttccatatgtagagctaaacaaaagtggtcgaactggacacaaaagctggacccacacaagaaaaactataaatgggacttcataaaaataaaaatctggtactcggtgaaagaccctataaagaggatgaaaagacaagctacacatggggaaataaaaggtgcaacccatatatggaacaaagacttagtatctaggatacataaagacttctcaaaactcaacagtaaaaaagcacaggatccaaggagacccctctccacaggg

SEQ ID NO: 597332 - DNA, 1578 bp, Homo sapiens
tgcggtttagtcccgaggtcgctccagcagcccggcctcacgcgacccaccattcccgccgccccctcacggtgcccgccgttacccgccgacctggcattatctaacctgggcccctagattccccgaccccgtgcccatcatggagacctgacagctccatgaccgacctgcgcaccgatacccaggagcccagtcgttccagaacgccctatcccatcctacaatggggcaccctagcattgccatccatcgacgaccccatttcctggactcgtgccttgacccacatccttgcaccacgcataaaccactgaccattggaatccccggtgcggaggatgccctcgccgcggtggctcatgggttccatgttccctctaaaactgccgggccggaggcgcttgctggggatagccggacatcctgcgagacccggaccaacgaccccccgggaacttggcttaaggcaagaaagcagtgggacatcagaagagagcatattgggaattcagtcccctggggactttcaccacaagacttcattgcggcacgcctgtggggccccagcacaggcaggaatccaggcacaccaaatgcacaccggaacaagagcacgtggcacaccatggggaccaataacacattcccaccaattcacactggacgaaaccaacacagagcaagacttgggccaaccagccgtggaacaacacttgtgtgacaggtacaaagagataatcacccacagtgtgggacacttacccatgggaggacaccggtctacatccaaggggccgaagcaggaccagtcattggaagccgagacaggcttcatacacacgatagtccccaatcgaagtggtgaccccgaatgcaataacgcaggataacccacaggcaaagcactgggcaacacgaggtgggaccacaaaaaaggcggaagatccgacaaaatataaaacgactaagggcacatgtgacctggaaagatagaaacaacaacggattcgatgtacctgtgggacaaaacggtgaatagcattgttgggacatgatgtagattgaaaagggaacccataaaatgatctgtgtggttgtggcaacatagagatggggagcacgcagtatagcataaacggacagaattataaacagcgtatctaaaggggtacactaattacgcacaatatttacagctgtgtattcacttgtaggttgataacctagcactgcacaatgtgcactggagtgacagatcacacacaataggcgcctacacaggggagaattgattacataacgaacatattattacagggaagagaaacgatgaaagtagcaacaacagaatagagcaagagaataataaagaaagcataaacaactaaaataagaaagaaactaatgagacaataaaagacaagaaagcaaaacgagatagagacataaaataactaaacaagaaagacaagacaacaaataccataacagaaggagacataaacaccgacagaacacaacaaacaccagaaaaaaaacaaaccacagacagcaagtcaagaagcagagaagaag

SEQ ID NO: 597333 - DNA, 957 bp, Homo sapiens
ccggtgaatggcgagcgaccggggggtacgtcacagcacggctccagtgggctctacaaggcgcctcggtcgatgaagcttctgcgggtccccagtgccctctccctcctgctcgccctcctcctggcctcactgccaggaagctcttgtgtatgaccttcacgcagtcgaagaacgagttccagattggaggttgatatgtggaagaataatgggccttgattggaaagatactttctgcagtagtctgcttattgtataattttaggatattggaaaagagagatatggaagcaggaaatatattgcagtcctttttgctgggttcctgggttttgtcagccttattctgactttctcctcatggaagctatgcagatatgtcttggcatcactgcagctagtaatgtgccttctggattcctggcacctgtgttcgctcctgttgggtacgcattatttgacgtagctccataccaagagtccaagtggcgacaaatttctgggtccgctgtccatgcgacaaacagagacatctgcatgttatatggttgggactgcagcttttcgacctcgggttcctacatctggtatggtagccgataagtggactgtatgtgcggtctgtggctacgatagcgatattgtgccaggtgcatcaggtgctctgcatcccgcagctggatggcagaagattctttgtcttggactactttgaacccgatctgcgtcttcttcagaacccaccaggaaagccagagtcgggatgggagccagggctggaacgtcagagacagctgagaatggagctgctgtaccgggcggctgatgtcctcgtccagctgcccaggggggcgactgggacgcgcggggggattgacactggcatggccgtcctccttaggcaggacaaagtaacaaaggcggcggagtgagcagcgggccctcttatttcgg

SEQ ID NO: 597334 - DNA, 1243 bp, Homo sapiens
  misc_feature (129)..(129): n is a, c, g, or t
  misc_feature (522)..(522): n is a, c, g, or t
ggacgtgacagtcgtctataagagcctggttggcgatccctgacgcaccgtcgtgatgcccaggcaagactcggcgagcgtggaattacagacctaccttacctgtagaggatcatgccaactatgtgnaagtcgagttatgcgcgacacaggtttccatttcgtgggaggcataacaagtgtggggctccaatgactgatgcacgccagattcggcgactgtccctattcggaggcgacagggctgtcggtgctggtagtgggcgagacgaacacctatcgaatgcggcaaaaggctcgattcactgagtgggcaacaccatggtggagtcaataaacctctaaccgtcttcgagaaaagacttgcatggcactcgatattcacccggcggcgaagtgtcgaggcttgtcgtagttccacacgaattggatggacacttcatcgatgacggatgtcgatggtagcgagtcgattgctataggcgcgacagtaatgggatgacaccgcaatgtctggccggntgtcctggctgcaatgtttgccccacatttgtagaaaggctatcatgtctgaccagcgatctgaggatatcagcatgcggtctcgacgagtgctgaaaagaagcaaccgctgcccttgtttatgtcaccagtggtcgtgttatggggtaccttcacgtacatcattaaataagtgctacccatgcgggcggcatggctatatttgcatacacctttccctcgtgacgcttgattttgctgcacaagtatcgtgtaattttacacgcgaactttggcgtggacacgaatatggcgtggggcgcaagacctagttcaggtggcgacccaaaagctaggaggctatagaggaactgccgtcgaagggaagattcgtgcgcgcacggtaatcgttcgcttctttggggtggctggagctctaggatccgaatggtagggggtggattttgggaacgatatgtgggcaaattggcaattacgtaaactaaaagccgcggtggataacagtttgctttgggacataattccgacccagggacgcgaacgagaacctcccttggcaagttctccttccgggttttttccccatagggaaaaggaggtgagtgcgcaggacaaaagatggatatgggcccaaggttggttcctttgatcttagggcaaggaagtttggggcgtataccccaaaacttggttgtaggccattccaaaggtataaccccca

SEQ ID NO: 597335 - DNA, 740 bp, Homo sapiens
gtatggtataagtacgcctcatcactcattctcaaccccctgtaccaaatacatagcctaccccttccttgtactatccctatgagtgcataattatagccaaggctccatctggctactgacaaacagacctaacatatcgatcattgacttactcttgcaatcagcctgacatagccgctcgtattaacagcacattctcgatccgataagagccccacatgtaagtcgtttacgcgccggtcggcagtcgatgtctcagtatagtcgccccatcgggactttccatcgctctattactattcatgtccgtagcgaaactcaaatctacgtaacgcgctcactagttcggcagtcataatcgcatcctcctcaaaggcacttcaagatcatcgtacgtccctagataatagctttctgatgagttctagacatagcctcgctaagctcgccttagcccccgactattaacctactgggagaactctttgtgcgtagctaaccacgttctcctgatcatgtatcactctcctaccttacacggattcaacatactagtcacagcccttatacttccctcgtatcatatttaccacaacagaatggggcggtcattcacccgaccatcattaacatcataaaatcctcatttacacgagaaaaaacctcatgttcatacactatcccccattctcgtctaattcctcaagccccgaggtcatttacccgggttttccctc

SEQ ID NO: 597336 - DNA, 150 bp, Homo sapiens
actgccttgcttgcgtgatctctcatacacggataccccatttttggcgactatcctgtgatcattgccctgttagctctttccagccagccacgcgtgttcccggttttgccttgccaggtattagagggtgtgatcgtatctgtctgc

SEQ ID NO: 597337 - DNA, 600 bp, Homo sapiens
tgcttaggattataggggaaagaaccaactcagccctggtgatcttctttcattttaataaatttagtatgttattttaaagtagcatattttctttctactttatgcagaaatcacatttcttatactaggtttatcaacatccattatttctttgcatatggctctagagtcattatatctgcttttcaggcttatgcagatttcaaccatgtgaaacatgaatataagcatgtccgtgattcttttttaaatgattttcacctacatttgaaacatgttatattagtcatggcctctcctttttctttttccttgttaaatgaatattgtgaattcatggcagaaactttgggaatcttacctaaatccagtataagtgacagacttaagagtttaactggtgtttgtttttgcatgcaaatcattagtccatttatttatgcatgcattcattcatttagcacctgctacgtgtcagatacagtcccagagctgacaatattaagaagaaggatgaagtattaactctttccctaaaatgcctgtaatctactggaggtcagacacaagacaagtaaatttcaggaagagaaaagt

SEQ ID NO: 597338 - DNA, 258 bp, Homo sapiens
ccaattggcacttaattactttgggtgggactcagaaactcagaagacacaaaaaaaattcacgacacagtctctactaaggagtttataattaggggatcacttaattagtaatgttattatattacatacttatatactggaattatcgagattaacccggctggtaaatttgatacttagggaaaaacctcactttcacacaggtgactactggctcttccatcagactataagcacctttcaatttcatgtttt

SEQ ID NO: 597339 - DNA, 372 bp, Homo sapiens
acctactactactaaattcgcggccgcgtcgacctttgattattgactctggcttttccaataaatcaaataccgcaaataatccccacgatcctcttgcagcccatggaccaacggtttcatgcttttatggggtaagttagaccattcaccaattccggttcgttggccgcactcagccagccgggtcacatactgatgtatgttccctgtctatcttcccttgccgccttcctgcatcttgaatgacgttgggtataaagagcagggcattccggcataaactctgaatgcaggcttaatacggtttcatcccgagctgttagccgcaacttgaaagtcgacgcggccgcgaatttagtagtagtaggc

SEQ ID NO: 597340 - DNA, 271 bp, Homo sapiens
gctctcttttccgttttgttctccaccttcgccacgtactccccgccttttcaaaaataaatcctgtatccctgtctcatccaaatctacatgatagtccaccctggtggcaaccagaggcccatgggagatgtctggattcgcagaggaatagctccatgtgatgcaaaccttgactaatgggaacaggaaaagggaggaaaccaggaagataaatctccctcccttcttattgctccttgcaacccttcccacttgaagcatgacccca

SEQ ID NO: 597341 - DNA, 757 bp, Homo sapiens
ttacgggatcgaggcgtccatgttggcagtcgttgggacctggcaagcattgtgcctagtgatctccttcgggtttgatccagatccatggggatggagccgtacaccaggcagcctcagggagagtgggcgggtgtcaagggaagccacggtcccagatggcccccttgtgtctgagctcccatggcttccttctgcctctaggctatgcccactggtatttggccgagtgctgaattcagagtgagctccagagagttgtacgaaggcctgaggctgaacgactatgaatcaatatgacttacgtgctcacaggttatacgagggacaagtcgttcctggccatggtggatggacattgtgcaggatgctgaagcagcagaaccccagtgctggtgtactgtgtgtgatccagacttggttgacatgtgggacgtgcgaaggctcgaatgtaacgtcccggagtggcgtccttctcgcgtactactaaagacatcagtggtgccgctttgcagacgattatcacggcccaatacaagtttgaggcctgaggtaactgagttgtccgtcatgatccacagccaggcaggaagccttgcgtggtgatggacatgcgtgcagatctatagggccccgaacaccgtgggtcatcagcagactccgaactgccctccccggcagggcagcaactacctgattgtgctgggagtcagagtgaggaggaatcccgctagggtccgtggtgatggaacgcatc

SEQ ID NO: 597342 - DNA, 559 bp, Homo sapiens
ctgtatacaaattctcctatccaacgaaaggcccaggtcctgacgaattcactgccgtatctaccaactattcaaaaaagaatgaatattaatcctactcaaactcttttttaaaaatggaagaagaggcaatactttcgaactcattctacaaagccaacattacctgatactaaaactagagaaggatacaacaaagaaggcaaactacaagccagtatcactgaagaacacagatacaaaaatcctcaaccaaatacttgcaaacacaaatgcaacaacacattaaatagatcattcaccattatcaagtcagcttcatccctcggatgcaaggatggctcaacataagcaaatcacataaacagacccaatgagaaaaaccacattattatctcaatagacgcagaaaaggccttctataaaattcaacaccccttcatgctaaaaactctcactaaaccaggtatcgatggaaccgtatctccaaataatcagagggataatgacaaagccacaggcaatatcatactgaatgggcaaaagctggacacattcc

SEQ ID NO: 597343 - DNA, 435 bp, Homo sapiens
gaattggtggggttttggtctcactgacttcaagaacaaaaccgcagaccctcatgatgtgttatagcacttaaggtggcacatctggagtctgtcctttattgatgttcagatgtatttggagttttttttttctggtgggttcacggtcttgctggctcaggaggcaagctgcagaccttcgtagtgaatgttacagttcttaaggcaacgcatctggagttgttaattcactcctggtggcctcatggtttcactgtgcttaggagtgaagttgcagatcttcaccgtgactgttacagctcacaaaagcagtgtagacccaaaacgagcaacagtaagatttattgcaaagcgagagaaaagaggaagggagggggaggaagggagaggaaagagagaagaagagaaggagaaggaggaagaaaagaaaaa

SEQ ID NO: 597344 - DNA, 137 bp, Homo sapiens
tgataaagccttaagcggagatggccctacgatgcccaggtctccatgtggttagcccagcatatgagcaaaggctgtgcgcatcttcagttgtttggaaaagtaaattcactgacacatctcactaaaaaaaaaaa

SEQ ID NO: 597345 - DNA, 751 bp, Homo sapiens
  misc_feature (168)..(168): n is a, c, g, or t
gcttatacatgtctgttctgattttgtcccttctagaggggaaagggaagaaaagaagtttgtgactctagttgtttttttgtctttttgtttgacgacagagtcccgctagtgtcactagcgttggagtgcagtgcgtgtgatcttggcgtcactgggaacctctgntctcctgtggttcagagcgattctgccgtgtctcagctctcccgtagtaacctgggtgctacacggcgttgtgccatctacagtcgcagctaattgttgcgtattgtcttcagtggatgactggggctatcccgcgaggctagtgtcggagcttaaatgcttggttaggcgagcataggtgttgagtccgttttaggcagccctagagttgcacgtcttgcacaggcccttagccggctagaaacggtaatgcagtattcgagtgcagacgctggcatcttctgactcctctgggcaggctcagaaggacactattgtcagctctcttcatacctgaataactaattcatcaggagaagttagcagatgtgttggcttgtgactgactagaaaataaatcgcattggggctaacttggttttcaggtcttgctcttgtaggctccttagaacagggtcttaacagagagtgtcatattcgagtaggtatagcgtaggtgtgtagggattcaatagtatacattcagaaaactgatgggttttaaagacaaatgaaggggccaaaaagcaggaaaaggtgaatg

SEQ ID NO: 597346 - DNA, 130 bp, Homo sapiens
gctcccagtaaaaagaaaggctgagcgcaagagtggggtacctccagaaaacatacctacatacgtccagcacgcaaggtctcaggtaaagtatgcagcaaaagttggagtgaatatccggacatgtgac

SEQ ID NO: 597347 - DNA, 1151 bp, Homo sapiens
gggaacccgccttggtaaaagaagtcctcccgctggctggcgcgaagtccctccgggtgcggttttacccctctatttccccggttcaggggcagttaccggtctcgcactcgagccgtgctgggctatgaactccctcgccaccgttaattgtaggggcccaactttagcgttataatttcgggtgttctgtggcgtgccaacaatgggatgtaagtatgggtctcaccgggccgtggaatttccgcttggtgggcaacggctttcgtaacgcttgggtggattgcggcataaccccttcccaaaccgaacagccgacgtggctcggtgtcccgaagccggtcctcgccaccgggccaatgatttgaaggccaggccaccacgaggggtggtccctcctgtggtgtccggacggggggggggtgcaagggttggtctgagtaaacccacgggtacacgggtaggacccgtggaaaggaagcccctggaggctgtgtccgcccgtgtccccggggtttgtcgtaggctgcccagaaagggctgcaaaagtccaacgttgttccacttggtgtgcctttggggcatccccaaagcataggtcaaccagcctgttatccttgcgtgctctaaactcctccgaggccgttccccggcaccttcatgacggagcacaggtaggcaggacgcacgtcggtatgcactaggaaagtgcgggctaacagaggacgctcggccaacaccaggggagcgtagtggcgactccgcatcgcgccctgccgcgtgcgaagcacccgagtgtgcacgggtcggacgaaggtccctagcacacgataaagtctgatagcgggcgtacaggcacaccccatgccgcctgccagcggtgcgagaccgcaggacggcctgaagcgccaaactaggggcgcaccttcgtgtacccgtcacttgcagggcacctgagccaaccgctcagcaggagctggggtggcccctgagctccaacggccataacagctctgactctccacagtgaggccacctttgggtagcaccccacgtgggtgctgtgtgtgtgtgtgagggttggttgagttgcctagaacccctgccagggctgggggtgagaagggaaagtcatagcgtccccattactt

SEQ ID NO: 597348 - DNA, 189 bp, Homo sapiens
  misc_feature (135)..(135): n is a, c, g, or t
cccttcggcaactgctgggattacaggcatgagccatcatgcgccagccgctaatgtaacgtaacctatgcacacgtccctgtttgtcgtgctcgcttttttatcggctgcacgcagtccacgtgcagtcctcangtcctctcttcctctagcctcgagcgcccagtctttgtcccacttatagagtgc

SEQ ID NO: 597349 - DNA, 135 bp, Homo sapiens
agcagagaccatcctcattcatggaccgatactctgcacctggtgagtgaggacagtcccaggtgagtcccatcgatcttgaatctcagtgccactgccagtgccattcaccactgcgtccttagtcttatcgag

SEQ ID NO: 597350 - DNA, 505 bp, Homo sapiens
ggcaacttagcaaaacaccatctcttaaaaaaaaaaaaaaattagccaagcttggtggtgtaagcctgtagtcccagctacttgagaggctgaggtgggaggattgtttgaacccgggaggttgaggctgcagtgagctgtgattgtgccactgcactccaggtggggtaatgcagcgagactgtgtctcaaaaaattaattaaattaaaaattaattaaagcgctccaccgtgtctttccttttgagagtgtggcattagcattttcacacaggtatttggactggttttacaggcttcaacttaaatttaattcccaggtattcttagcacttgggggtgggtggcgaacggattaacgggacgataactattaaggccaaggttgcccaggaacaaggggctttgggcacaccagggcttcgcctttgaaccaattggtttttggggtggtcaggggaggtgtagtgtgtatttttttggagacagcattctcattggcatt

SEQ ID NO: 597351 - DNA, 2433 bp, Homo sapiens
aagggcaggaaactgccattttaatttcaccctgggtcagaattgtcaggagttagggtgactgcaaagaagccctaggcctgaagcctcaggctctggtgtgccgcaccacaccacaggtcccagcctaatacttcccagaaagggaatgaagcagagagtaggcagagtcagggggcaggggaagggccgtgggaactgatgtagagggctggtgatggtgaagctggtgaagccccgggagagacctgtgggcaggtaggaggcagctcgtagcatggccatggagccaggaggcatcagagcgtgagatggtgccaacctgggaatgcagtgtggcctgtagggaagcaaggttctaattggtcagctgctctaggactttgaggagaaaggactcagagatgtcccttgattggaggaagggtgaaagcaaaaagttgcatggggcattattgaaagggtgtcaagaatgggactgctagaatgaggaagcaaacataaagctggacacccagacaaggaggagccctggaaaaagaggggaagggtaaagagggggcctccttccctggaggccatctgatgagggtcgatgggccagtttgagaaccatttgtggcaagcgtttaaatcccaggctgctttttgccccagtacctggtatccagccatcgattgatgtgctacgagagaagatgaaccaattttattattagcctgaacaaaacataattaggaggagaaatttgcttctgctgttgcagttgctgcagcaaagaagttacataaggttcattcggatgacttgggaacaccttccctacttccctattcctgttcccgtttctctggcttgaaccaagtaaatagaggtccagagcctccactctgccttctagaaattcccaagacagaaatgtgctcaaggagcagatctaagaccctcagcctatagcggacacggaacaagggcacaaatcgaataagtcagtgcattgtcatgatgaacatgtggacaaaggcaagaaaagggagaagggacaagagagaggagcagactggaggagaaggaataaagatctgaggcatagctctgctcctgtgatgttagaggaagggaaggtggaaaaaaaaggcattgaattattctcagacaatttcagaaggaccagatggattctggaaggaattaactctgttatgtcctgtactagtatcattactacactctaagatgggcaaacgaaaggatttggagcattttggcagatactctttgggtgattgagagggggaggtaggagggcatggctgttggggtgactatatgggggtcgcatttgggctgaaagttaaggccacagacacatcccaggctgagctccacactgacccccttagactgaggctttcactcagggcacttaacttgggtggagggaggcaggagtggaaactccaggcctaattgctaggtctctctcagctcttccagggagcacggggcaggaaattcctcaaattccaggcttgtaggatcattgctgagcttaaccgcagagcaagagaaagaggcaggagaggcagagaactgccttctctccatctttttttcccttgcaattttaaagctgcagcaaatcagaagggtttggaggggctgatggctatgagagaggccccaagcataacacccccgaccctggtaaagaaagtcccaagtctgggaatcccagagaaattagtcctgaattgagtaagtttgaagtcaaaaatagactgctgtggcccgggataagcatttttcccagggtgaatttttttagttcttcagaatagccagtggtaaggaagttggtttaggagcaagaactgtcttgctgaaataaatgatggctgcgcagggagcacattggaaggggtcttggggtggacagaatttccttttgctctaagggtgaaaccagtcaggtctctctctttctgagctctcctcccagagcacctggtcaggatatcccagtcatcacctccgggaagatgatgttccctggatagcccatacattttctcacctccatacctagctaacactgctgcatcagtcccaatgaccccacttcccatcctttactctctgagatctggatttgccttcaagatgcaccccccatgccactttcttaaggtagtcttctcaactccccccaaagaatgaactattatttttggggggcttccaaagcaaattgctttgaaattccaaaagatcatacattctgttttaatcatagtgggttgttaagctcctgcactagactataatgctacttgtggatagggactatgatttgtttatatctgtaacttccgtctcttgcctcttttccccagcatagagcagaatgactgccatacagtaaatcaaaa

SEQ ID NO: 597352 - DNA, 474 bp, Homo sapiens
tcaggcagggaggaatcatgtctgctttgctcctggtgtttcccctgagtcactcagtgattggtatttagctagtatcccctcagcatctgctgaataaatgaagaatggaaggtgactgcacagaattgaggaattaaagagtcagagattggatggccaggattggcaggagataagaaacacaggccgatgggcataggctctgcttggagtgcagcaggtagacccctgcttggctagaaagcagcatgcagaggggaggggcagggtgtcaggttagagagaccacctgggggttgattgagaagagccttgaatgccatcatcatgaagtgcccaagacctttaagtggctgagttagcactcacagaggggatggaggagacctgctttcccaagatgaagattgtaattggttattgatgtcctatttgtatgctaatgctgcttaataaaatagctaagccata

SEQ ID NO: 597353 - DNA, 116 bp, Homo sapiens
  misc_feature (93)..(94): n is a, c, g, or t
gaaaaatgaaacatcggaaaaattcccgaaaacacaagaaagaaaagaaaaagcgaaagaaaagcaagaggaggtcttaattattactttttnnaatgctagctttactattctga

SEQ ID NO: 597354 - DNA, 1825 bp, Homo sapiens
aaagaggcagctccgagtgaggaccactctacgagcagcaaaactgcattgacatacgatccgtgaaagaagattaggaatcttctcgcgcgctgaccttgctgagcgcctggcaccatacattcgagcacacttaatgtgctgcacccttggattcgcttactctgggagcttggctggctcacgatgcacggcagcctctcggagcagagttcgcttcctggcacgctcatcgacgctgacacacaggcaccaccaactggatgaccacactgccactgactcgctcgcctctcgcacactggctacaaggctggccctgctacttgcactaaaccccaccacagggcattgcacgcagttctacaccttgacgacgaccggcacgctctggttctcaacccccttctactgcgcacacacacagtctttcgctctacgcaacaacttccctcccacttacacaaacccgtggacattgggtctcatacttggcaacgcacggcaaccatcggtcgcccacggcccttacacaacccttcgcgccccaacatcccttgggccttaacttgcgaggcggccccaacaaagcaacttataaatttggcctacatacgcccaaacgccgacatggcttttcgccccatcatcccccggaacagactccaccttggccaccgagcgcaaaccccgcaggccaacattaacggcacgcagcgcctccaaacagatctccaacctccatgccaccacacaccttactccgccccgagacgaccatatcaaaattaccaagaccgccacacgccgacccacacacaccggcggccacagcaaccgacggcccacaacctcccacggcccacactggccgacctccacatcttcggccccaagttccaaccgtgcgcaacccccaagcaccagcaccgcggcgcctcccctaatccgctcacgattaaaccccacgtgctccggtccccacccacactgtgccgcaacacacttcacacactcagcggcaccaagcaagcggaacgacacccacacacgccaaccccaccacgccgtggcaccacttcccgacactcgccgcgcacacacccaagcaacaccgaccacaccgaccacactcagaaacgcaccgacaccattcaccggcagcaaacaaaccagcgaccggcgcagacagcggcggcatcatcaccaacacacgcgcaggacatcaccacgcacaaccacagcacggcagtgcgcacccacaaacgggacaacgcagcagcagcacacacacaggacacaaccaggacccgccatcagacaaaccacgacgccacactactcaccacacacacagcgccaccacaacgaagcggccacccacgcatactacccccccgctgggacgcaacaccacccacacagctgccccacctatgtgcggcgaacaacacacgcagcaaccgaccacgagcccaacgccaacaacacactggcacacaacacgacacgccacgctggccaccccacacccgccggagtcgccaacagcgcaccacacgcgagcagacgcccacacccacgccatcggcccaccgcccagcccacgccacccgaccaggcatccactgtgcgcacaccaacaacgaacaaccacacgcacacgcccagcgcagcactaacgaaccgctgcaacagcacactgccccaactaacacaccagagcccccccaccacgcgcaagagcactcaagacgaaactgcacaccggcgaacaagagccgacccccatctcacaccacaccgccggccaagcaaacgccag

SEQ ID NO: 597355 - DNA, 943 bp, Homo sapiens
  misc_feature (943)..(943): n is a, c, g, or t
gctgcgctgacactgaggggtgtcgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggggtcaataatttggcgtcgccgtgggatcatgtagacgtgctaggctggagcgagctgcagtgccaaggatttgtcgaatgaagccatctcccatggggacacgtgcagtcgtgaagggtggccactcgtgcagcccatatcctgtgcctccggggcctgcagtccggaaccttcgatgcttcacttttggacacgagggggaatatcacgtcgcttccctcctgtgccagacctggcagcctgggtgtcatggagtactactctgatggatgctgcctccttgctgcctgttctggcccctcggctgcagcctggggacatcgtgcttgacctatgtgcagctcctgggggacagaaactagcgttgttcagactggctgttgctgcaatcttgctgcaatgatctctccccggtcccggaatagacccagacctaacagaaaagattcctttcacacggctaatggtggccttgaagaagactccgcgcgtggggaaagtccaaagctccgagttaccctacatcggggactggccgggacagtgggcgaagaacggggggggggaaacctaatgaaacggggtgcgggtgacttggcctggatccaaaaacgcgacctctcttatgaggggggaacacactctatagggacaggaagaaggcgaacaatttccgttgcaaagatctggaaggcgactgtcacaaagagaagattn

SEQ ID NO: 597356 - DNA, 359 bp, Homo sapiens
cacgagatagaaccaagcactttctttattcctttgttcagagcatttccattttttagtaattgtttcacatggaaatgaggcaaaatgattaacgaaatttatgttttttagacagggtgttgtgtttacaccaacgagaaggctgagatgctcctaaatgtgatgttataagcctaaggcagacttgactagcagcaacaagttttttacactactaggaaagcatgtgtcattatagtcaggcctgcagctcttttctaccatagccgcgaaatgattcataacaggtgttaactgatcttttggtggcttgggcttgtgtttgacaaactcaacaagttgcagtccttggttgg

SEQ ID NO: 597357 - DNA, 141 bp, Homo sapiens
aatacggtatgtattgtagacgtctgtagtctcataattcagtatggccacacacagaaattaccagtagaaacaaaatgagggcacacttgctccctgatcctatgcttggcccttccaacctcctattagaactggctt

SEQ ID NO: 597358 - DNA, 144 bp, Homo sapiens
  misc_feature (8)..(8): n is a, c, g, or t
  misc_feature (63)..(63): n is a, c, g, or t
cgactccntagaggatcccctacttttcacagggattagtacatgtaatcttcatttagaaantgctcccaattgggcttgcctctattttgctcctcctttttgttttatatccctcattgagcctttgcctcggaccatgat

SEQ ID NO: 597359 - DNA, 895 bp, Homo sapiens
  misc_feature (58)..(58): n is a, c, g, or t
  misc_feature (61)..(62): n is a, c, g, or t
  misc_feature (64)..(64): n is a, c, g, or t
  misc_feature (104)..(104): n is a, c, g, or t
  misc_feature (106)..(106): n is a, c, g, or t
  misc_feature (110)..(110): n is a, c, g, or t
  misc_feature (115)..(115): n is a, c, g, or t
  misc_feature (137)..(137): n is a, c, g, or t
  misc_feature (143)..(143): n is a, c, g, or t
  misc_feature (152)..(152): n is a, c, g, or t
  misc_feature (155)..(155): n is a, c, g, or t
  misc_feature (167)..(167): n is a, c, g, or t
  misc_feature (185)..(185): n is a, c, g, or t
  misc_feature (187)..(187): n is a, c, g, or t
  misc_feature (196)..(196): n is a, c, g, or t
  misc_feature (206)..(206): n is a, c, g, or t
  misc_feature (217)..(218): n is a, c, g, or t
  misc_feature (225)..(225): n is a, c, g, or t
  misc_feature (227)..(227): n is a, c, g, or t
  misc_feature (250)..(250): n is a, c, g, or t
  misc_feature (253)..(253): n is a, c, g, or t
  misc_feature (257)..(258): n is a, c, g, or t
  misc_feature (264)..(264): n is a, c, g, or t
  misc_feature (271)..(271): n is a, c, g, or t
  misc_feature (293)..(293): n is a, c, g, or t
  misc_feature (300)..(300): n is a, c, g, or t
  misc_feature (330)..(330): n is a, c, g, or t
  misc_feature (337)..(337): n is a, c, g, or t
  misc_feature (344)..(344): n is a, c, g, or t
  misc_feature (354)..(354): n is a, c, g, or t
  misc_feature (371)..(371): n is a, c, g, or t
  misc_feature (392)..(392): n is a, c, g, or t
  misc_feature (398)..(398): n is a, c, g, or t
  misc_feature (414)..(414): n is a, c, g, or t
  misc_feature (422)..(422): n is a, c, g, or t
  misc_feature (427)..(427): n is a, c, g, or t
  misc_feature (450)..(450): n is a, c, g, or t
  misc_feature (464)..(464): n is a, c, g, or t
  misc_feature (477)..(477): n is a, c, g, or t
  misc_feature (511)..(511): n is a, c, g, or t
  misc_feature (533)..(533): n is a, c, g, or t
  misc_feature (538)..(538): n is a, c, g, or t
  misc_feature (545)..(545): n is a, c, g, or t
  misc_feature (746)..(746): n is a, c, g, or t
  misc_feature (818)..(818): n is a, c, g, or t
  misc_feature (895)..(895): n is a, c, g, or t
aaaaaaaaaaaaaatctcacaaactaataaaaaccagaaacaaaaaaaacaagttagnacnntntcctgaaaggcaaatctaacaactgcagaatggacttctncnttcncaacntttgtgaaaaaaacaattctcntaaggnatcaaaaancantgagtgcaaaangggaagttcaggtacaangnctcaaaacnactaatgggnacatgagaaanntgaaaancngctacaatttcctctcctttaanacnaaannttaaantaacaanacttctactttttatataaatntttaaanttcacacatcatgacctgcatttcggaccnggtcgtntttaaanaaaaacatantacttagtgatctgcantggcatcccaacaactgaatncagggnccagcagcaggaaaanctactctnatctnaccatccgcagcaaaaaccagcnaaagagcacccaanccaggagactcanaagaagctaaaaatttatgctaaaacctaactcntaactatactgacacactaccnaaaanggcagancacatcctaaaggttcacaagtcacacacagaacaaaaatatacaaaaatcacctcacaattcccgaagctctaaattgattcattccccacacgtggtttccctaattttatactgataaatctatcaaattaaaagctttcatttccaaccacttcaataagatagacaacaccatgcttaacattttttgttctctgnctaattgcttgcttctgctaaactttgcatttccatggctaataggaaagcttgaacccatttttccaaaanttccaatcttgtgttctgatttgaaatactgagtacacacccctgatgctttctctaaagtttctttttcaagatan

SEQ ID NO: 597360 - DNA, 1030 bp, Homo sapiens
cagctgggtgacagtgagactccatctccaaaaaaaaaaaaaacaaaaaattacaaaatttactttgggcccgcacttgtaaatcccaatacttggtaggctgaggcaggaaagttcgcttgggaacccaggaaacagaggctgcaggtgagccgagactcagtgtgatttacattttcaccctggggttgacagagcaagacttcgtgctctcaaaaaaaaaaaaacaaacacggtgctgggcccactttatatggaaggctccctccggaaaattttcttccacaaaacactatggggctaaaaaaggttcccaatttccccggggggcaaattcactaatgtgctccgcaggagttctactacacaagacgatttggtctcccaatgcgggtgagaaaacgcgccctcctaaagcggtagaccacaaccgggcaaattagggcagagacgccagaatgtttgggccggggtgaaccctggtcggggaacaccaccacctcttgggtgggagacactttcggtgctactgagaacatatcaccaatggcgagcttaccctggtgatttgagacccttttcaccgggacgagagcgacatacttctcatagggaggggccatcacacatgctttttttccaactctttcaagtctacgttctattctggagaggtggcaattttctgtggtctgttgttgcccccgaggtgtttgttgcgttgtcccatggggcaaacgcctccgcgcctcctatttccttggacatttgtcgggcagacgcacatgaggcttccccccgggtgtgggcgcagaggaattgtttctggattgggccctcggtgattcccacttgtgctgagggccccccccaaggtgggggggcattaacacgcgtttgagccacctatgcttgtccacaagcgttccagtgagattttctcttcttccccagcttcaaacaccctctgtgtgggcccggggcgggtgggcccccccatatttttggggccacgcgggtgggcctccgc

SEQ ID NO: 597361 - DNA, 345 bp, Homo sapiens
  misc_feature (303)..(303): n is a, c, g, or t
gtcgaccatcacctacaattaaactactgaaatatgcagtgataattgtgccttggagaatgcatggtgtattcgttcgttttcttgctgctgataaagacatacctgaaactgggagcaaaaagaggtttaattggactttccgtacatcttctgaaatctaggtggaggtcccaaacttcaattcttgacttctgtgcacccacaggctcaacaccacatggaagcttccaaggcttggggcttccacactctgaagccacagcccaagctgtatgctggcctctttcagccatggctgtngagcagctgggacggaaggcaccaagtctccagtcgacgcgg

SEQ ID NO: 597362 - DNA, 162 bp, Homo sapiens
tagacctttggttgtccccaccttttggctatagtgaataatgtacgtatgaccgccagggcccaaaatatctgtttaaatccctgttccaattcttaggtgttatacctagtagtagatcatatggtaatcctatgtttaactttttgagaagacaccaca

SEQ ID NO: 597363 - DNA, 955 bp, Homo sapiens
ccctataccgacgtcgtcacgagtagcgatgagccctgggtctgttttataacaaaatcgtgacctaggctgcgattgctgagaaactccactggagctcacggaaactgtctggacatgatggctcgatacgtgttggccgaacttcacggctgtcccgaagaggtctcctgtgggcgagttcctcctagcgggtggcaggacctaaacctggctggttgggaacaagcttgtcagtgtgacgacaagcgtgggaaccggggtagccggtccgttgactaggcctggagtcggcgggagtctgcgatgtccggccctggacgtcgcacgtctcctagcccctggggtgtcatgtcgtaggcacagcaccatagtggaggctgcctgggctagacgcttggtagtcccgagggctggcgccagccaggttgtcccgctggtgcgcccgtgggatctgggctcgcgttccgattgtctgtgcgtgggcgcattggctgcttcgaggtttggtcggccactgagagcgctgcctgagtctcaccatgttcgctgtgagcatgctgcgctagccttctctcagggacccatctgagaccatgcgacccatgtggcggcgaaatctcctgaggaagggccctcaagcttgtggcaccctgaggttcgctgctagccagggagacaagactgaatccctcggtcgggccgtatgtagctcccatgtcgtagatcccgagggtcatgtggcggggagcatctctaggtctcctggaggcgcgcactatggggaagcgacctaggctgtggcttgattgagaccttggatgaacgctcgttcaagccccgtttgctccatcaggacattcatacaaaatgtcccccttgcatggagcttgtcataacagcccctctatgggcgagctgaagcgctttcaaagggagccacccggggacacca

SEQ ID NO: 597364 - DNA, 897 bp, Homo sapiens
  misc_feature (17)..(17): n is a, c, g, or t
ggcagtcgcgcgctcgnatccccaagatggcggccgttaaggacagttgtggcaaaggagaaatggcacaggaatgggcggcggcgtccacctggggattcctgaggccgtgttgtggaagatgtagatgccttcagtgaaacagtctgggaatgagactgcatgatacagtattagagagaacgctggaatgaacagtaccagacagtataacgtcatatggaactcaacctgtgctcatcacagaaagagaaggctaagaggtcgagattcctgaaattaaacacagacttggaaattctataaatacagtgcagaagagaacaagagtccaccaaactcaatggagaccagattcttgctgggtcagataacctgtattgcaaagcttcagtgcctcctaccgataaggtgtgtcttgtggtatgggggctaatgtaatgcttgatctatgatattgactggaatgctcaggcattgttggaggacagaatttatcgacggcacaaaagaatcttgattccctggaggaagaccttgacttgtcttcgagatcaatttactaccacagaagtcaatatggggccgggcttattaatgggatgtgacgacagaagaaacaagatgactttaccaagacagggattgtgcgggcatgtaacaatgcggttaggttccaaacatgtgttcttaataacacttttaccttagggtgactcacttgatgtttacacggagaatttgggaaaggtaggccttttttttttaacgacatttgtcacattttgggagggagggtcccctttcaacgtcgggtaactcttgcggggaaaacttgaggggaaggaatgaagcgggggaaatcaagaggtcaggagaacaagaaggtggataagg

SEQ ID NO: 597365 - DNA, 428 bp, Homo sapiens
gccataaggtgttttctgatttattatttctcatggtggccctgtgccccctctctactgatttgtttattatgtttaacttccaagccattagttcttggtccatgggaaagttgaagatgattgtgggtaggaaaggagtgaactggccgggcgcttgttgtcacgcctgtaatcctagctctttgagaggctgaagcgggcagattgcctgaggtcaggagtgtgagaccagcctgggcaacatggtaaaaccctctttactaaagtacaaaaaattagccaggtgtggtggcccactcctgcagtcctaactgcataggaggctaaggcaccagaatcttttgaacctgggaggcggaggttgcattgagccacgattgtgccatttgcattctagcctgggcaacagggcaagactctgtctc

SEQ ID NO: 597366 - DNA, 434 bp, Homo sapiens
  misc_feature (21)..(21): n is a, c, g, or t
  misc_feature (49)..(49): n is a, c, g, or t
  misc_feature (93)..(93): n is a, c, g, or t
  misc_feature (119)..(119): n is a, c, g, or t
  misc_feature (130)..(130): n is a, c, g, or t
  misc_feature (141)..(141): n is a, c, g, or t
  misc_feature (149)..(149): n is a, c, g, or t
  misc_feature (156)..(156): n is a, c, g, or t
  misc_feature (168)..(168): n is a, c, g, or t
  misc_feature (318)..(318): n is a, c, g, or t
  misc_feature (349)..(349): n is a, c, g, or t
  misc_feature (389)..(389): n is a, c, g, or t
  misc_feature (424)..(424): n is a, c, g, or t
aatattgccctcgaggccaangaaattcggccacgagggcccaaattcnttaaaaacatgcctaaaataggccaagccgcggtggttcagganctgtaaaacccaagcacatttgggangccagaggtgngccagatcacnttgaaggncaagganttcaaagaccangccatggccaaacaatggtgaaaaccattgtcatcatacataaaaaataaaaaaaattagccggctatggtggtgggcacctgtagtcccagctactcagtgaggctaaaggcaggagaatcatctgaacccagggaggcggaggttgcngtgcgttgagatcaacgccactgcactccangcctgggcaaacagagcgaaaactatgtctcaaaaaaaanaaaactgcctaaaataacctgttcacttttcttcnaggcaggccc

SEQ ID NO: 597367 - DNA, 367 bp, Homo sapiens
cagcaggtgggaccacgggtgacgacaagaaagcgcatcattgactcagcccggtcagcctaccaagaggacatgcacatcaggaaaaaggacactagccgcccaccaataccatgcgcatgctcataacacttaacttagtcttactgctcttggcaccgataatcccaagtcttcctttgcctctccatcatggacattcacattggatctcgtcgcctgctggtgtctccacttttactgtcagcccctgggattcattcactgttcctcggaagggagagtgcggcttacggccatctgcgattggctacgtgtctgtgctttccgggcgcctggatctcaaggctggcagagcgctcatcct

SEQ ID NO: 597368 - DNA, 95 bp, Homo sapiens
gccccccccccgccccctgtttgggggggggggggaagggttttttgggattaaggccggggcccccaaattaaagttggggggttgccccccca

SEQ ID NO: 597369 - DNA, 1452 bp, Homo sapiens
  misc_feature (243)..(243): n is a, c, g, or t
  misc_feature (953)..(953): n is a, c, g, or t
  misc_feature (1452)..(1452): n is a, c, g, or t
cgggttcgctgtagtaactcgatgatgaaaggcgggcgctgggtcatcattgtacctcgtagctcactaacgtcggctcgtgggtctagagacttggcaacccgaggcaatcgcgttgtgctcaggatgatctgtccgagttcatcactcctattcagaacacagcatccagctacgagataggatcggttctgtcgagcgacagtctgcatgataggcggcacatatcgagcacgagtgganccaggtagaggacgggctcagtcgtccggtcaaggctgtggtgcatgaggtgtaggagcaggggagggagagccaagtatgaatgctgtgctcgtagcatgggctccttgcaaggcgctctgtgcacttcacgtgggaagcactctaaactttcgaacctggtaggcagtgcgcgtggcacccacgttgacatgccgtagagaatagttcgtggacaaagccttctttctcgtgtaaacttcttccgggcgacaaggacttcctcggtacgcaaaaggaacatttaccacgcgtttgcaatcctgccaagttccatgagcaacgttgtatcgcggtggaactagggataaggttgttgctatggcacattggccacttccgagaggaggatgggcctttcgtttggatcgaacacccgtttgggtttcccctaggtcaaccgctttgagcttaggttggatttcattattctctttccataactcggaataacttccttggcgggggactcggggtcaagagggcggacaaaactcagcttggagaatttgggaggaaacacccttaaattttggggccattttgggaaaccaaaaaacggaaagtggatgcgccgcgtgccgttaatggccaattacatatccgtaggagcttgtgccccgggcagaagctaaccttagacaagaagtctctttgggaaacggccaagncgaaaggcgccaaaaaacacgatttagacggaggaggagacacatctcttggtgaaaagccccaaagcacccagttatatagggtttccttttccaaaatgcgcccttctaaacagccgaaattgggaacacggttcggcgggttggatactaaccaccatatcgcgctgttgggtcgtcctgtttcctcccagtgttatattttccacccgccgcttaggtgtgcagcgccaatgcgccgttttccataaacaagtttcggcgcggtctagaaacgcgccaattacccgccggggccgacgacggtgttattagcgagcgcgacatgtggtttcgcagcatacctaactattggtgggttgtctccccgccgccgtgtaatttaccacgacgcccaaacgcgggtgttgccttttcactcccgatagtttttttataccgtttttctatcactttttggccgctttggggggcgcattatgtatgggggccccctccn

SEQ ID NO: 597370 - DNA, 739 bp, Homo sapiens
gttgtgcttccagaggtgtaatgggggcccggcattccctcctcgtcccgggctggcccttgcccccaccctgcaactcctggttgagatgggctcagccatgagcgtcccagtcacaccagcgcggtctccgccgcgacaagcaaggcatctggcttcgagtggcgggacccccgttcacctaggtgctggcatcctgcgctactcccatccaggtgggagagctctccacagccaggcctaccagcagggtgagcaactggagggtcttaaaggatgcccaggactcagatccccgtctcctactcttggtattgcacggacacctatgatagaccagcagtggagatccctccaaggctcactggtgaaaacatgctgagttgaatgtattttgacaacgtgaagactgctaaatcaaaatcttcccccagagtcctgtttcttgaccccagaggccacctttatcttctgaatttggacttgcctcatgggtagcccagttaatctgttgagaggaacagatgcccggccttggaaccatgacatggagttcccctccaaaaaggtgtttgccaaggcaggaagcaagaacagccagagaaacccctgtggcagcagagctctgaccatgcctcaagggaccctggaaattcccagatcttcaggtctatgcgcatagatggaaccaaacagcggaagtactagggatccccgtttacttctgcggatgaaatcc

SEQ ID NO: 597371 - DNA, 221 bp, Homo sapiens
actgggtgctcggccacatatcgaagcattgcattgattgacttactcatttcaagtataatggtacaaaaaaactaccagctgttcaaagggacagaaatggagcttaaaactagatcgacggtacttaacctcaccatgttaagatgccatagcctggagaagctaaaaactgccaagctcacataggtataattcaattcaattatcgtacaatagga

SEQ ID NO: 597372 - DNA, 909 bp, Homo sapiens
  misc_feature (505)..(505): n is a, c, g, or t
  misc_feature (716)..(716): n is a, c, g, or t
ggcccatgggccaattgactacaccagaacaggtcagatacttgaagttaactttaacttctgctggtccacgtggcttctaaggtgataggagtcgaatggaaacgtcgaattgtgtttcctcaagagggaaaccggtagaagcgttgtcttctgaacctgtcggtgaacatttcaataggacagaaccacgcgtgcagagtgacgcagacgacatctcgtcacgtgctggtcgtatacccttggatgagtcagtgtcaccgcggatatttcagacccatgcatctagtagtcttggtggctgaatcaaccttgcattcaggtgcgctctgcgaaccattcagcgtatcttgccttcgatcataccgtctttgaaacctatcgactggccctactggtctgctcatccagtcgaccactatgtagacgcacacacgtgttttcatggttccacctatggctggtcgaatgtctacgacatttaatatccagggaggaacgttancactcggaatgactcttgggacatccgtccattgcttatgagacaacggtcttatcgtctagttcagtaccttcgttccttgactttctaccactggatctgtgcttacatagcctgggcgtttgtacgtaggttcgtgatgcttcctgcctgcggtggatagccgtgttcgctttcgtctctgtattctggacggccacccaagccacanctatctaacgagtggtacagaggtgactgggcctggtgcaacgtgttgtccccgttgtggcctggcctccgtgcagcagagtccacaagtccaccggaacattcactcccatgggcgtcggagcaaccttcaagagatctttctacctgcctttccatgtcatgagaggaagaataagacgagagtgtatgac

SEQ ID NO: 597373 - DNA, 499 bp, Homo sapiens
taacacactatcatctataccatcaatagtccccacctctcccattaacatgctatataacatctttgcacctttccttgtgccataaacaggtataaccattcaatcctcagtacgatttacaatagtgagtagtcctcatctctgatccccagttgtgcttcatatcaaaaattaatatacccttttcaatattaatccattcattttattttagttgcaatcattcagtggttgggtgtacacttggatcacttaacgccgtagagaatattagatcacaaaaaatgcagcagctgttcatgacaaactctgcatgacaattgtcggtaacgaccagaatccagatatatcatgtccaccctctgccactgtccttataggcgggagacatttgcacgctcttcacaatgaaggtttcatttaccaagaagctttaaaaaaatacctcagttccattcatactgcaaaacgttcatttaaaaccacttttagctag

SEQ ID NO: 597374 - DNA, 150 bp, Homo sapiens
caccatgtgctggcatctgggtggagcggatccactcccctcacattccacaggcccatgggactcactttggtaacagagctcctaccaacactgaccactaaaaaaaaatgtgggttttttttttttttttttttttttttttttttt

SEQ ID NO: 597375 - DNA, 315 bp, Homo sapiens
gggggcagtgcggctctgggctggccgaaggggtggcgctgcgattcccgcagggcagcgacgcgactcttggttgcggggcccggtctttccttttccccccccccgggaaaggccttggggccgggttggcccggcggggggcccggcaaatgaactgggagctgctgctgtggcttgctggtgctgtgcgcgctgctcctgctcttggtgcagctgctgcgcttctgagggctgacgggacctgacgctatatgggccgagtggcagggacgacgcccagaatggagctgatgatatggtgtgtggtgctga

SEQ ID NO: 597376 - DNA, 887 bp, Homo sapiens
ggctactcagggcacacagcctatggagcagccctgatctgcaaggagcggcatctctggcgctgctgtgcacagctgcttccatgaaagctgctgcctaacaccaccagctcacccttgaatctttgggcaaatccaagaactctcccaggctaagccccagtcttggggcttgcctgtcctgcatcatctggcaaccagcaaagggacaaggacagcggagatggtggcaacttggcagagaggcaagacagcagagacacgcagaggcagcaattggtgagagacaagagacagcagttggccacgacagcaagagacggtgaagcagtctggtgattgacggactgtaggtagactcgtgacgtgtgacaggccagaatagtgtccactagatacatgctagccatcgatgctgggacccctaactgctcatacacgagcctcgatccccagaacaccagacagcttgagcactccgcaaggacgtggtggaaacccgagatgcagacctgccaagctcggggatcccatcagtgggataagactgggcttgtgtgcccacttatgggtcatcactgtgccactggggctgaggacgtcacgcatttagggagccacatccccccaaggtagttatcaccgttaaagacatgacgcaaagttaaccaagggcccattccggggcggttagagacaggatcatggtgttcacacccagcgcggcttacacggggctggccctgcgatagcagctgcagttgccagtcaggcacacccacctttagcaaacccgggcacaccctttaccttcagtttctgaacgatccgcaattttacgataggcatcacacttttgggtaaccatccgtaagtgccttaaccct

SEQ ID NO: 597377 - DNA, 1023 bp, Homo sapiens
caaaaacttcgatgctttgaaagatgattacagtggggaccatgatcagaatgactaaaacagtgagcactagaaggagatggtgagaatgaccaataacgtggaacgagacaagaatcatagcattatgaagagcaaaggctgttgtccctgtatccgccaaaagcatcccctgcagtacaactacactttttggtcactccaggtagcaacccccggcctgtacccactagactcacagagtctataaacagaatatcaaacatgattggcacctttgcgctctgtggagcagattcgtgggagtgttttatatccacactggtacgtcctgcgtgaccttacaggccagagtgacttccatctcttcaaagaaggaattaaagccatgtgggacgatgatgcaaggttaccaatggtggcagagtggattattcggctgccgaatgggtcttgccctcccgttgctgggacgaaatctcacttttgcgccatggctgggggaccccagttcatggtcggggaggagatctgtggggctgctgtgtgtctgtccgcctttcctgaggactcttaatttccctactgggttactgactgccagtgaccaatgcaatcccccggccgatatccgggaccgcttcggcgagtgcttgatctactctcaatggcatattggcatacaaaaagtccctaccgactgcatcaatggacaattcaagctttcgaaatacaagaattaccttgtggagagttcccaagctggcaatatccttttctgtatgtgtgttgttggtcgacatggttggagcctccagccagtactcctttctcactggacggactcctgaccaagggctctttgcaatataccgagagaacgattcgttaaaaccctcagaatgtactttaagggaaaagagaagtgacttgttagacacaagtgtacaagggcacgaggggacaccctgatgaggctgacaaacacggcagtgccacagagaagcgcatcaacggaacaaa

SEQ ID NO: 597378 - DNA, 370 bp, Homo sapiens
  misc_feature (73)..(73): n is a, c, g, or t
aaaacgaccgcgggggatttcactggtaccatgacatgtatttataggatacattctcctcttctgctgccgngaggtcttagcatgagcagtttagacagtcggtctcccaccccatctactttgacccctttgaatagccatatgccatatttgctgcaccttctagcttctggacaggccttcttgttctaagaatttggcatttagtggtgtcagcagttctgagtatagagagttagaatagtcccaagccatgtcacagttttcactgtgcgacacattctccttttccaggcttttagctacaccctgttcagcttttctttacaaccctttccccttttcttccttcctgattgagagcatg

SEQ ID NO: 597379 - DNA, 124 bp, Homo sapiens
cttcggtagggcccttcagtgaagtacgattggggcgttggggagctgtgttataccctcaaacttctgtggacgtctgtcactcgttactaatatttggagcgcagctgcgggatgccgtgcc

SEQ ID NO: 597380 - DNA, 221 bp, Homo sapiens
tatgtacacgtgggtacgtacccatgcatcctcgtgcgacctgaaaacccgtggaagcggggggttatgcggccgtctgcactcattatacccggagaacagggagaggctcttctagcgtgtagtaggttgtgcagagcctacatgccatcacggagcattgagaagaggttccccttgctgccaccttgctcttgtccacgtgtgagccttgctgtaga

SEQ ID NO: 597381 - DNA, 866 bp, Homo sapiens
gcaatagcgccatgtgtgctgctcggttaggcggaaggcggcgggggggctcgagtcggtgtatgccttctcggcgcgctcgactggtcggcgtgggaagcctgtgacctgggctccctgtcggggaaaggtactacttatcgagaatgtggcgtcctctgaggcaccagcggtccggtgagcctacatccagatgtgcgcagtctgcagcggcgctctcggaccccggtggtcgcgtggctggtgctctggcgttcctccgttgcaatcccgtttgcgcgtcacggagaagtcgccaagaatggtaagtaggagttctgaagttccctcaagtacgtctcgtgtctgggtggtgggttcgtagttcccatgtttcactgcttcttcgagatcgtgcgaggtgcacggtgcgtgggcgcaaccctcgtcttctggcttcctgcgggaggcgcctgtccagttcgccagcgacgacgccaccgcgcttatgacctgatcccaagctcatcacctggtctccggtgtgtcgcaactgatgttgcctggaactttgagaagttcctggtgggccctgacggtgtgcccctacgcacggtacagccgccgcttccagaccattgacatcgagcctgacatcgaagcctgggtggctcaagggcccagctgtgcctagggcgcccctcctaccccggtgcttggcagttgcagtgctgctgtctcggggggggttcatctatgaggggtgttcctctaaactacgagggagggacacctgatcttaccagaaaataccacctcgagatgggtgctgtctgttgatcccagtctctgcaagaccagggagttccccactataaagtgcggtg

SEQ ID NO: 597382 - DNA, 377 bp, Homo sapiens
tgcaccaataaatccttaggacgatgagtggttcaggtactacattcattcctagcacattttacttctgctttaattggcctaggactccttagttaaagccaaggtttgtaggactttagggggctctgattgccctaagagtggtcctgaaacggtaagtcctttcaaagagcttactggatacttgggaagaaataaaggcaacttttcttttcaaatgagaaatgttagaaatgacatgtaggctaaatatctggtgagtatcaaaattgcaatgtaactaatagagattcagtagggaaaaatatactgtattggcaaggttaattatttgtgtgaaatattctatatatcaactgaaccaaaaaaaaaaa

SEQ ID NO: 597383 - DNA, 439 bp, Homo sapiens
actttctggccttttagttcctggtgcacagcccctaagtcaacttagcattttctggcatctccactgggcataagctaaaaccttccaggtcaagattcagctaggggccaagagatgcagtgccaggaacccttaaacagtggcacagcatctcagctcatcttcactggcacccgggattggcatacattcttcaagatcccattggaatttttaagtgactaaaccatggtgcatcctagagtgcatatattaatatttggccggttaaaaagaaagtgagcagggtaagctaagtcctctttggaggtaggtaataatgataagcttggtcacggtttcactactcagcagggaaacaagatgaattcccattggtaggtagtggagacaaaatggatgatccattaggtaaccaataaaggtgcggaaacta

SEQ ID NO: 597384 - DNA, 1110 bp, Homo sapiens
ggtctctggcttgatcggttgacttgggccttgcagtgcgatgatggaccccgacatgcgccgcagtcccgtgagccataggcccattccaggtcgttgcgaggttcagtcccgggacccagatcaagctggacaggttgcatagtccgcggtcgaccggttcttggatgtccgaaggacgtggacagagtttcgaggacgatgacgggatggtgcgcgagaaacgtcgtgtacgcctgggcgaaccgtgcacgtgtatcgtcgtagccgggtgtgcgacaggcgaacgaagagggacctggcaccacgcagggcgactgttggccaccaaaatgacctagcgtgggaatggttgagcatcgcgaccagtggtagtgaaccatgggcaacgaggcattaggtggcatcgcatcctgtaaatgcaattgtagatagtagtcagaataacaactgggtgcgttcggagatctagacgtgcgtcatgacacggagctggggctgagccataagtgaattgagcaacccagaggcaaggaacccgttatctgggagctcatcccattggcgcgcgtgaacatgtaagaggccacactaagccactgtgaggactactgtcgctggacgcatacagatgcgcctaagaattggcaagtactcctcataaccggagaagacaggggggaaacaaggcatttgctttaacccatacgggggcacagtggagtacggaaagggcagcgctttgtggccagcaagtgaacgtgaaagaagacgtgaattttgtccacggtatgagagtgccaaatatgcatgcgtttaggcaaaattggaaggggaaacgtaatcaggttggaaatggggtgcaaagtgtatgaggaataatgcaaggccaattcgaaatggcattacaatggatggttaaagattcacaagagaaggggaataggcatgacgaccacgaaggaagaaaggacagaaggataacacagtggagcatgtgtatcatggaagaaagtatgtaaaaggagtgtgtaggtgggatttgcagggatatgactgtagggaattatttggtgaaggcaaagcgtggaagcgaggcgatagaagagt

SEQ ID NO: 597385 - DNA, 213 bp, Homo sapiens
tctacaatgtgtagaattactatctgtgtaacactagactcatgaagataggagataagaaataattataattggctgagttcggtggcttacacctgtaatcccagaactttgggaggccaaggtgggaggatcacttgaggccaggagtttgaatccagcctggccaacatgaaaccctttctctactaaaaatacaaaaatctaccgggg

SEQ ID NO: 597386 - DNA, 1227 bp, Homo sapiens
ccacgcgtcgcggacgcgtgggtcgacccatgcgtccgggcggaggtgcatggtccttggtgcttgagtggtcgaggccagtctcctgggcctgcctggtcggccagtcgtggcgtaaagcaggtactgacgtggcgccggataggtggttggtcggtacgtctgtgaaggcatcaagctattttcgtggcaagtattctacatgaaacaatgttgataggtaccgtggctttctatccgaaacgcggagtgaataccaaggctcttcccgatggccccttaccgacttccgggtgccacatgactgcattcttcgtgagcgagaccagtgcagcggtatgctgacccctagaagaagtcaacgcgatgccaggccggctctggaccgtctcaagggtgtgagacgggcagtcccaagccggtcctaagtgtaggacagacaaaagccgcgatcgagtagtgtaaccctgctattgcaccgtccaagggtcggttgcagtctgcgaaggcctttaacgacatgcacaagtattggccataatcgttcggagtgcagccataggctctagagaagggttatgcgcctagggagatgttaacacaattgagcaagtagcacaagacacgaacccctagtgcacgaggatgacaaacgcaggcgacaaaggaagcaaaaatgcccttacaagaataccagactaaacgcggtggaaacgacgatgcacagagacgagagctggcgactggtaagaggacttaacatgtgcacaaactcaggagcccccagaagggaacaacgaaaaagcgagtggggcacgcaaaacggaacacacaagataggaagagaacaataacgagagaagcaatggatcgcagacaaaacgcaccgccgaaccggggaaccatcccgtaggagaacagaggaaggcgccacaacctaaaacaaaggaaaccgaggatagtaaacaatttgcccccattaaaaaggaaggagaacaacagcagaacgacagaaaggaggagggcgcggaccaacacgcgcacaccatacagagaggtaaaataccccgacagcgagaaagagggagctgccccaagacaagaacgattagacgacgcacgcactgaaacaccacaagaggagaaagagaagatagatactagacaagaacatacagagaagacccacaatataaaggtgggtaaggcatgtaacaataagagtaa

SEQ ID NO: 597387 - DNA, 377 bp, Homo sapiens
gacagactttcaaaatggaattaggcactggggagagatcagtttccccacatcagggagaagaaggtataggtggggaagggggtggccacgagcataacgaagaagactcactatggcaagggagccgctgtgcctgtggcaataccacttggacaggtcgacttcatgccttcaagccttatcccctgctctttcgattgtgtctgtgccccctttcttgtcctttgtgcaaatgcccactacgggctacctcatcctcgtgctgttcttgtgaggatctctgggcagtaaggatcttgaatctcctttctaacactgtgcccggcaaggcggatgagcattcctctgacctttgtcttgtgccaacctgtaaa

SEQ ID NO: 597388 - DNA, 1455 bp, Homo sapiens
  misc_feature (391)..(391): n is a, c, g, or t
  misc_feature (1260)..(1260): n is a, c, g, or t
tgttccgttttcttcccacagagaatttaagatggccctttgtgttgtcgcccacgaaaagagaggatggttatatagtactctctgtggagaaccttatacaagggggtgtgtaaattcttctttccttttgggtgttgttgcccctccccccccgggggaaaaggtggttgttcttcacccccccccgcaacaccacgatttttggttgtgtcccaacggcctcacaacggagggggtttttccccccacgttgttgttgttgcccccccgaacgaaatacgccgcacgttttttggaaccacagtgcccccccgtggttacaacagggtagggtaatttttccaccattgtcttttgttcgaggtcttaacacatgcaccccttcggncttctttgggtcttggagccccctctttctcccgcgggtttcccaccccaccacgaggtgtttagaaattgttgtaccccaacagcttctcccctccccccaccctcctggtagctgttctctggtgtggctcatatcttcttatggaagttttcttggcgctcagcacttatgaacttcttgggccacctgctattagtgggacgacctctgtttctcttggccccttttataccccacgcacgcttttataacgccacactcccccccacacagatgtttttcttgttctcctcacacacatttctttctgtttctccttcacagagctttatcactcttatttcgaataaacttctcacatgcgccacatctgttttctcccacaattatcacgaggtgggtgtcttttctgttctctcttctcgagagttgtgtgtgtgtctctctcttatactctcgcctctctctgagaccaccgcactagactctctgtctcgtcttctcttctctgtttctctcctcgccacagaggcgttagtgtgtctctctcacccagcggagagtgtgctcttctctgacacactctctctcttgtccacgcgtatatatcgtctgagaagtgtaaattgtgagaacaccacacccacgcgcttgtgcgtgcacacacacacactcgtgtgttgttttcccacacagaaagcgcctacacacaccttcacagagcacctctcaccccattcgccgcacacaccatattctcagattatctgagtaaacaaagactcgaatattcacctttacgaccattcacacttctatatttctttgttctccatacttcgcatacgcgtgtgcgtttacctgtntgtcacacacactttaaataaaatagaatagtgctgataactcttttataaaaagaaaacgtggagaaataccactgacacctgagaaaagatggattgctatccacgatgctcgtttagagaagcactttattcttggcacttttctttattctttctaattatctaaaattccaataaaattttattcatata

SEQ ID NO: 597389 - DNA, 289 bp, Homo sapiens
  misc_feature (104)..(104): n is a, c, g, or t
gactttcaatagaatctttaaactagaatattttcttgcatttttgaggactaaagacaattgtctactaattattctgggtggtgatacagatccactctttnctcctctttaaatagaatctcagccatgctttcagcaattagtttagcattggtctgatagttctttgatacaaggcgggggggtttcctactttggtttcaaaattctcagtttatttccagtttggttagttcagtaaacaagtcaagataccaattagacacatttatgggcagcaaaagca

SEQ ID NO: 597390 - DNA, 240 bp, Homo sapiens
tccttgtatccaagcagtcgggagactgaggcaggagaatcacttgggccaggaggcagaggttgcagtgatcactccattgcgctctagcctggtggacaagagtgaaactctgttccaaaaaaaaaaaaaattcttcccttttctggttgggattggtccctctgtgtaacccaaattagcgactggtggatccaagggacgactggctgggataacaagggaggggtacccgagctc

SEQ ID NO: 597391 - DNA, 930 bp, Homo sapiens
cgaacatagcccgtgcgcttgtggttgcctctgtgttcaggtgctgtacgtaccgggtggcgatctccgacgttggaccactgtccctaattataatgagtcttgcaagtgtgagaagtcctaaatgtgagaattatatcaagcgatcagtggttacaagtgaccgcatgcaatctatgagtaatacatccggtcgtcgtattcgatcgtgcatcaattccgtgatcactctcgaaagccaagtagcccaaagccataaaaaagggccgccgtgcgaaatagaagggagcacgaagcgaggcgattccgaggcttcctcgcaaccttacccctagtcaaggtcaaattcagcacctcggactcctgcgacctgatcaaagacgaatttcagctactgcaagctcagtaccacaggcctcaagctcgaatgtgacaatgttggccaggtgagcaatgtcagaggatgcagcgtcactatgtgatgtactacgagatgtcctactggcttgaacatcgagatgcacaaacaggctgagatcgtcgggaggctgaacgggatttgtgcccaggtccttgcctacctctcccaagagcaccagcagcaggtcttgtgatccattgaagggccaaaacaaggttcaccgttcccgaggttgaactctatcgatccgacaggcagctccaagcccaccagctgtcccagctgcaaggccctggccctgcccttgacccattaccgtggggctgaatggcgcttcgcttccggggggcagcgcaggcaccggcctgccctcatcgcttatccgggccatgggttccccaggcccaacctatcaaaggaagacaaaggaaaggtgttgcatgtttgtaacccaaccaggggcatacttgttaaaaattggaatatcacagtggcccgcacattgcaac

SEQ ID NO: 597392 - DNA, 318 bp, Homo sapiens
ttgatcggtaactggttggttggtggactgcttactgcttctgggtgctattgttgaaaaatttcagaggtacagtttcaacttcttgagttcattttcaatctctatcgacacatagatctacttcagttatgattggtattactggtagtggtgtcctatgttgctgcttgctgattgcatagttctttggccgtatgaaacatatgtagttgagttatttttcccttattgcaggaacgatatgactacaccatatggtcaaatgtcctctcaattctatggtgtactgtacatctcgtactctctctcatcctt

SEQ ID NO: 597393 - DNA, 122 bp, Homo sapiens
gcacccctccaccccatttgtgccagtatcctagaatcttgtgctctcccccagttccctttgggttccatgtttcttgttccctcccagccaagtggacgcagagttaagtttagattaca

SEQ ID NO: 597394 - DNA, 384 bp, Homo sapiens
gtcacactttttgcactgaggtacaggctcttccctccccctcctctcctcctgcccttctgccttccaccgacgtggatgaccatgtactacatgcacaatatacggcctggtgctcaggcactcactcttgcgcgcttcttagcctccagaactgttagatatcaatttctgttcattatcaggtattctgctatagccaataacaaaacatgactaagacaccatgctatcctaaatcagttgtcttcaaactaaggtacataaaaacttcctgagccacatcaaagcaagcatattttttcacatactcggcttctcccacttaacaacataaaggcccatcacccctccaatctgaatccatgctaaaagtgtgcagga

SEQ ID NO: 597395 - DNA, 455 bp, Homo sapiens
  misc_feature (24)..(24): n is a, c, g, or t
  misc_feature (84)..(84): n is a, c, g, or t
  misc_feature (90)..(90): n is a, c, g, or t
  misc_feature (93)..(93): n is a, c, g, or t
  misc_feature (97)..(97): n is a, c, g, or t
  misc_feature (107)..(107): n is a, c, g, or t
  misc_feature (113)..(113): n is a, c, g, or t
  misc_feature (115)..(115): n is a, c, g, or t
  misc_feature (147)..(147): n is a, c, g, or t
  misc_feature (175)..(175): n is a, c, g, or t
  misc_feature (177)..(177): n is a, c, g, or t
  misc_feature (193)..(193): n is a, c, g, or t
  misc_feature (196)..(196): n is a, c, g, or t
  misc_feature (201)..(201): n is a, c, g, or t
  misc_feature (221)..(221): n is a, c, g, or t
  misc_feature (226)..(226): n is a, c, g, or t
  misc_feature (230)..(230): n is a, c, g, or t
  misc_feature (237)..(237): n is a, c, g, or t
  misc_feature (241)..(242): n is a, c, g, or t
  misc_feature (247)..(247): n is a, c, g, or t
  misc_feature (249)..(249): n is a, c, g, or t
  misc_feature (277)..(277): n is a, c, g, or t
  misc_feature (292)..(292): n is a, c, g, or t
  misc_feature (315)..(315): n is a, c, g, or t
  misc_feature (320)..(320): n is a, c, g, or t
  misc_feature (322)..(322): n is a, c, g, or t
  misc_feature (329)..(329): n is a, c, g, or t
  misc_feature (334)..(334): n is a, c, g, or t
  misc_feature (346)..(346): n is a, c, g, or t
  misc_feature (352)..(352): n is a, c, g, or t
  misc_feature (360)..(360): n is a, c, g, or t
  misc_feature (374)..(374): n is a, c, g, or t
  misc_feature (382)..(382): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (412)..(412): n is a, c, g, or t
  misc_feature (431)..(431): n is a, c, g, or t
ccccttttaatgatttgtcttganggaatccttgtttagaatgtaaaaatggggaaaggggccccttaattcccttagtcctcnttttanacngaanattttattanaaacangntattcccctttttttccctttttaggcaaaantgggtttggagttttaaaaaaaggcgananatgtaaaatttaaacngcntgctntggaaacccttttttcaaangcctntggntttaaangggnnggggnanaaacccttttcagaatcccaaacggccnaaagttattgtaaanccgtttgttttcccgttttatgngggcnanaatgtcnaatgngctatgcagccngggtanccttttanataaacttgattgncttttaanataaactgntncnatgccccctgattgganataaaaacgttatatatgnccaatttaatttaagaaaaaggga

SEQ ID NO: 597396 - DNA, 406 bp, Homo sapiens
  misc_feature (115)..(115): n is a, c, g, or t
  misc_feature (191)..(191): n is a, c, g, or t
  misc_feature (212)..(212): n is a, c, g, or t
ccaagtcccttgaagctccccaagatttcctttcccaggggccaagctacttctttctttaaggggggagttcccctgggggccgaagcgcggaaattcatccgatactttacanccttcaatggggagctcgaggactatatgagtgaccggggtcagtttgtgatctcagcacaggaatgggatcccanctttgaggagaccctgatgtncaacccctccctggcattcgttcgtccccgatggatctacagtttcaatgagaagcagaagttacttcctcaccatctctatggggtggtgccgcaggcctgaagtatgtgctatacacacacacacacacacacacacacacacacacacacgatgcatttaataaagatgagttggttctccaaaaaaaaaa

SEQ ID NO: 597397 - DNA, 173 bp, Homo sapiens
atgtacaggttattggaagtcagggcacccacggtgggcacagaagctccgtcacgcttcctccatccctttccctatgtgtctcttatcctaccatcctctcattctttctcttcctaaagcacatgtttctatgagacaggggccacagccagcaactcccacttctgacg

SEQ ID NO: 597398 - DNA, 391 bp, Homo sapiens
aggcgttgtcgtgctctgttgggatgacgtgacattattgattctgagcagcatatgctgtgattggctcgcctgaaagtttgttaccctataaggaaccctcaccaactatctctgctggataagggagtaccgcatcttttgtgggagggcagagtatggacatcttacacccggtgatcaagtgtgtacataaacttgagcattcgaatgggagaaaaagcaaatcgcacaatgacatattttgagtacataaccgtatttaccacagggtgacaaatggggccaataaatctgccatctttgagctcatcttgggtggctagactgctacggcaacttctctgatgggaacagtaccttgttgggctaaaaactcaccctttcttca

SEQ ID NO: 597399 - DNA, 107 bp, Homo sapiens
caatttctggttggaatggtgacaacactgctggagccaagtgctacaatgccttggttaaagggatggaaacgtacccctaaggatggcaatcacagtcgaccacg

SEQ ID NO: 597400 - DNA, 555 bp, Homo sapiens
atttctcaccttcctcttttccacctagctgccctacagtcctcgtttcttgtgaataataggtaccatgggttcctctggtggctaacctcaatcttgtgcctctgccttggtactatgcaagcgctctggctaactgtggtagttgggttgggttgtagccctcttccatctagcccatgtgccctctcctcactaagtgtcgtgggtctaacctgcctgcccattgcctcaagtagagagggtcagggaacatggctatctgtcacttccctgtggttattcgtccgtagtaaatctagcaccttgcatgtctggtatctggctctgcgagggaggctctttttctcctggcctcacagtgcccaccaggaggatctgcgcacggtcgcacagcccaccagagcactacagccttttattgagtggtgtcaagtgcctggtctgtggtcgtgacgctgacagcatcttcccaaggcagcaggtctctgtggaggaggccatactccctagttgccactggggccaccacctgacataactcgcctattgtta

SEQ ID NO: 597401 - DNA, 253 bp, Homo sapiens
gtactttgagtctgtacatgtcgggcggagtagcgtatcgatgggcagtgaggggcgcatatgatcctaggctataatattcggagtatacgtagcggtaatgtaacaacggtacctctagaactatagctagcatgcgcaaatttaaagcgctgatatcgatcgcgcgcagatctgtcatgatgatcattgcaattggatccatatatagggccggggttataattacctcaggtcgatgtcccatggccat

SEQ ID NO: 597402 - DNA, 343 bp, Homo sapiens
aaaaaaggttttaggccaggcgccgtggctcacgcctgtaatccaacactttgagaggctgaggcgggcggatcccctgagtcaggagttcgagaccagcctggccaacatggtgaaacccccgtttttattaaaaaaacaaaaattagccgagagggggggcatgcccctgtcatcccagctactcgggagggtgaggcaggagaatcgcttgaacccgggaggcaaaggttgcagtgagccgagatcgcgcccctgcactccaacctgggggacagactctgtttccaaaacaaaacaaacaaacaaaaagattttattaaaaatattttgttaactcaga

SEQ ID NO: 597403 - DNA, 211 bp, Homo sapiens
cgtggttccttgcagaaccagcccacccaggccccccaccaccaattgccatgcacctgcatataccacccagagacctgaggaccatcacaccttgcccactaccaccgagccaagggtacacatacaccacccagagcggcagggaccagcctgcttggcttctacatcatcagaatagccttgccacaggctctgcaaggaacccgcg

SEQ ID NO: 597404 - DNA, 228 bp, Homo sapiens
  misc_feature (30)..(30): n is a, c, g, or t
  misc_feature (124)..(124): n is a, c, g, or t
  misc_feature (149)..(149): n is a, c, g, or t
  misc_feature (164)..(164): n is a, c, g, or t
caaagctgggctccccagggccggggcgcntcgcccacatcctcattccagtccccatccccaccctatccccgactctgccccaggtccaggcgggaaccacgcaccgaaacgagcgggacgnatggcattccccttgcagccggttnaaggcggggaacgtnctccaggcgaggaacccgtcgctttcgggtccgagcagggccacgagcagcacctggtgttgga

SEQ ID NO: 597405 - DNA, 181 bp, Homo sapiens
cgcaaacaggtacaccgtgtctagaacggatctaacccagggtcggccaatggccggtcgtcttcgccagcgccgctggcacatcggattgccgttggacaacagcaccggggtagctgtgttgctcgaggatcatgcgtggtgtgtgaacactactctatcatgttccgagctggccgta

SEQ ID NO: 597406 - DNA, 1005 bp, Homo sapiens
ggtaaaacccagcccactagtctaagtacccaccctgatacgtgcaatcatgtagttttggcggaaatttccccatcattctaggatgatacagaaagaaaaactgtgcctggaccctccctcttggtgggtctgtggaaacataccagcggttttattaaatgggcccctgcatcaatagccaaacatgggggtttggtaatgagaaagcaggacaggccatctgtcagtgacccagaccaggacgaacgtttacaaacacctcctggaacgaagctcccgacctgcatgtcaccttgatcggggcgctgtgagtgagggcagtgtgatacccagtgaatagacgcactctgagtataacccgtgtttggggctgaggcctgctggaccgactggctgggccaagatgggagcagaccctagggacgtatagcacctcggactgggccgtgattcggaccggactctgtgttcagctacactcagaatagcctggcgtgcattctcatgtctccgagaccggaggtaagtgggaagcaacagactgaggctggagagtaggtgctggcaaaacagtcacttcacactgagggccgagattcttacccagagtccagagaaacaaatcacgggcatgtcagacttaatcaacaaggactgacatggttgcccctgaactggctacctgagaggcgtacagacatcaagtattctcaagggaatggaagcagaagagcccagcaagaagaacgagtcaagagggaggtgctctccatatatgaagatcaacccagtggcctaccaaacacaggcattttaacccacgggaaggacagagtgacaatgcacactacaccagaataacaaccgtcataccctacaactcattttacatcatactctgaaacgttaaattcgatggaaaacatggccaaggaaccccgggactcaggtacaaacacgaaggcaaaaagaacaatacctagagaaacggtgcacagggac

SEQ ID NO: 597407 - DNA, 425 bp, Homo sapiens
cattatccaagataggagtgtggctgtgtgtgtggcatctccagccagccgcttgtcacacgtgacgccataatctcctatggacttaaacaccaacaaaagccgaaacggtggcccagaggctgctcctttgttatcccatgctttctaattcaagtcgaatgactgctatggtcacacttatttagtcacagtaaaaaatcacgggcgccctctggcatgcatgacatgcgctactccgccacgtgtaccactcccgtgtaaaaagtttctagaatatgtctgttcacggaccacaatgggcatgggtcaccactccgaagtggatgggactccaccattgcgccttagcggccctcactacaactacgaaccctttaacacgcaccagcattactatccgctttgggagctggacattaccg

SEQ ID NO: 597408 - DNA, 959 bp, Homo sapiens
  misc_feature (508)..(508): n is a, c, g, or t
cgccgagaaaaaaaaaaacaatagaagaacaaaacaggtatggccaacaggggacgggccggtgaacgcaccatggaaaatgtcgcaacgattgctgtgcgcagcatgggataattccggggcccaataccgcggggtgagaccacagcgggcccatgtctccacaggagggaactccggtggcaagaatgcttccaagtgggcacatgggaccttggaggattaagctttcgcgtacacgacccgtagggccaccccatggaaccgtggcactgtccaccgtggctgctgcggtacccgcagcgctggtagccaagtcttctggcaagacaatgctccttccggggcccaaggacgcaccccccccaagggggggacccaacgcgatagacaccccgtgacccccaatagcggggggcccacaagtcattttaggccacccggggtaggcacccacgctgttggccaccgcgcgaggaataacaggtttcacgccccccccaccgcnggggcaagaatgggtgcacgacaaccagaacaagcctgtttggcttcggcaatattagaggaactcccctgcacccagtggagagcgtttccacggcgcaccctgtcccagcccagttgatgtcgcctgttccatgaatgtatacgcggacaacgttagatttttgtgggaattctcaaagtggcatataagtactattatggaagaaaaccaaggtggtaacaaccccacctgtacactcagacgccgagaagcactccacaaaatctttactggggagctcacaatatttcgtgaacgacgtctctcaactgttgtctgtccgcgtacacctcgtacggcggaggagaagttttcgctccatcctgccgccccgcgtgcaggaggaaaagacgttcaaagggccccgagtggctttaatacaaattacagggggaacccccacaaaaca

SEQ ID NO: 597409 - DNA, 196 bp, Homo sapiens
tacggcagtatgtgatctgcccagcattcatcgctcaataagtgacgtagggaagacctgtgcatgtgagtcgatttcataaactggaatgtgagccatgtgtacatactttggtttcaactttactggtcacaaaaaaaaacacacaaaaaaaacaaaaacttccaccctggttttaaattgggtgggttgtggc

SEQ ID NO: 597410 - DNA, 104 bp, Homo sapiens
gcctgctgagggggctggacttgcggccggccactgctgttgagctgttatgccggtaccctttcttggcgagaaaggccatgcgcctggcttctgccttctct

SEQ ID NO: 597411 - DNA, 169 bp, Homo sapiens
cgatacacctgatattaatttttaagctgcatacatctagcgcttactttcattatatgcttcagtactctaaccaaagaataatatgcacgattatggaactcactgaagaataacacgagcatattacaaattcatatggaaattataagatgactccagaggtacc

SEQ ID NO: 597412 - DNA, 638 bp, Homo sapiens
gcctgcggtgacacctgctcccctctgagagcttcaggttctccggcctgccttcactggtttgtgtccagtagccggactgattctctcaagtttgcgtagtcggttcagtcctgttagaacaagaagacgaaaaacacctgtccagaaaacatggatgcatttgagaaagtgagaacagaattagaaacgacagccacaagaagaatatgaaatcatcaatgtggaggttaatccatggtggtgtggtgattacccaagagaggtggttgcgttgggtcgttccaaggatgaaggaagcagacaatgataattatgaagttttattcaatttggaggaacttaagttagaccagcccttcattgatgtatcagagttgctccagagtgaaaagatatgtggctgcaagataagaactgaagattctgaagcatctactgtgtaattataaagctcagcgatcagcccgtaatggaagcttctttcccgaatgtgtccagtttgaatgggtacacaggaccgaggaagatgaagatgtgtgtattctaccaccttccagaggaaccttcgctgtcatgacgtatatccgagcactttgggtgatacaaagtaatgaacgcttttatcagaaaaagac

SEQ ID NO: 597413 - DNA, 613 bp, Homo sapiens
  misc_feature (27)..(27): n is a, c, g, or t
gagggtggaaatcgcttgagccccggngaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaagcacttgaactatggctagttcaagcacttgaactatggctagttcactgaggaagtgaattttaatttcatttcattgtaattagtttaaattcaaatagccaatgtgctggtggtacatat

SEQ ID NO: 597414 - DNA, 415 bp, Homo sapiens
ggggagagtgggtccgtgcccacccgaatggatatgtgggcctaatgacgcttaaagtaagcttatatgacactggtatagagaggtataccaaaaggccaaagcacgtgtctatcagtctcccggtttcttctgtctgtcttcaactttcttctcctcagcctaagcaacgagcagtaagagggcaggacctactgctggtacagcaccacctgcgagagcagtcactgcggcccctacatctcagatgaggctccatatgatgacgttggccagggcctatgcaccctagccaggacataaaggctcaacatgtacagcggctgctataatgagcgcattggtcttatcctccgtgcgtgtcacctcatcgtcgtgcagtgtgaggtccgagtagacgcaggcgagctcgtcg

SEQ ID NO: 597415 - DNA, 267 bp, Homo sapiens
ccctttttttgggggggggggccccccctggggggttcggggcccccccttcccttcccccccttttgggtttggggcgggggggggcccccatttgccccccgtttggggttttttttggcccccccggccctccgggcccctttcccccccccctccccccccttttcccccgggtttttttgttgggggcccccggccctgtccctcccccgcccgggggggggtccccccttttgaaaataaatttttttggggtttttttca

SEQ ID NO: 597416 - DNA, 336 bp, Homo sapiens
ctgtcattccagcatatgaaactatcgatgccatattaataacttatgaaattataaaagagtaggctgaggacggtgtctcacgcctgtaatcccagcactttgggaggccgaggagggtggatcacctgaggtcaggattccagaccagcctgaccaacatggagaaaccccatctctactagaaatacaaaattagccaggcatggtggtgcctacctgttaatcccagctacctgggaggctgagggacggagaatcgcttgaacctgggaggcagaggttgtgatgagccgagatcacaccattgcactccagactgggcaccacgagcaa

SEQ ID NO: 597417 - DNA, 542 bp, Homo sapiens
  misc_feature (14)..(14): n is a, c, g, or t
  misc_feature (75)..(75): n is a, c, g, or t
  misc_feature (94)..(94): n is a, c, g, or t
  misc_feature (112)..(112): n is a, c, g, or t
  misc_feature (116)..(116): n is a, c, g, or t
  misc_feature (119)..(119): n is a, c, g, or t
  misc_feature (121)..(122): n is a, c, g, or t
  misc_feature (129)..(129): n is a, c, g, or t
  misc_feature (137)..(137): n is a, c, g, or t
  misc_feature (166)..(167): n is a, c, g, or t
  misc_feature (169)..(169): n is a, c, g, or t
  misc_feature (186)..(186): n is a, c, g, or t
  misc_feature (216)..(216): n is a, c, g, or t
  misc_feature (220)..(220): n is a, c, g, or t
  misc_feature (233)..(233): n is a, c, g, or t
  misc_feature (241)..(241): n is a, c, g, or t
  misc_feature (262)..(265): n is a, c, g, or t
  misc_feature (267)..(267): n is a, c, g, or t
  misc_feature (288)..(290): n is a, c, g, or t
  misc_feature (341)..(341): n is a, c, g, or t
  misc_feature (372)..(372): n is a, c, g, or t
  misc_feature (383)..(385): n is a, c, g, or t
  misc_feature (397)..(397): n is a, c, g, or t
  misc_feature (399)..(399): n is a, c, g, or t
  misc_feature (404)..(404): n is a, c, g, or t
  misc_feature (415)..(415): n is a, c, g, or t
  misc_feature (433)..(433): n is a, c, g, or t
  misc_feature (443)..(444): n is a, c, g, or t
  misc_feature (450)..(450): n is a, c, g, or t
  misc_feature (461)..(461): n is a, c, g, or t
  misc_feature (475)..(475): n is a, c, g, or t
  misc_feature (493)..(493): n is a, c, g, or t
  misc_feature (497)..(497): n is a, c, g, or t
  misc_feature (518)..(518): n is a, c, g, or t
gggggggagacaangcgcattgccactcctgccaagagctcatgcctaaatattattatttcaatgaaaaatganaaatattcacaagccctgnttagcgagtaaagcagtnacanccncnnccaaagncgcaagcngaggagattcgagcaggttgatgcttccnnangaggagacattgctgantcgtcggggtgatgccacgctggatctgcntggngactgtgtaatgntctcagcnccatggtccacacgggttttnnnntnttttctgaagttcaacttttnnntgttttttttgttttttccacctccaggttcatgttgggcttttttttgtntttcaatttttgtttgggctttttttttgtnattttgttttnnntttttatttttntnttgtntgttttttggnctgtggcggttgttcttnagagggccanntttggntgttacatggnttaggtctattttnttggttacattttgttcntgcncccctttaggctggtatttgntgtgtgtctgttgatccgattttg

SEQ ID NO: 597418 - DNA, 453 bp, Homo sapiens
cccaaacccgccagcagtgtccatcattgagtggacatgaacgtggcttttattgctcccctggggtccaaagaaccccataagacaagtccggcatgaggagtggccagaaggtgaacccgcccccagtggctatgttggagagctgggcttccgcgctttttttggatttggcaatagattggatggaaaaaagaaaggggtagagcccagcccctccccaatcaagcctggagatattaaaaggggaattccccattatgaatttaaacttgggaagataactttcatcagaaattcacgtccccttgtcaaaaaggttgaaaaggatgaagctggaggcaaatttgtcgctttttttggaaaaggccagtcattgggtaaaaagggaaaaaacccctaagtgaggactgttgggtgattggaaaataataaaagaatcttttgccccca

SEQ ID NO: 597419 - DNA, 458 bp, Homo sapiens
cacgaggcacaacctaaaatttctccctcacttccaggagttattctgcccaggttctggaatctggccagatgtgatgcagaatcccctccccactactcacctgctctgtgaccttgagcagtgatttagcattttcttcatctcattttcctcttcagcaaaatggagaccataatgcctacttcacagggtttgtgaagaattaaatgatctactttatggaaatgactaacggttccagatacataatgagtatttgataaatgctagctatcattggattcattttgttctcataagatattaatcatttggacacattgacaagcaggagaggaaaatcatgttcatttacccaccactctgatagtgcaaaatcaaataacactgatcctgttcactggagatgagtcatatagccagaatctgttagcaagtggtaatgccttctctgg

SEQ ID NO: 597420 - DNA, 111 bp, Homo sapiens
cgtttcaggtcaaatatggcgagcgtgttcggctgaaatttatcaatgagagcatgatggcgcatcccatgcacctacatggcatgtttgtacaacttgaaaatggtcaag

SEQ ID NO: 597421 - DNA, 384 bp, Homo sapiens
  misc_feature (347)..(347): n is a, c, g, or t
cctagaccttccctctgacagagcctacccaaatgagaaggaaacagaaaaccaaccctggtaatatgacaaaacaaggctcttcaacaccccccaaaaatcacactagctcaccagcaatggatccaaatccagaagaaatccctgattgacctgaaaaagaattcaggtgtttagttactaagctaattagggagggaccagagaaaggcaaagtccaatgcaaggaaatccaaaaaaaaatgatacaagaagtgaagggagaaatattcaaggaaatagatagcaaaaagaacaatcctcagcagtagaattgagcaaatagaagaaagaaattcagagctcanagacaaggtctttgaattaacccaatccaacaaagtg

SEQ ID NO: 597422 - DNA, 265 bp, Homo sapiens
  misc_feature (137)..(137): n is a, c, g, or t
  misc_feature (151)..(151): n is a, c, g, or t
  misc_feature (153)..(153): n is a, c, g, or t
  misc_feature (159)..(159): n is a, c, g, or t
  misc_feature (224)..(224): n is a, c, g, or t
  misc_feature (233)..(233): n is a, c, g, or t
ggaataactaatctgtggtggtaagaatcaaaatagtgattaccttggggagaagagaggattggctggcaaggggcatgagggaatttcctagagtgatggaaatgtttatagaaccgtgggctacctggcatctnttaaaactcacctntncatttnactttatataaattgtacttccattaaaaataaaaacaaagaggagaataaagaaaacataaatncggcatttngtgaatgaaaatactgtagccaaatatttgag

SEQ ID NO: 597423 - DNA, 124 bp, Homo sapiens
ctttggggaaaaaaaattttccccctgtccccctgggtctttggaaataaaccccccccccccccaattttttttcccttttggggcaaccctaagtgtttttttttggtggccccctgcccca

SEQ ID NO: 597424 - DNA, 160 bp, Homo sapiens
ataaccgccaaataccgcacggacagtttggcaataaggctgacgtatacacatcaatgcgactgttcctgagacgaaaccactcattttaacgtactgtgacacggccaagaagaagaagaccgtaatcaccaaaagtggaatatttcggaaaacttgg

SEQ ID NO: 597425 - DNA, 432 bp, Homo sapiens
  misc_feature (271)..(271): n is a, c, g, or t
aaaactcccacttgaatgtcttcggacccctcctcaggcgaggtcatgggattgtccttgccagagtgaacaaagggcgattcctgctaacactagcaaagaagaatctttcatttcatcagaggggcatcacatatgatgttcaagacagtagggcatagctagctgaagaggaacatcttgagccagagaggaaaagtctataggcagcgccaggacaaggaaattcccacactgtcatttgtcacgcgacccctaagcaacccagccnctcctggatgggccgagggccttgcctcccgcatcatccatgggagtcagggccttgtcctctcgccttccacccccatccttgtccttttgcccagcatcctcaggacgctttgttcccagagcagacatcccctggaccccattcaaaccctgcctccg

SEQ ID NO: 597426 - DNA, 141 bp, Homo sapiens
ggataaattgtaaaaaagctaaaattaagatagatagctaaaagatggaacaagaagaggagaggagagggagtctagtctaacaaacaccattggtcttcttcttgtccatcacaaacttcctccaaattgtggtgatct

SEQ ID NO: 597427 - DNA, 167 bp, Homo sapiens
atccccgctttcgccatggtttcccttaggagaaggattttatatctcttgttcactgtattgcaaaggtttccagtacttaacttctaatggggtggctttagcattatgtttagctagtccgatttaacagacagggaacacatagggcgaaacctgggctaccg

SEQ ID NO: 597428 - DNA, 306 bp, Homo sapiens
  misc_feature (170)..(170): n is a, c, g, or t
  misc_feature (211)..(211): n is a, c, g, or t
  misc_feature (248)..(248): n is a, c, g, or t
ggatctagaggatcccgtcatttctacacacacaggtcattcccaccagaaagccaaacatctagtctctgaagaacagttaaacactttacagtagactggaagcatgatattctcgtgaacttgtcgtggtagtatcacacatcccacacagataactgttctatcangcagaggctgtcaaggactgagttgatttttctcgttcacnaagattccaaggcaaggaacatgtaatacatagctgnttatctatttggagtgtgtccacttacagttctaacaagtttttccccgtgtcctggg

SEQ ID NO: 597429 - DNA, 305 bp, Homo sapiens
tcagtgatagaagttgttacttggaaaacccttggggacgtaatgtagtgatcgcttgctgatccggatgagcggagtgcactgcggatgaccacctcgctcttcagagactcgcccgccggtgaccacgactactctctgccgatgggaaagcagaagcaagacctgctggaagaggacgactcggctggaggagtctgtctccatgtgaacaaggatcaggtgtcggtggagttctgctcggcgtgcgcccggaaagcgtcgtcgactctaaaaatgtagcgtcaagtaatctgctctttatc

SEQ ID NO: 597430 - DNA, 585 bp, Homo sapiens
  misc_feature (464)..(464): n is a, c, g, or t
agcagctagacttattcttttattcttaatatcagggtctttggacagcattctttctacatgatccttttttgtacatttaagaatattttgattatattaaacaagactgctgattttggtactttttttaaggggtcttcaagtaagtaaaacatacatcgtagctagaagaaaaatgtaccttaaattcgcatcttccctctcatacccaagctgtgaacaattgaaatattttgtcttaaatcacttggttcaatacatgcttatttgttttaaaacctgtatcatcaaactctctctctaaatttaaaatgctggtgaatatgagacttttgaggagagagtgtgctcagaacttacacggcatttggtaggccaagtatgctaagtgtacaatatattttataaattatacacctgaaacaaagaaatgggggcacttaaaataaaagtttatatgntggagataatggactctttgttttgcaaagctgtttgctatagcttacaccgcattagggctactctacctctgaagagtgtgtaatttggtgcgattgaggagttctacggctgttcctt

SEQ ID NO: 597431 - DNA, 313 bp, Homo sapiens
  misc_feature (253)..(253): n is a, c, g, or t
  misc_feature (278)..(278): n is a, c, g, or t
  misc_feature (296)..(296): n is a, c, g, or t
tcgtgtctagaggatcccgttcaattttattctgtttaccaaaaagttaaaagtactgttggaggcaggcaaacagagagaagttttaagagtgactgtggagttggactggacaacaggggaaggaagtaaaagtgtggttagagagtgtatccatttctgtctagtttgcaaaatgtaacgtgtagtaagagtgaacggatatctcgcccaagaagagaaggagagcactattttctttcgccttttccangaaagagtcaaataaagtttgtcanactttgaagagcttatcngtgtgtagaaattgaag

SEQ ID NO: 597432 - DNA, 159 bp, Homo sapiens
gcagaggctggagaggggtaataaaaatctcctagtggaaaccacctcccgcactgccccccagctgggctctggtctcttccagtcacttcagagcatagtcctaaatctagaaatcctgtgtgtatcataggcctgaagagggcggcagccgggcgt

SEQ ID NO: 597433 - DNA, 365 bp, Homo sapiens
caggtaacagtagagaaatttaaagcccgttgttccctaagagtaactgcagcaacaaaaaatctgaaacctagatcaggtttccttgaataaacatcccacactagaaaaaaaaaatgaatgtctattttcaggaataaaaaatatatactataatttctactgtcaaacaaaagaaatctgacagtcagccaataataattaaactgtggaggatcaagcattaaaacacactctgtcaagaaatagagcaatcaaaagaatcagattcagaaatgatccaggtgttggaattattaaaccggggattcaatatagatataatttttgtgttaaatgttacagtgaagatgaacaacatgcat

SEQ ID NO: 597434 - DNA, 366 bp, Homo sapiens
cgacccttaataatgagtgcccagcctaatttatgaatttttagctgagatggggttcaccatgttggctaggctggactcgaactcctgaccggggtgatccacctgcctcgggctcccaaagtgctgggattacaggcgtgagccactgcgcccggcaaaaaaaaatcttttttaattagccatggtggtgtgcacttgtagttccagctacttgggagatagggagaaggactacttaagccccaggagtttggggctgcagtgagctatgattataccactatactccagccaagactctgtctccaaaaaataaacaaacaaataagatgggcgggaggtaatcatcttttagccatgctc

SEQ ID NO: 597435 - DNA, 169 bp, Homo sapiens
ccccacttggcgaggcagtctcgaggacaagagatagagaccatccttctcaacatggtgaaactctgtctctactaaggaaaatataattagctgggcatggcgccctgtgcctgtagtccccgctacttgggaagcagaggcaggagaatcgcttgaacccaggagg

SEQ ID NO: 597436 - DNA, 208 bp, Homo sapiens
agtcgcgtgtagtctgtcgcgtgtcgcaccaccattggttttatttgcctttaccaccaagtcccaggcctggctaataatgaatcaataacctttctatgtctctagcctcctgtatgccactagtagaagtattacgaaaagccttataaaccgaacttagacttagttcctcacatccctcttcagagttaatagtgttggtgac

SEQ ID NO: 597437 - DNA, 250 bp, Homo sapiens
ctcgtgagcacactgatgatcattcccacgtatttgtagccactgtaggccagtaggtgaaaggtgctactagagtcgaccccacgcgaagtcacgggaccttcattcagtttacatgtcatgtgccgttttctcagctgaaaccagtttacccatgcgttatgtgccacactgtgattggcacaatgcgattttgccaggggattgcgcgttcagaagctcaaggcctaacagatcctactagtagtcg

SEQ ID NO: 597438 - DNA, 247 bp, Homo sapiens
ctacaggacatggaagaccccataatagccgccagctcgatgaccatcgacaagctgcttttgtaggaagaggatagcgactcctatgcgcttaaccacactctctctgtggaaggctacttatgcgtagctcccacctgagtcctgttccctgaaactgggattataaaatgaccctggaattgagaccccaggttcatgcttgtttggagtagtcattttatgactacactttctacgcacagct

SEQ ID NO: 597439 - DNA, 395 bp, Homo sapiens
attcgcggccgcgtcgacctctaaatgtacagtctttcacggatgtagggagtaggttgagcacttgagcgtgagcatgtgtgttgcgtcgtgtgctgtgtgccgcatgggtgcgtgagtgttgcgtgcgtccatgtgtacgtgtgagtgttgcatgttgcatgcatgcatgcatgcatggggcttactccctcccattgacatgttcatatttcaagcttcctctgttccctccatatggtgatactccctctgttcccaaatatagtacaaagttgagtcatctattttggaacagagggagtagtacggagtaaaagcctccctctgttctcaaatacggagtatttgtctttctatagatttcaacaagtgactgtcgacgcggccgcgaa

SEQ ID NO: 597440 - DNA, 332 bp, Homo sapiens
gctcgacgttctgtttctttttaaagcctggttaatggccgggcgctgtggctcacgcctataatcccagcactttgggaggccaaggcaggcggatccctgagttcgggagttcaagaccagcctgaccaacacggagaaaccccgtctctactaaaaatacagaattagtcaggcgtggtggtgggcgcctgtaatcccagctactcaggaggctgaggcaggagaatcgcttgaacccgggaggcggaggttgcggtgagctgagatcacgccattgcactacagcctgggcaataagagtgaaactctgtcaaaaaaaaaagtcgacg

SEQ ID NO: 597441 - DNA, 466 bp, Homo sapiens
ggcgagctgggcccgtgtttcggccgccgccatggccgcggtggacctggagaagctgcgggcgtcggtgcgcgggcaaggccatcggacgtcctgaccaggcggcggcgacgcgcaatggcatgaacgctgctgtccgggctgtgacgcgcatgggcatttatgtgggtgccaaagtcttcctcatctacgagggctatgagggcctcgtggagggaggtgagacacatcaagcatgccaactgggtgagcgtctccaacatcatccagctgggcggtagcttatcattggcagcgctcgcgtgcataggccttttaccaccagtggaggggcgccgggcatgcggtctacaagctggtccacgcgacggcatcatccaatgctgtgacgtcatcgtgcggggatgcgcagtccttagcaggtagccaatcatcttgccggcaggcgagtggggcagcctgctgg

SEQ ID NO: 597442 - DNA, 1650 bp, Homo sapiens
  misc_feature (126)..(126): n is a, c, g, or t
  misc_feature (581)..(581): n is a, c, g, or t
  misc_feature (728)..(728): n is a, c, g, or t
  misc_feature (772)..(772): n is a, c, g, or t
  misc_feature (1095)..(1095): n is a, c, g, or t
  misc_feature (1543)..(1543): n is a, c, g, or t
gatagtactcgagtgtctcagagcacagttgtcctactccctgacactagcctgcctcgtattgctgaccacgtgactacgctccccacgcgccgatcggatgagctggattgagaaccttgcctntaaagcacatgagccgcacttcgcataggaccagcatcacactcttaccacatgtcacatgtggcacctgcgtaacctatcaacagggcatgtgtattgaatgtcagcatggtgcacgcgaaatgcctgcaaacggggaaccgagagatgtccatccgtgtggactatagaaggacggttggcaatggacagtcagttgtatcctgtcggtaagactatcagcgccctaattgatcgttgtgtgcgtgaccacttgatggagcgtagcgatgagtgaacccgctactgacagtcatcacgcatgcatatccataatcctgattatgtcagtcttgagacaacaatcaaggttgagttaccatgacgaacgacgggtcgctatcattactctcgatactctgcgaaactaaagtatacgtgaaaccataggtaaatggacgccgtatgcaaacaanttcgataacgtagccaagatgcacccctttggaccacgagtactttgacgttacctcgcgtgaaaggaaacgaccaagggtggggcaccaaaacgagaaacttattgattggaaggcgctgggacccgaagacgttaacattgccangaagtttaaatcctgttttggatgcgaatctgttcgcaatttanaaccgcaggcaattaaggaccacctcgacattgtgcccgtacttcttagccaccagccaaacgtaaacgaagcgcttagaccgcttgcgaactcgggaaacgaaactccacaaaggagttcgattagcaagatgtgccgatgtttgtttgggacccggcaccgaatacgacctcgggatttgtttggcggtccccactctcggaaggaaagcgacactctccggtaggaccaaggcaaccttgtcaagcgcttcgttcttatacttgcaagggtggggtccaggcggggccgaggcccattggcactgagttggcatttgcgngaacacgatccccgtcccggaacgttttgaggtcaacaccgcggcgccaaaaaagcgcgcctttagcaaggcaagagggactttgcgagcgcagatacgggattaggagtccaaccagcctaccaccaaaaggctttggtacccccgccacagagaaacggcccatattcagtataggctctctttgtggccctaacttgcttgttgcttgactataaagggttcccccatgtggtgtattcccccctttccaaatcggtagctaagaacccgtttcacgtgcgtgatgggggcaattgtgcgcccatgaggtggcacgacaccacggggtttatcgaaaatagcacccctggtgcccctttggtgttactatcaaaccagtagcagaggaaatattgagttcaccaaaagttgtggcccccacgggtttaagcggtgacatcacagngacaccgggcatagttgaaaccctcatagaaacactatgtgtcccttctcaaatgaacgtgtagttaaccggtaattcagtaacagtacagagagaaattacacccg

SEQ ID NO: 597443 - DNA, 207 bp, Homo sapiens
aaaaaacgggggggtttggaaaaaatttcccttaaggtttttggcccccccccccaaggttgggcaagggcggttcccgaccatgggggggaaaaaagcctttttggggccccttaaaaaagacccaattgccaagggaaaagggggttaaagcccgggacaaattttgcggggggggggggttccaaaaaaggttttttcccctga

SEQ ID NO: 597444 - DNA, 1176 bp, Homo sapiens
ccacgcgtcggccacgcgtcgggggcagcagcagctgaggcagcgagctgaggcagccgcgacggccggcgctcacaagggatgacctggagtaggccacaaaagagccgagggccgaggagcgcaccacgccgtaggacgagcagagcactgaggacagcgacctcggaaatacctcaccgtagcatacaagcgcaggggaaacgctagcaagctgtgagcccactcacacgccatacccgaacaacaacgcacagagacaaaaacacaaaaaaccaaacaaagacacaccaaaaaaacacaagagcgcccagaagagccagaacaaatggacagacggacaccccaacagaacagcaataccacacagcgacacgcgagataaacaacccacaacagcacacgagatagagacacccaatgataaccaagacgaccgcgcagacgccgacaggcaccacacaaccacataacacaaacaaaacgaaaaatagaacgagtcacaggcaaatgaaaaacacagaaagatgcacgcaagaagcagcggggccgcaatccaaagcaagagacagatcagaaatgacacgaaagtagcgtgaatgagcacacagcacacgcacgagagagaacagtgagaaacaccaacatacagagagagaacagacacagaaacagaaaagcaagcaagacagaaacaaaagagacaacgaagaaggaacaacacagaggcgaagagagaagcagcagaagcacacgacagaagaaaacaaagaacaaaaaagagaagaaaaaagaaaacacaagagcaaacaaacaaaacaggacagaagcagatgagagagccacagcaacacaagcacgaagacaaggaaaacaaacgccgagacgaggcagacgagcgcgaacgagagcccagacatcaagagacacaggtataagacagccagggccagcgccagaccactgacgacgacgcgtcagtgggacgaggcaaagcggtgtaagggagagagttagagacagcaggacggcacagagagacgaagcagagcagacaagcggggggaggacgacagacgtaaaacagagagccagagagaagggagaccacatggcggagaggagggagacgctcaacgaaaacgagaaaacgaacgaaagcgacagaccgagcgg

SEQ ID NO: 597445 - DNA, 615 bp, Homo sapiens
atggtaacaacactactacagatgctccttgacttacgatggggttatgtcctgataaacccatcgtcaggttgaaaatatcgtgaagtcaaaaacccatcaactacagctaaggcaccgaacatgggagcttaccctattctgccggagggggtactacattagcctatagttgggcaaaatcatctaatgcaaagcctattttatttaatttttttttaagagacagggtctcattctgtcaccgaggttggagtgtagtggtgtcatagctcactgcagcctctccttttgggctcaagcgaccgtcccttcttagccaaccgagtagctaggactacaggcacatgtcaccacacctgtctaatttttaaatttttggagagatggggtccctattttgttccccaggctggtttcaaactcccagcctcaaacaatcctcccgccttggcctccagaagtgctgggatcaaaggatcaaagcctgttttgtaataaatggtgactctctcatgaatttgctgaatgctgtactgaaagtgaaaaacacaatggttgtttgggtattcaaagtgtgatttctccctgaattgccattcttttagcatcatg

SEQ ID NO: 597446 - DNA, 331 bp, Homo sapiens
  misc_feature (331)..(331): n is a, c, g, or t
agagcatgtgtaattagtgaatgaagtgactgagtttgcgcaaacacgtgttgctgttgagtcagatgaaaatagtgacaaatcacattataccctttttggagacaaattatgcacagtgtggaactcttcgtgaaacctatggtgaaaagggtgactggtgtgcaaaacaagaacctgtgagaaatgagatgcgttttgcgacacaaagatgacaacccaaaccttccccgattggtgagaccggtgatgtgatgtgcactggttttcatgacacatgaagagacatttttgaaccctttctttggttaaagggatgatggttttacgn

SEQ ID NO: 597447 - DNA, 431 bp, Homo sapiens
actctagcaggatctcaccgtaatatgtaccaatgaaaagaaaagaaaaacattgtgctggctccaaaaaactgactttgagctacatatgacctatgggctgtatactgttggatctttaatagcttctagagaagaagttcaagatctaagtaggtgcttggctaaattttaatttcttccttagatatactatagacagcacttttcattattaatttctgtgttatgtttcagggggcagaaataaggacatttctcgtgaactactgtttacactgtcttttggtgaaggaagattagtatgatgaacctagacggaaacacactgtttacacctagaggagaaaataaaagagggtcatgtgaaagaggaagatggaataaaaattcaatattaaagactaaagtgaatatcatatagtaagtat

SEQ ID NO: 597448 - DNA, 231 bp, Homo sapiens
tatctgagccttggcggcacctcttcaattttaagagaatcaggccgggcgcggtggctcacgcctgtaatcccagcactttgggaggccgaggtgggaggatcacgaggtcaggagatcgagaccatcctggctaatacggtgaaaccccatctctactaaaaatacaactaaattagccgggcatggtggtgggcgcctgtagtcccggtacatgccccggtacatgca

SEQ ID NO: 597449 - DNA, 264 bp, Homo sapiens
gaaccaccacggctggctaattttttgtatttttagtagagacgaggtttccctgtgttggccaggatggtctcgatctcctgacctcgtgatccgcccgtcttggcctcccaaagtgctgggattataggcgtgaaacccgtgcccgccgtcttatccttagaaagcagttagaaagacacctgagaaccaatccaaactgcagccttcacagaaccttctggaccttctggatgcaactcattactgccagaggtctttgat

SEQ ID NO: 597450 - DNA, 113 bp, Homo sapiens
  misc_feature (104)..(104): n is a, c, g, or t
gtgcccaaagacactttgaaggtgaaaatccaccgtcgtgattttaggcaatattgccagatgacaaggggttgggtcattcgatggcaccctgcctgctctanatgtatccc

SEQ ID NO: 597451 - DNA, 297 bp, Homo sapiens
  misc_feature (201)..(201): n is a, c, g, or t
  misc_feature (244)..(244): n is a, c, g, or t
tctgggactctatcaggggggctctggcttcagtgcaagcagtggccgagggcggggggtgggcttgggcaggggcggaggtagcagctccagcgtcaaattggtctccaccacctcctcctcccggaagagcttcaagagctaagaacctgctgcaagtcacggccttccaagggcagcaacccagcccaggtagatggnctcttctaggcagtggctcaagccaggtattatccttggcggnagagtagtctagaccaagccaattggagaaccacattcttgggttccctgaat

SEQ ID NO: 597452 - DNA, 148 bp, Homo sapiens
gagctcgctaccatataggttggacgaccgagcacgtattcatgcgaaacttgcccttgcagcccaaatgcaggagcaaatgttggctccccagtaagcccacaaggtagactgaagccattatctagttgactaatcggcgagtctc

SEQ ID NO: 597453 - DNA, 271 bp, Homo sapiens
actatcaatgacattacatgagctcccaatattcgtattaaatggtagtcaagagactatcaagcaggaagcctgatctcgacatgtttcctcggaggctctgaacctgccctatcttgcccacccagaattcttttaagttctgttttgttttaacagggtatcactctgtagcccaggctagagtgcagtggtgtaatcatagctcactgcaacctccaactcctgggctcaagtgatcctcctgcctcatcctcccaaatagctgaga

SEQ ID NO: 597454 - DNA, 210 bp, Homo sapiens
acatctcaatccaattctttggcgctcttgcttgtctaacttgctcggacaaatctgacaactgtgaacaactggccttcttatcctagagatctacatgttatataatacatgtgttcatacatagccttgtctatgcccacatacttcaggagaccagctattatctataaatctagatgcgtgccattcattaataacaaaattaca

SEQ ID NO: 597455 - DNA, 129 bp, Homo sapiens
cgttggcagcccaggccagggtggccagcaccagcgtgcgctgcaggctgggttccactgcacctgcgccgcgcagctgctgcagcatcagggtggagaccgccgccggcagcttgctccagcgcgatg

SEQ ID NO: 597456 - DNA, 1430 bp, Homo sapiens
  misc_feature (899)..(899): n is a, c, g, or t
ggggccgacccatacgacggcggcggtgtgactccatgcgccgccaccacacataaagggggcgtggcacccacacggcgcgatgctagggggggcaccatacaattactgtccgccggggggccaacaacaaacagtctgccgcctgcttcgttatattagggggaggcccacccacaaaaatgtggtgcatctccataaggggggccgcaccaactaaaagaaggggggtggggctgcccacaccagacgaagccccgtgtattaatactggccaaacagggtatgacctctccctctcctcacggggaggatcggttttctcgtagcagtcccgcctactcccaaacggagaattggttgtgtctcgccacgaacatgaagtttggtgccctcttctcgggtttctctcctaatttgatgaagtccttctgctttcttcaaccagaagggggggagtattgtccccaccgggagaatttcttatatcatcaggccccggcggtgtttcctcttatcgtcctcttggtgggagcgccgtggcgttttgtcccctcgggtattccccaacatatagttgacgcccctctggagtgtccacatcggggttgtagtactctgcggggaataactacttctcggggttgtcgaagtggcaagttctactctgctgtggccccgtttacaagagcgcccctctctggagacttttcccgcaacactgctcgtctcacacaacacccccccaactagtgtgaggacgttttgtgtgtcctctgtcttgtgctgcaaacacgcgtggggtgcacctgtgtgcgcgctgacgacacagtggggggtgtttcacacactttctcacgcgcacatgggtgtctctctcacacagagtgttgagattngtgtgtgagacacactctcacagagtttgtcacacacagcgacgttcacatctctctctctatatgtctggggcggtgcccctgagacctctaagagatgtgtctctcttgtgttgtgcgcacactattttgttgagaggcgacatgtgagaagagaatagaccacatgcgtgtctcttgagagaggttgagatggcgccctatatgagaccgcggtttgtgtatagccacacatctgtgttcacccccctcttatatatattatattcacggccacatcacatgagaacgccacatgttttcttgtgtggccttttctaagttttggttgttcttggttgttctcacgttcttttatgagactcccacgctggcaccacaatttgagattggacttgcacaaattatacctggctttaaaggagatgtgggaaattcctaaattttttttgtgagacccttttcaactcccccaccatggcgtgttgtgacaccttctacccataacatagtcaagtattttccctgcca

SEQ ID NO: 597457 - DNA, 958 bp, Homo sapiens
  misc_feature (1)..(1): n is a, c, g, or t
ncatatgtcgtggatgcgttgggctcaatccggctgtcctatgcatcttatagtgttgcgcgcattttgcaacaagcttgtacccgatatggtgccggttgattgcctagcttcggatttattatcccccagtgccctaaatcgctcttcgtgttcgtaatggtgtttcaccgagctgggtattcccgcggtgggccacagcatattgtggtaggggcaaatggtgcttgtcccttacgaagacgcctcacctttgtgttcacaccgctgtattaggccttcgctcgctcgccccttgtgtgagcgggctccaccttggggttcccgctccccgtcgtttaattcccagattaatccgcccgcattttttgtaaccccccaggtgcccgtattttctttttataaactgttttgcacccccaacgatttgtataacccccagatgtgctctaaaatactggtaaacacaagcttcgtacaccacactaggcgggcataaaaatctttttaacttgtaacaccctccttacatctaacaacatagtttaggccaccgggacaaaccccttacaattatcttggttatactaaaagatggtgtgcaggaagtgcactcccacactgggggagatgcacgaaaaatggggtctccctgtgctccaccaatgggatgtataaccagtggtgaccaccacaattatagcacccaagtcctgttacacccacggtgttgcagatctatcactcattggtttcccagattataagtgaacaacatgaaaaaggagtacacccacaatcggtacaggacaaaagaagaacgatgatgaagagggcttttgaaataagaacatctttcttaccctgttgtggggtcttttttttaatttccttttttggggccccaaaaaaaaccctttgttaaaccccaacaaaacaaaaaaaacaaacataaaaa

SEQ ID NO: 597458 - DNA, 496 bp, Homo sapiens
gggctcaactggaggaacaaatatcagctccacctctgagcccaaggaagaatgagtcaccctgccccaccatctgaacactcattacactaaacacctctgggaaaaaaaaaaaaaacaaaatatcacaaaacaacagaaaaaaacaaaacaaaaacacaacacaaaaaacacctcttgggaggcacaaaagcaccacaaaagcaaatcacaaagccaaaacagtctagacaggcgagacaccaatggctcataatgacaaagccgagctaagcgtgcggcaaacaaaaagcaaccaaccgttgagaaacaaacacgaagagaggaacaaccaacaaaaaaaaaaaaaaaccgcggggcaaacacagacgcagactctagaaacacacaacgaatcaacggagctaccacacaccaacacagtaagcctcatacaaacaccggcgaccaaagagcgcagcagacaacaaaaacagcccccgcggctacccgaaga

SEQ ID NO: 597459 - DNA, 174 bp, Homo sapiens
  misc_feature (12)..(12): n is a, c, g, or t
  misc_feature (25)..(25): n is a, c, g, or t
  misc_feature (80)..(80): n is a, c, g, or t
  misc_feature (93)..(94): n is a, c, g, or t
  misc_feature (114)..(114): n is a, c, g, or t
  misc_feature (162)..(162): n is a, c, g, or t
  misc_feature (166)..(167): n is a, c, g, or t
  misc_feature (170)..(170): n is a, c, g, or t
tcagcatattgntctctctccagcnggacttctttaagcgactccttcaactgtgctcacgtgtcctttcagcagtatcngctcccgtatggnntgctctaactgccgcttganaagtgctttactgccgctcgagaacccatccggcttcttcttctgtgntggnngcnacag

SEQ ID NO: 597460 - DNA, 230 bp, Homo sapiens
aggccctcaacgtggaacaggcatcccagacgattgcacggaatgcacttaatcaggaaacggaggtggagctgtacaacgaatatcccgaacctatcaaactgcacaagaatgagcgggccaatggcctccgcagaaagctgcagttgctgagggggcagtgagagttgagcacagagtccttcacaaaccaagaacacacctaggccttcaacacaccaacgaacggc

SEQ ID NO: 597461 - DNA, 214 bp, Homo sapiens
cacctgtccccaaacactgggatgtttatggtactattactatcccctctttacatagattgagagaattgataataactgagtgattattccttttgaagaagtgataaagtgaaggtttcaagccacgggggtgtggcgttcaatactctaacacaagaatcatcaggaaatgtcttcagattgtctttcgagagaatttctctgtagatgg

SEQ ID NO: 597462 - DNA, 1479 bp, Homo sapiens
ccttcgccgcgctgttcagcctggccacccttgctccttcttgtgtttcattttgctctcacatttgtggtggtctgtcgcttgtctctccgtggctgtgtctcgttgtgctgttgtgtatattcgtcatgttcctggtgttgtgtggtgatgttggcgtctgttgcttcgtcttacgtttctgtagtgtgttcgtcctctcgttcttcgcagttgatgtgtacctgtcctggtgttgtgtggcgggtgtctcttgttgatgggtgcagtgtagtttagatggcggtccaccccttttgtggggtggtcgtgttcgttttgctctgctgtctcgcttgttagggtggtttggggggtgtcgtttcgctttgtctagtatctggtgtcggtctgatgtattgtcacgttgtgcggtgaagtgttgttgtgctttgggagttctggttgctgctgtcctatccgcgcctcttttgtgtatggtcggctccgccggcctggtagtgttgtaactcgcttgtttggcgtccactgcggcacgtgtttgttgtctgtgccggtggtcgtgggttatggggtgctgtcgcgtgttgtcccctgagctgggtggctacgtgaatcgtgttgttgcatgcacgtgttcgttgtctcgtttcttgtgtggtctctggatggccgccgcatggctagtctaagtgtgggctccgccattgtggctttgtccgctgatcgttcggtgggatctgtacgtggtgtgtgctcccgttggggctaccgctgctcccgttgttggtagccctgtcgtggcctggtggtggtgatgttgtgttggtgggggtcctcacctgggttagctgtcctccgctgggttgcgtctccccttgtttgtctgcggctctctgtggtctgttctattgttactctgtggtggtcccgccgtgtgtcctgtgtttggagccgtgtagtctagtgtgggccatctcagtgtctcactggggcgtcgatgatcgtgagtgagggccttctccctagtgagctggggtgttgtcttgtcgtcgcagttgtctgttgtatatggccctggtatggagccccgctggtctcacgcaggctgcggtccttgtggtgtcccgggcgcgagctgtgtggagtgtgtatcgccagggagtactctcacgctacctgtactcttattgtaagtgggactgcattcttagatagacctgtcttatagggttctcccctctttgggctgctctcgtaggggtctcgtaataagaccccaccttggatattcaggcagccgcacaggtgatattatcgggtactatgagccactgtatatagatggcccctgccacggtggcgactgccttgccatcccactcggtgatggatcggtttggatacagggtaatgttgctcgccattttgtgccccaagttaagatgctactggtttgaaggaaaaataaaaaaaaaa

SEQ ID NO: 597463 - DNA, 374 bp, Homo sapiens
  misc_feature (12)..(12): n is a, c, g, or t
  misc_feature (20)..(20): n is a, c, g, or t
  misc_feature (34)..(34): n is a, c, g, or t
  misc_feature (36)..(36): n is a, c, g, or t
  misc_feature (49)..(49): n is a, c, g, or t
  misc_feature (53)..(53): n is a, c, g, or t
  misc_feature (104)..(104): n is a, c, g, or t
  misc_feature (109)..(109): n is a, c, g, or t
  misc_feature (121)..(122): n is a, c, g, or t
  misc_feature (135)..(135): n is a, c, g, or t
  misc_feature (148)..(148): n is a, c, g, or t
  misc_feature (151)..(151): n is a, c, g, or t
  misc_feature (223)..(223): n is a, c, g, or t
  misc_feature (235)..(235): n is a, c, g, or t
  misc_feature (237)..(237): n is a, c, g, or t
  misc_feature (320)..(320): n is a, c, g, or t
  misc_feature (329)..(329): n is a, c, g, or t
  misc_feature (331)..(331): n is a, c, g, or t
  misc_feature (340)..(340): n is a, c, g, or t
  misc_feature (371)..(371): n is a, c, g, or t
cagacccagctncctatctngatcgtccacccgntnccttcccgtcctnactnacaccagccatgtccaagcggagcagatcgaagtcggaggaaaccattcgnggctngccaaggctcgnngaagccaaggatngagcccccctctnganggagaagccgaggaggaggagaaggacaaggaagaggccgaggaagaggaggcagttgaagaggaagaagtngccaaggaagantntgaagaagcaaaagaagaagaagaaggaggtgaaggtgaagaaggagaggaaaccaaagaagttgaagaggaggagaagaaanttgaaggtntnggggagganaagaagtaagaagaaagttgaaccccatttnctc

SEQ ID NO: 597464 - DNA, 456 bp, Homo sapiens
gatgtgcttactctcccgtcatgattctagaggcttacccagccttgatggactgtaagtccaataaaatctcttttacttcccagttctcgggtatgtcttatgtcagcagcatgaaaatggaccactatagtgctaccaattcaaataaccatcattaggaggtcatgttttacactttttattttatctttattttttatttttatttttgagatggagtctcgctctgtcatccaggctggagtacagtggcaagatcttggctcactgcaacctctgcctcccaggttcaagcaattctcctgcctcagcctcccagagtagctgggactacaggcatgcaccaccaggcccagctaatttaatttgtatttttagaggagatggggtttcaccatgtagatcaggatggtctcaaactcctgacctcaaatgatccacccaacacggcct

SEQ ID NO: 597465 - DNA, 316 bp, Homo sapiens
acttgattttaggtgtaatactggcatatatctgtcatattaccccactcaaagtttcttccgactaggcatcaaaatacagtgatttattaactaaggctttaatacattgttccacctaattggctcagactttgtattttatttacatatagtgttttttaccgctttttcaagcatttcttaatattttttaagtttcatgaagagtcagttattaatccataccatgtaattcttgtaatatgtattcagtgttttgtaagagtgatgtattttcaagattttgtatgactgtaagatcctcttcaaagag

SEQ ID NO: 597466 - DNA, 640 bp, Homo sapiens
agggatggagaagccaggtatcagcattggagactgatggagaactgagacggaagacacgagggggggaccttgcagctgtggaaggctccttggagcctcctttgtgggagggtatcagttctggttctgccagagcctcagccctggtagcagaacctcagggctgcccctctccccaaactcctcccagcaaggctgacccttatgagcttactccttaaacagtattaaccctgccacactcatggcgcatcgcgcaccttggcttcccctgccccactttgctcctgctgacagcgtccattgctggcacgctgcgacacgcgtgcaacatactacactccagccctactctccgcgctctcgactctacactcctcaagggcgcaagggctccgcttacacacacgctgcgcccactcccatggctacatgcgtctctctcttgcaccacactaggactcttaggtacgaacatcacccttcccctttttcatggatcactctacacaagctgacggtatcacctgtgcgagcagaatgtcctcttccctgctggctgccctgcccatactgctgcagggctgtggcggggtgcaggtctgcggtcggggtgggccacagctcgtgtcctagg

SEQ ID NO: 597467 - DNA, 1053 bp, Homo sapiens
ctcaggagccagaacggtctgatctggcctctgctttgaggcccaattattccatcagggaaatctatctagggctctccccttggtctttcaaagtggattaatgacccttcctcgatacttgcagagagataagccctgcgcgtaggaactgcatcctagtttgatgcgagtcttgtgacattcgctgcgagacgtcttgcggttcaacctttcgacagctcccgtgtatactccaaggctgtctccgtgtctgggaatagtaggaaggcagatatcccaggaacatagggtctggagctcatccgcggctggttgcccataccaagggtgttcatgcgtagcatggatgagagcaaacaagtccatggtcttgtacagcacttggttgacgtcttatgacttggaactcgcccctaggccagcgcgacgcaatggtgatgggggatctcagtgggctttggcgatatagcatactattccaagagcgccttgaactagagcgagtctggacgcatcgtagtggtctcggactgcggtgggggaactgaggagcgaggtagcatggggcacaaaagtaaccctggagggccccaactggccctcacggcgcaccaagggtggtgtagccccttgtggcgactcgttgacaagagactcactgtggttcccaagtcattgaccgaggataggtaactaagtaacacctgggccgaaccttctatccaatttatatgttcactgggcctggaagagcaccctttatgcccataatatttcccgaacgtgcctcggtgtcccatgggctccttgaagatttaccagtcgtggggcccagggtgcatgctggggacttatttagaacccgcctttttccatttatgaatcgtaagggcatatgagcttggggcccccggcattcgtaggcacggatgacgtattacctggtaagcctaaccaaaattaggggcctaactagtttggtgtaccacttgtgagagccaggcgaaggggcgtggcacttagggaacacaaagagctgcgagaagtgga

SEQ ID NO: 597468 - DNA, 414 bp, Homo sapiens
ccgaccgacgatcaggcgactccatcttggttattacccattagtgccttatcaaaacccatgtgggtgttaaaaccagcaatgctaatgtcatgtttattgacattcataatgacgctgggttaaattatgtgacattgaggctgatttattatgcccgcaccaatgttgggatggtcacttcttgagcgacatcctatcttaagggtaacttcttccgtttttcctattaactgtagaggcagtatatgcactgtcttgccgttgttcttgtgaacatagttcctttctatcccttctcctgagaccttccctctctatgtgcctatccatcccttaactacctcctctcttaacagtgttacacagcaataaataatgcattccctttttgatttctggggagtcgccctt

SEQ ID NO: 597469 - DNA, 217 bp, Homo sapiens
tgaatatggggtcctcagccctgcaccctctgcggtcatcagcggctgcatggttttgaggctcaggtttggataacggtgaaaagaatagtcaccagggattactcagaccggccgagctctcgcgagtcctggtgggcgttgaactgtggagaaagcacgtatgcaagatagtggtcaagcacgacatgcatccctcgtgaatggttttcacttt

SEQ ID NO: 597470 - DNA, 362 bp, Homo sapiens
aaggcggttttgatttcgcacgcatccatcccatcgagttctatgccgttttcccggacgaggagcgggcgcgcagggcggcaggcaagtttcgcggtgaatccttgaatgcccaggtcagtgtccgcgacgacggcgcctggtacctggaactgagcaaggtgatgtacgccacctatggcggtatcggtgacttcgagcagaacttcggggcggtggtcgagcccctgggcggtacgatcgaagggtggggcgtcaagcacccggtgcgggcactcaattgagtgcacttcttctttcaaccagcaacggctgacccaagggttggccgtttttgtttatcacgcacaaaaagtcgacgc

SEQ ID NO: 597471 - DNA, 286 bp, Homo sapiens
tgcgatctaagcttactacagcctctacctcctgggtcccgcgattcttgtgctcagcctcccgagtagctgggactgcaggcgtgcccactgtacctggctactttttgtatttttagtggagacggggttttgtcacgttggccgggctggtctcgaaatcctgacctcaggtgattcacctgcttcagcctcccaaagtgctgggattgtaggtgtgagccaccgagcctggctaaaatattttaaatctttcaaagatatgtaaagatgttacgtgttttct

SEQ ID NO: 597472 - DNA, 511 bp, Homo sapiens
gtcggggaacgtggcgccacggaagtcatacattgaggcgagccgtacctagagatctcaacataaccataaactcttggggactggactgacgcattcatggatgctcagcacctagcaataaatttctcagtaagtaattagtagaaggatatagcagaacattaacatgaaagcaatacataacatcagctaggcaatcaaagaagacagaggccgggtgcgggggctcacgcctgtaatcccagcactttgggaggctgaggcaagcaggttacttgaggtgaggagttcaagaccagcctgggcaacgtggcgaaaccccgtctctaccaaaaagccaaaattagccaggtgcggtggtatgcgcctggagtcccagccacttggcaggctgaggcaggagaagtgctttgaacccgggaggcagaggagcagagtttctgctcaacagtttctgatcaacagtgctctaaagaaaactttccactgttggaattggatttgaagc

SEQ ID NO: 597473 - DNA, 419 bp, Homo sapiens
  misc_feature (369)..(369): n is a, c, g, or t
tagaatctcatcttctgagaaatgctgcctgtttgtcttcacttgtgagggagactgctcgctccctctgcccttccattttgtttctcagacaggctctttagctttaagggctaggggcattaaggatgccaggatctgtgtttcagagctgagtgttctcacccagccttattgaagcctagcccggaaagctttgagaagcaaagcccctgacagccgagatcccttggcagtactcagtgcggcagtgttggccttctaggataatggggattttctcatatcctcctttggaccgttgaaacctccacaagggaatcatttttcaaaacatcttgttctgggaaggattggaccaagtaagtntatttactggtggaaagaagcgtgcacttataccaaagcagtcttctagt

SEQ ID NO: 597474 - DNA, 163 bp, Homo sapiens
ccttcctgtagctctcaaagcaaattatgagccattatctctattctgcaagctcagactgcagaagcatgtgaagctaacaccaccgatgatggcgtaccctagcatgacattctcttggacagcagaatgttaatcgacacgcgtgcagcattatgtgaaa

SEQ ID NO: 597475 - DNA, 653 bp, Homo sapiens
gctcgaccgtcgtcactaacagtcaaaagtggcgagcacaccactactgctgcattgtgcacacgcggggctggcgcacccgtcagggtggagctggaatctccaggcaagtcctccgtgctcgtggtgggaatcgtcatcggtgtcttgctactcacggcagcggctgtaggatgagctctgttgtggagaagatgaggaatgggcctgcaagcccttggaacttccgtcctggaaaagacaaccggggtcctccgcgcacaccaggggagggccagattccgattttaagggattgaaattgggtccagcccacgcctgaccattcgacaatccgagtgctaaaagcggaattggtctaggcgccttgaggggtgtagaccccctggaaacttgggatctttagcccccaaaagggttttggaccaattgtccccccgtgaggccccgccctggaggtgcgccaattccccccgataagaaaagggttttcacaccggaagataaaccagtttggcccagaaaaaaaaaaaatgtcacggcgcctttatagtatgtgcaccgggattcggcgggtctgaggtgacacttcctcggaggacgcataaatacggaaaggtcaagagttcctggaatttggcggcgacccaaaa

SEQ ID NO: 597476 - DNA, 97 bp, Homo sapiens
tcataagggctttctaaaaccatttctgtccaagagaaaaaaaactgtactgcttgttcaagagggctgtgattaaaatctttagcattttgttcct

SEQ ID NO: 597477 - DNA, 224 bp, Homo sapiens
ccccccttttttgggggttaaatcccccgggttttaaaccttaaaaccccccccttggaaaaattttttgggaaaacccccccccccttttttttgcccccccagtttttggggtaaaatggggcccccccccccccccaggcctttttaaccccccaaaatttgggttttggggaaatttttttttttgggaaaaaaaaaaaaaaaaaaaaaggggtttttta

SEQ ID NO: 597478 - DNA, 101 bp, Homo sapiens
agtgatgaaaatgcttaggatctagatagaggtggtggctgtgaatgtactaaatgccactgaattattattcacttgctattgaaacttctaaaactagg

SEQ ID NO: 597479 - DNA, 238 bp, Homo sapiens
ctagggataacactgaattaggaatatacacaaaatggctaagagggctgggtgcagtggctcacgccttgtaatcccagcactctgggaggcatgggcgggtggatcgtttgagctcaggagctcgagaccagcctgggcaacacagtgaaaccccgtctctacaaaaattacaaaaaaattagccaggcgtggtggcgtgcacctgtaaccccagctacttgggagactgaggcgg

SEQ ID NO: 597480 - DNA, 366 bp, Homo sapiens
ccgcagcatacgccgtcgcgtcacgcagagggtcgtcgtggtgatgcgcaccaaagcgtccagcgggccaacgtcgggaatcggcttgtcctgcaggacaatgcggtttttttcaacgaaaacagcggcgctcatggttgccataaggtgatctcctgcgcaggggaactccagattgcgccgcgatcacgcctggcaggttgatcatgatcaactatcgcgcaactgaccgcacatcgcgtgccgctctgggcctgcgggcaatttgatacagatcaacctcgacctcgcagcgcaggccatgatcagcggcaggtatcaccgccgctgccaccgaccccgagggagattgccatgtctgaccaa

SEQ ID NO: 597481 - DNA, 951 bp, Homo sapiens
cgtcgtgttacccaacgataatatggacgcggcgcagttgagcccaatttacatagatgtcgcggccgaaagccggtcacttcgcgcttggccaacctatccaccttgggcccagggtctcctgcacacggtcggcccctgtcccatacgtacccgtttttcgtggacacagatatgtctggtgctgggcacgccctgatagccccatatttcggggttagcccagaaattttgtaaccccgggggcgggtacccctgcctcggtgggcccccccgtgcctccgctccatggtggccacaccgtccaggagatccccctctgttaagttgtaatgttgaatacaccccacaggggtcttttggaacaacccccggaaatccccaaccgccggccgtcagagtactcctaccctcggccgcgcgcccgtgtggtcaagcgccgtacaaagccaccgcacctcggggacgcatgcggccacaaaaggagatcactgggagcccccagggaattggcgacaacacccgagcgtggcaaatatcaggaagaggcccctcctccctcagaaaaaactatacaaaaagacaggccgtcggtcccaccgtggtgtccccacacggggaagagacgcccccacctgggggaggcccacgcgggcggcacaaaccccatcgccgctccaaaggtcttcaaggaccacctccccccccccaacaagcggtgaagaccccactcttgtggactaacaaaagaagaagacagccagcaccaccgctagggtgggcacagggaaccggtaggtagcacgagcaccgtgggcgcggataaaggcacagcaggaaaccatcttcggaacccccgaagcgcacacaaggtgatccacgagtccgcggaccatactcccacgtgactcccccccggggccccaggccacaatcccgtcccccaaaaca

SEQ ID NO: 597482 - DNA, 139 bp, Homo sapiens
gatatgagctcggaccggacgatagggatagggatgaccgtcgccgtgagagggataccttgattctcgaggtggaccccagctctcctctctggctttttctttctctctccatccacctggcttgactaatggtctc

SEQ ID NO: 597483 - DNA, 396 bp, Homo sapiens
ctttttagggggggcggtttttccagggcatttcccccccggggttttgcccttttggccggggggccccccccttggggggggtttgcccctttggggggggggccccggggttttttttttttaaaaggttttttggggggcccccggggggggggttccccccccccaactcctttttttttccgggggagggggggggttttgggggggtttcccctttggttcttggccccccccccccgttttgccctggggggttcccggccctgggggggggggaagcctttttggggcccctgggggagggcccgttttcccgggggggggggggttttttcccggggccggtttttccggtggggggggttccctaaaagtttttttcccctggga

SEQ ID NO: 597484 - DNA, 893 bp, Homo sapiens
gggaaagtgacccaaatcagactacctgtgaagcttggcacattaccttcagccggacgaaacatacatggtccacaaacagtattactgtgctacacgccacgaccctccactgaagaggtctgcttccaacaaagtgcctgccatgcaagagaaccatgcgcacacgcaaggcgcgaacgatgtctgagatgtgcctacctgagcaggaaacaaaggcctcacactggttcagcagagattcttgagtagccaacctcaataatccttgtacctccaactcaagaaccacagaagggctcgcgagagttgctacccacccaagatgtgatcatcttcccaccggacttttgtctctaaacacttggaaacttctctgagatcaacaagtgttgttcagtttccaacatgtgataatatcattcagtgtttcctgcctagagatggcgtgccatagatctcagcaaaaggtgttatctcagtctgagcggaggaccagttccaaaaggtgtggactcatcacgagtgcctgtgtgcaacaatcagttcactaaggtaacaaaactattctggccccaaagaggaatttctggcgggttaagtggaatcagggtaatgactgggtcaagtggaggggaaagtgtttccagattcagcaacgcgcacgaaaagcctgtgcagtagaagaaggctactaacggtgacaattggatgtggcgagttccaccagtggaaattattttttccccctagaccagaggggtgaagtttaggaggggcacctatggccaagaagcgattgtgtttcacagctccggggcaaaaagaggggacattctttgggagaggattcgtgtgcaacagcaaggaaggactaggtagtgggcaggcac

SEQ ID NO: 597485 - DNA, 777 bp, Homo sapiens
ttgcaaaatacatttgaatgtgctttcaagtattaccagtttggggtcatagctgaaaaactttattaagtcacagataaaatgggaaaatcaggaatattttatattgtatgaaatatacaataacactgtgtgtgatggctcaggtctgtaatcctgtgatagttaatactgattgtcaacttgattacattgaaggatgtaagcattgctcctgggtgtgtctgtgagggtgttgccaaaggagattaatatttgagtcagtagtctggggaaggcagaccccctacttaatctatgggcaccatctaatcagctgccagcatggctaaaatataaagcaggcagaagaacatgaaaagactagactggcctagtttcccagcctacatctttctcccgtggtggatgcttcctgccctcaaacatcagactccaggttcttcagttttaggactcggactggctctccttgctcctcagcttgcagatggcctattgtgggaccttgtgattatgtgagttaatgcttaattaaacctccccccttttatatggttaaccctaaaaccacacaatctaggcatacaacaacaacaataaatcataaacgaatactccccacatacactaccccaaacctgcacatacacgtcaccaatcaaactatcacacacaaacgcaacatcaacacaacaaaaagagcggcgccctataataattatctccacgcgcagccaatcatttgcgcgacaagttttcttacaacagaaccaa

SEQ ID NO: 597486 - DNA, 892 bp, Homo sapiens
agcggattgggggaagcgcccgcgctttcggagggttccgttaaaatggcgccctggtggccggtgtggtgcccgcgccttagcctgtcgaggagcatgggagcttgctgtgtgtgctgcagtgaagggcgctgggccgcggatccctgctgctgtgctggctgatgtctagtggctgtgctcatgacctctggaccacctgtgcacggctcctgtgtgcgaggatgtgctgatcccgtgatcagaagtcgccgaacgttcttgcttgcgggaaccttgtgctggcaggactcctggtgcaggatgccgaagctgatgtatgcccagcaggttccaagtatgcttgtgctggtgtgatttggcacgcaaacttcgccccaacttgtatggaacgacgcatgcaattgtcttaggtactgctgaagacaagactccacacgaacagagcgttattcgacaacgagagagaagcacgatgctgcatctactcttcagcactccacagaagacttcattcacagtggagtttccgccaaccctccctggtcaatactctacctcttgctgagcctcagtgaggacccacgcatggcagccaacgcaaggttatctagctatgctacgtcatttgcgtcaggacctgaccaagagatgcccactcaatcccttacctattatgccagggcctcagagccttacccgtgagctaacaaggatcgagagtagcacagtcagaccgagagctactctgccagagttggggcaggctagtggcatctagcacgaccttggcctgtgtgtcctcagtggctccgcgcctggcaccagaatctactcatcacacggacagtcttagtcagcgttcaatgagtacgacgattgccttacgaac

SEQ ID NO: 597487 - DNA, 1185 bp, Homo sapiens
ggatctcgtgagaaccaatctcactaaaatcaagaacaggtagtggggaaactgcccccatgattcaattatctccacctggttccctccctaggacacatggaggattactgggaactacaagtcaagatgagatttgggtggagacacagccaaatcgatatcagggtgttgtgaggattcatgtgatgcaacactgtgcttgtgatacatgctagccttgctaacaggtggctagacgcacgctgtgccggctgctgtatgtggacttacttgattctattgttacatgaccgtctatcgccttcgttgtctcactcctgtgttgactcctgtcacgcttgcttctaatcgttttcccgtccgtttctcccgtggtttccatcgccttgtggcttgcatgacgtcaggcggaccgggcaatggctggctgagggctgaacgagatgctctgacatgtctaggcaggaaatgacagttcccaggtcagtcctctgtttcaggtgtggaaccatggctccgaactacactttgtgtgataaattctatgtaactgccaggcatgagctctacctccagcgcccttaggctgcaagactaggacatgaggctgaaagtcagagaagtccctgtgagacgagggccctgaggaagcactggccagactgtagcaggtcactcaccaggccacccgctggttctagctatcccgaaagccagcctttgtgccagcccattgatggcttccttagcagcattccaagattatggtacactgggagacctttcaacagaaagttcgacaaaccacccctggaacggtgagaaacacacaaggtaactagagaaaaggtatatagaacaacactaagacttgggacccacaacaagtaaaacgcggaagtgcaagcaatagaccggccgtgtgtaacaagaggttgtgaacccaaacaaaaggaggaagaacttctaaaaacagataaatagcgggcaaacatgtaaacaaagaagaaaagggcaagaaaaaaaaaaaacaaagagagaaaagcaagacgaaaggaagaaaacagcagtataaaagagaacaaaaagaagaggaaaaaagcaaaaactaagagcagaagagaagaagaaagaagcagaagaaagaaatgacgacagacccccccgtcgccctagaaagaa

SEQ ID NO: 597488 - DNA, 142 bp, Homo sapiens
ggcagagagtggacagagttacatacctaggtatctgtgcagagctatgtcaaaacgccccagtaggcagagcctagcataatgttacatcacctgggtgaccagctgcagagatacgtcacaataccgtctgtaggctgga

SEQ ID NO: 597489 - DNA, 792 bp, Homo sapiens
tagaggcttgtgacactacatccagctaagtatgtagggacagggttacatatgttgccaggctgttcgagctcctggcccgggtgatcctcactacctcatcctcccaaagtcccaggtatgaaccaacggtgccaggccatatactccttatgaggcatgtaagtgcattaaagtgctcgttagatcactggacagtatccaagtctctcctgggaaaaggaaagatagccagcgttggtaaacaacccacaaaagaaggcaacagcaaattctgagatgagttattcttcctttgtattacccagatcgaaggggttcgaaagtcctgagagtttgcagtctcgctcagaactctcccctctccttttggtcagcatcgacgtgaacagcagggtatcgtccctccactatgaagagctttcctgtgctatgaacggagggcagatttccgtatctgacaaggggcatcctgggggcaaatctgtacacagtgatttccttaggaccgggaaggattacagcccgatttcctctatagagcaccttccctttgctaaaaggcactaatgtcaaatgttaaccagccaggtcgcagggattccctacctccagtgctatcgtagcgctatcgatcttgtcctggggcccaaagtggtggcacccgggttgctgcgaattccacctacccaacatgaaacacctttggctctgactcatccaggccagaccactagttgcagttttgcaccgctcgcattcaaggtcaggacaaagcataccatcgggagc

SEQ ID NO: 597490 - DNA, 748 bp, Homo sapiens
tagagcaaggagaagacccctggatggtggagagtggagttccccaaggcgcacatctcggatgggaaagcttgtttggaaccatagtttctaaagaagaaaatcaggaagtcatgaaaaaactcataattgatggcacatttgacttcaagtggagaagacctgcattaatgaactcggcattagagaagcaacaaggcaaaaagaacagacttatcagtaaagtgtagttaccatcaaacaagtctacatgaaggagaggagctttaaaggtgtgaatcgggaacaacatctaggtctacaatcatcgcttatagaaaaccgagaatagttaccagaggaaggagaccccggcacagcagtatcagtagcactattaaacaactgggggtcaacacagagcgtaaatgtcataaactgtaacatctgtgggaaaatctcctccacagtcctccctgagtaacaccagagaatccacaacggagagaagctctatcactgtaacggaagtacgaacagccgtcagacaaaggctcatcccataactcaagcactcgagggcacataacaggagaagaacccctatatatgtcgtgaaggtggaaaagccccagctccacaaaatcgctacaggaaccagagatgcaaactgcaaagacgccaaccaagcaggagggcaaactaaagggaaaacaatacacaccgcgatcaagaaaaagctaaggacaaggagacaaaagaaaacaaa

SEQ ID NO: 597491 - DNA, 495 bp, Homo sapiens
tgcccccatgtccgggagaagggctccgggaaacaaaacaaggacctttattagttggccttttccatcaactatgaccgtggggaggaggaagggtacctcaacttcattgccccccccaaacgggagttttacctgtggacaaatggggtcagtgcccttctgggcagttccatgggcaacgaacaaacccggctgggcctggaacaacttcttaccatggagacccaactgggttttctggaggtggaaaaagtgcccatccccgaagggcccccccctgtggccccccccccccccaaattaaaattttgttatgaatgcagcatcgcttaacctttacagtgtgggtggccatgggccccaacttcggccccttcaacaacccttaagggcagtgggtaaaggagtgcaggcccccttaccaccaaaaatttctgcaaaaaaaaagtttgcttgggttttgggatatgtttagcccgctttgttccctta

SEQ ID NO: 597492 - DNA, 356 bp, Homo sapiens
  misc_feature (28)..(28): n is a, c, g, or t
  misc_feature (91)..(91): n is a, c, g, or t
  misc_feature (98)..(98): n is a, c, g, or t
  misc_feature (103)..(103): n is a, c, g, or t
  misc_feature (105)..(105): n is a, c, g, or t
  misc_feature (114)..(114): n is a, c, g, or t
  misc_feature (157)..(157): n is a, c, g, or t
  misc_feature (166)..(166): n is a, c, g, or t
  misc_feature (175)..(175): n is a, c, g, or t
  misc_feature (178)..(178): n is a, c, g, or t
  misc_feature (189)..(189): n is a, c, g, or t
  misc_feature (231)..(231): n is a, c, g, or t
  misc_feature (272)..(272): n is a, c, g, or t
  misc_feature (289)..(289): n is a, c, g, or t
  misc_feature (293)..(293): n is a, c, g, or t
  misc_feature (329)..(329): n is a, c, g, or t
atgctctgagttcaggagatttctgagntctgacgtgttgtcctggggtggaaaattcctctcgtgacctcgtgtgtcatgtcgcattgcnccaggcntacancngtttatgcngcgtccctaagggttgaaaaaacccagcgcctcttcagctgcngtgtatctncttatacanaanctctgtttcgngctcggaattatgtgtgtggggcgtatacacgtgacacaggngatttccgcgttcggacttgggtcccatccccgaggtctcnttttgtgtttacaagtnttcntgaagtgcaaacgttctggtttctgtcttttcaggngtgcattatttatatgttctattttgt

SEQ ID NO: 597493 - DNA, 118 bp, Homo sapiens
  misc_feature (55)..(55): n is a, c, g, or t
  misc_feature (62)..(62): n is a, c, g, or t
taaggatccctgcaggagagagaactgaagggaggactggtcgaaggggcagtgnagcaggngtcttggagggacaggccatgaacttgcaggggggtgagggagccgccaaattcgg

SEQ ID NO: 597494 - DNA, 345 bp, Homo sapiens
cagcgctcacattactgcaggccacctactcatgcacgctactctggaagcgccaccctagcactatcagccattcaccttccctctacacttatcatctacacaattctaattctactgactatcctagaaatcgctgtcgcctaaatccaagactacgattaacgacacttcatagtaagactcaaccgtgaacaactaaactcctcggaatcctgactcaatcattgacacaaaacacccaaataatctataaacctagccatggacatccccttatgagcgagcgcagtgattataggctttcgatctaagattaaaaataccctagcccacttcttacca

SEQ ID NO: 597495 - DNA, 775 bp, Homo sapiens
  misc_feature (303)..(303): n is a, c, g, or t
  misc_feature (414)..(414): n is a, c, g, or t
  misc_feature (457)..(457): n is a, c, g, or t
ctgtacgcttgggtatgtgacgctgctggacggaaacacctcaggacacggcctacaacaccaagagaggtattgtggccagtattttggtctcttcttgatgttcttggagtcatcacatagctaacagacgcggccaattttccagatcctcagtccagacttacctggaggatttcggctctgtcgctgaggtgtggatctaccgagtctgatatatctcagtcttgtatacctcgttccagtaactgtccagggacgagccggtcgacgttttcttaaacgttattgttcgacacccanacgactggagtgcaggatcctccatcctaggctcatgtaggtagggacggtactagcgggagtgtggagatactttggccctacagtcctaagcagatctcgcaatgcaancataatagacgtatcgtggtaacctccttttgtccacaatcanttctgaggcacaaaggtttggcaattgggctatgtgtttcggccgcggctagctgttgtcctgtggtgctcgtgcttactcgtgtatagggacccccgttgttactgggattgctcggaggtactggtgattgggcatggttgtcatttgtagtctatccatggcgctgcaatgtttcgtagttgtccttgcgcagtacatgcctgggtagcttgccgagcgttgccgcaacgttcagcccgcagctgctggggtggggatcatctggcatcatggggaccgtgctccgtcttgcaaacgtggtcgtggggccgatct

SEQ ID NO: 597496 - DNA, 458 bp, Homo sapiens
  misc_feature (305)..(305): n is a, c, g, or t
aatggtttattttacaagttaacttttcccctgcatcaatttaaacttggccggggcttaaacactttagggcaacccacccggaacaatagcaagatggttttctagaaaaaaaacttttttaccaatggccaatatccatccctcatgaggcctacttgttctttgtaaaacttgaggggggactaggctgatcttttacatatgccggggacaaggttttcatggggggcataaaactcgtttcaagctttgacttttaaagatttggagggtccgggtctttacaaaccccacccctcttnctcctgttttcttcagaagggaacaggcataccacgctcagagaaaacacaagttcaagacttttcgagatgatttagaagtggatctcttgttattttagcataatgtttattttctcttacagattccatttgccaaaaacatttatggaa

SEQ ID NO: 597497 - DNA, 638 bp, Homo sapiens
  misc_feature (284)..(284): n is a, c, g, or t
ttttcggggcaaccgtggggggtttttaatattggagacctcaaacaaggtcaccttttttacaaaaagggctggcggggccatggtttgggcctggattaaatattttgcgggcttttctgcaacaagggggatatcccttcattccagacgctgggcagggaaatgagttttccatacttgccttcaggcaccccagagcttgaagttccaaaaccaggtcagccctttgaacctgagcatggccccagccctggacaaaacacgttttgccagggcaaaantgatgggctctatcccaatcctcgggaacggtccagcttttacaactgtgcaacgggggggctgttccaacaaaactgcccgacaggcctggtgttcagcaactcctgcaaattgtgcccctggatttaagttgtaaagcccccctccagtcccaattttgagggtgggcccaggatccctttacagcctgcctcctgggttttccctgggggccccaatttgggtcctgcaggcctttttgtggttttcctttatccaggctttttgctttcagccttgccttccttttttttgggtttcctggggggcccctttcccttgcaaaataaatttttggtttgtgccccttttta

SEQ ID NO: 597498 - DNA, 812 bp, Homo sapiens
ggccaggcgtggtggctcacgcctgtaataccagcacttgggagacgaggcgggcggatcacctgaggtcgggagttcaagaccacctgtggcgaacacggtgaaaccccgtctctacaaaaaatacaaaaattagccaggcgtggtggcacgtgcctgtagtcccagctacttgggaggctaagtcaggagaatggcttgaactgtgggagatggcggttgcagtgagccaagattgcaccactgcattccaacctgggtgatgaagtgagactctccaaaaaaaaaaaaggaatttattaatcctgcctggggctctacatagcctcagtggcgcatcatgggatagctcagaggggcccttgattcgtgggcagggcaattaaagccagattgaggaatttaccatcttctattagaagaaaccaagagaaaaaaattttttatggctaaggagtgctttatgaccacttaatttttaatctaagttaaagtggtctctcccgtgtgggttactggtgaagtggcacctcttttgggagtgggggctacataataggtgccttacccccaaatcttgtggcaacctaataccatcttggtccttcggacttagattccaaacactgtctgtgatgtgggacagttgtgaaactattgggccaatgtgtgtcccacattaggcttataatgggagggttctcacaaggggttcccacgggtcattcagggacgggcgctaatatctctttcggggggtcagcgggccacaaaccactgggtccagaaaggttgtagacacgggtcaccgg

SEQ ID NO: 597499 - DNA, 562 bp, Homo sapiens
  misc_feature (219)..(219): n is a, c, g, or t
  misc_feature (255)..(255): n is a, c, g, or t
gtataatcgttggtggaggcgggtgtatgggagggttcaggagggacggggaaggaagatggcgacgtcgggggcgaacgggctggttcggcacggctcgtgttccaatccgcgcaaatttagtgagaagattggcttgagaagcagcgtcaggccgaggagacggcggccttcgaggaggtgatgatggacatcggctccaccctggttacaggcccnaaaaactgcgacgtgggcatacacaagtgagctctncattatgggtgggtctcttgcccaattgttaacccagatttggctcttggccttggccgaagttccaagagcccccctccactcaacctttgggattcatcttcgtgagcactcgtgcaccaatgggcttggtgtaacgggggtgcagtgagaatcctcgaagcaatggtgtccccagttcgggcgatacagccggcaacattgacaggtctccctatagtcctgcctacttatctcctcccccagagtctagctggcgaaggacgatgggctggggcaattcccctgcagagaaagggtcagtggt

SEQ ID NO: 597500 - DNA, 609 bp, Homo sapiens
  misc_feature (558)..(558): n is a, c, g, or t
ttatcacaggtagtgtcagtattagaattatatatagtagcaaaaatgtggaaacatctgacatgtcaatggcgatgaaagtggtatgtaataacagtcagtcatgatggaataccagggcgagccatgtacaagtcaagctacagacgaataatgacctcaaaaaatgttcacaaaatagtagtacaccaagacaaaagtgcattttcaatatgatcatctgaaaaatacagtattctctttgcaaaaatgtagatgtacttacaaatgcattgtaaaagtctggaaggatttataccagaatattaatcaatattttcatcttattttaaaatttcctaaatatctgaaatattcttcagagaacctcaattcctttgtaatcagaaaaattagttaaaatattaaaagcaggcaagtaatatcaacaagatgatacactaggagatcccagctcttgtctccccaacaaaagcaagaatttaacagctacttgccaacaaaaatagctctgagaatactccagagtacagtgaagaagctgcaggaacccattanagcacccccaaagcaaagacagctgtatataaaagtgtcggaagcgttttc

SEQ ID NO: 597501 - DNA, 377 bp, Homo sapiens
  misc_feature (7)..(7): n is a, c, g, or t
  misc_feature (17)..(17): n is a, c, g, or t
cagttangcggccccantagaacctcctggaataaaggttcccagggggcaccctggagccttttacatttcccgggaaggtcccggggggaaacaacccttttttcgggggggggggggccccaaaaaaagaaacgggggcccttttttttcccaaaaaaaatttcccgggttttcccccccccctgaaaaaaaaagtttttttttcacccccggggggaaaaccccggggggggggggggcaccccctcaaaaagaggggggggcccccccggggggggttttttaaaaaacgcgccgccgccctcccctttttttttttttttttagaaaggggggttttctttcccgtggggggggggggttttttttttagt

SEQ ID NO: 597502 - DNA, 200 bp, Homo sapiens
ggtctcagtcatagtctggaacttctttgggtccaagactaggaggtccctaagatcggatggcctgcctcctcctgtccctcacagggattttttcccaaaggtggaaggggggcatgctttaggtcgttaaagtattcgggtcgggtttggggcgctcacccccattattctttcgcacaatctcttggggttcacag

SEQ ID NO: 597503 - DNA, 891 bp, Homo sapiens
tacagtgacagggagattcggatagaatatagattggcttcatgtggaaaatatattctcaataagtgtaaaatagtagaaggtctatatcatgggttgtatttatctgcttcacaacagcacaaagtgtctttcatttttttgttggtttcttttaagatcttttttaccctgaagtcggtgaatacttttctagatttactttgatactctttctgtgtatactattaacgcttttgctgtagattgcctagtaaaattactaaggactaggcttgtatcctcacactatggtctattttacagctctgatgctttacgggcgggcaaaacgtgtagctctactaaaaatgctttaacactaaatttggaacaacgagtatgaacaaccaataccaatacctattgcgtccgcgattcttaagaccccagttcgttattccactaaactaggttatcttaaccatatcatctgatcctcgtggggccattatttaccttcccttatgtcttatagaataatggttaaatattctcgtaggtcaaaacttacttccaggcaaagtaactttcccaacaattaaccagtaattagagcacctgaacaaaaatctcaggtggtttaccctagcgatgcccatctcttgtgctcatacctatcattcacacaaagccaactggggagcgctagaccaaactaattctcaacctgcccctttgttaaactccaccggtctcgcgataactgcacctagtctgcaattctgccacgcaacctacatccaaaaaataacaaggaatccaccacagctccagcaaaaccagtcacacaactaaagcggcactcaacacgcacaacaacaactccaccgcacacaacaaaccacgaaa

SEQ ID NO: 597504 - DNA, 225 bp, Homo sapiens
tgggggcccaagaaaaaatttaattttttttaaaaaaacgcccccccccccgggtttgggggggttttaaaacccctttttttttttgccggggttttggcatttgaaggggggtttttttaaaaaattggggcggcccattttttttttaaaaaacccttttttttggggcccttttttttaaaaggggggcaatttttttttgggccccccggcccaaattca

SEQ ID NO: 597505 - DNA, 155 bp, Homo sapiens
  misc_feature (61)..(63): n is a, c, g, or t
  misc_feature (90)..(90): n is a, c, g, or t
  misc_feature (94)..(94): n is a, c, g, or t
ctattctaacgaaggagggagaggagtaatgcacaagaaactcaggccattgggggagcannnagaaaccgaggaggtccagtgcatgcntctntggcatttatgtggagttgcagttgtgtcctgctgaaattgcagggcttttgtaccagtgt

SEQ ID NO: 597506 - DNA, 130 bp, Homo sapiens
agcggaatcgtgagtgtgctgttcgaattcataagaacaggtaggttagaagtagggtcttggtgacaaaatatgttgtgtacagtacaggggagagtgcgtcatatgttgttcctaggaagattgtagt

SEQ ID NO: 597507 - DNA, 908 bp, Homo sapiens
ggggagcgcctgcgccgctccgcggagagtccgtggatctcagaggttcccagtattccagacctgaattgttttccagattaaagcgaagagacgatctgtggatgttgaagtatgcaagggagctgaaggagagagacattgagaagagagatttgtccgggtctgggtaaagcaatatacaaggcctgctctggatgcaggatgtctgtaatattgactcatcagggatagtagtgaagaggtgccaagaggatgagtactcaaggattctagcattatgaagaatgaatcatgcgatgtgatggtggcttgaaggagtaactctcctagggagattgctgaatcatgcccttgtccaggaaggaggtgagggagaatagaacttgtgatgcacatagagaaggagccccgtaaaattataagtgcaaggactatacatttgtgagaagaagctgtgctatttgaagcgtcaagccgttgtttacacgtctcaggggtatctacaagaagagaggttctgagtcagggggaaagagtgtaatcatgacaaaccgaatgatatgtcagagcaggagtgacaggtccaactctctggcctcacagatgaaaatcttgggccccatgtactggactgtggcaaaaacctttgctcagagctcatcccttacccaacatcggagaagcttcatactgcgagagaagacccttgcaccatggtgacggggacatgtgcgggaaaagccttttagtccgtaagtgcaattccctgggccacaggcattcgagaagaatttcaccactgggagttcgaagccctattggttttgcagcagtgtggtgaaaacatttcgagcgtcgagtcacttcctcagtccgggtcaacagattgcgcagctggcgagacc

SEQ ID NO: 597508 - DNA, 1708 bp, Homo sapiens
  misc_feature (1)..(1): n is a, c, g, or t
ntggtggtgccagatccgtctccctctgtcttcgtcgtcctcgtgctggggttgttttgttgttccttcccgtccgtgaggtggtaggttttcctcttcctttgcggcacacatttgtcggtgggtgaatgattgctgcggtggtctgtcaccgcggggagctcgtcgactctctctgctcgcgttcgcttcgtagtatgatgtgttgcactccgccccccccctttcgtcgtgggttccgcgccaccgttttcttatttgtctctcccctctcgggtgtggtcctccccctccttctctagtgagggggtggctgctctatgttttgtgtccccccccggtgcccccctttttttggtggggtattttccttggagtgtgcccctccccctccccctctctcctcggtgagtgtgtttctgtccgccgcgattcgagttatgatgtaattggcgtgccctctcttgttgttgtgggagggcttgttgtgcgccatcaactcgcgtgcgccgctggtcgcgttggttacgtcctcgtgatggggcgccctgcctctttgttgtggtcgcccgtacacctctccctcccgctgctccccctcatcgttgtggttccccccgtcgctccccttcttccttttgggagtgggctttcgtgcgcacccaataggtggagagtgaggagtggtttgtgtggctccccccgcctcctcagcggagtgcccttgtgatgtgggctcaccactccgcgggggggtggcgcctgcacaatgagtggccgctgtggatctcccacccccgagtagggttgctacttatagttggtagcaccgcaccgcttctattcttgtgcccgataggaagctctactatgtggcggtgtcgcccccgccccgctcggtcgtataggtagatcagcgcggggagctacttcgcctcgcccctctccccatcgtagttgagagtagaataaatgggagcgccacgcgcgctcctcgcgagaaagaaacttcctcctctacgagagagaggagcgccctcggagagagagcccaatctcctctcgtagagagtacttctctctgtcgcgaggtggtggtgtgatacgcccgcctctcatcgcgccgctctctgtcgcctctcatcagcgctgctctgagatatgatatatcttcgccgcgctctcatgagcggcggggggagcatagggagggcgccgccaccctctctcgctctctctcttgtggcgcgcccccacggagacacactctctgcgcgctcctctgtgtgcgctgtgcgctctctccatcaatgtgcgcgcgccgcacactgtctctctattagagaggcgcgcgctcgcgcgccctctctccccctcgaggggtgtctcttttgggcgctcacggctctctcgtacgcacacaccacgcgagacaccacgcgaagagcccctctctctcgggcgtataccccgcagaggcctcatagtgtcttctctcctctcggtgtcccccacaggtggggtgtggagggggagcttcctgtttctgggtgtgttcctctctttcccctctctttaccactcccccccctcccctctattcccctctccccctcgttctccccctctcacgggctttcttcccctctgtggttttgttaaagccccacctaagaaaaaaaatggcctctgtgggtttttccacaca

SEQ ID NO: 597509 - DNA, 261 bp, Homo sapiens
  misc_feature (59)..(59): n is a, c, g, or t
  misc_feature (76)..(76): n is a, c, g, or t
  misc_feature (144)..(144): n is a, c, g, or t
  misc_feature (252)..(252): n is a, c, g, or t
ctgtttctagcaacgtgctgttcctgctggacttccacagtcacctgacacggagtagngtcgtgggttacctggngggccgctgggacgtcaacagccagatgctgacggtgctcagagccttcccttgtcggagccggctcngggacgcagagactgcagctgccatcgaagaggagatctaccagagcctgttcctgcggggcctgtccctgggtgggctggtaccacagccacccacacagcccggcnctggccatg

SEQ ID NO: 597510 - DNA, 164 bp, Homo sapiens
ggaatcaggcttacggaacaatcattgaaccaagcagtggaggttgcagtgagccgagactgcaccactgcagtccagcctgggcaacaagagggaaactccatttaaaaaacaaaaaacaaggccaggcacagtggctcattgcctgtaatcccagtacatac

SEQ ID NO: 597511 - DNA, 486 bp, Homo sapiens
aatttgagaagtgctgctgtaattccccttaaaggacgggagaaagggccccggccatcttgcagcaggagggattctggtcagctataaaggaggactttccatctgggagaggcagaatctatatactgaagggctagtggcactgccaggggaagggagtgcgtaggcttccagtgatggttggggacaatcctgcccaaaggcagggcagtggatggaataactccttgtggcattctgaagtgtgtgccaggctctggactaggtgctaggtttccagggaggagccaaacacgggccttgctcttgtggagcttagaggttggtggggaagaaaataggcatgcaccaaggaatcgtacaaacacatatataactacaaaaggatggtgccaagggcaggtgaccactggcatctatgcttagctatgaaagtgaataaagcagaataaaaataaaatactttctctcaggaaaaaaaaa

SEQ ID NO: 597512 - DNA, 753 bp, Homo sapiens
acacacacatacacacacacacacacacacacctgaggccaccagaagacacttccatccctcgggcccagcagtacacacttggtttccagagctcccagtggacatgtcagagacaacacttcccagcatctgagaccaaactgcagaggggagccttctggagaagctgctgggatcggaccagccactgtggcagatgggagccaagcttgaggactgctggtgacctgggaagaaaccttcttcccatcctgttcagcactcccagctgtgtgactttatcgttggagagtattgttacccttccaggatacatatcagggttaacctgactttgaaaactgcttaaaggtttatttcaaattaaaacaaaaaaatcaacgacagcagtagacacaggcaccacattcctttgcagggtgtgagggtttggcgaggtatgcgtaggagcaagaagggacagggaatttcaagagaccccaaatagcctgctcagtagagggtcatgcagacaaggaagaaaacttaggggctgctctgacggtggtaaacaggctgtctatatccttgctcttgtggagcttagaggttggtggggaagaaaataggcatgcaccaaggaatcgtacaaacacatatataactacaaaaggatggtgccaagggcaggtgaccactggcatctatgcttagctatgaaagtgaataaagcagaataaaaataaaatactttctctcaggaaaaaaaaa

SEQ ID NO: 597513 - DNA, 197 bp, Homo sapiens
gggaatcctctcaagaggacagtcattttgtgaaggttcaattcagctgttagcatggactttcagaacctattgtagaaatgagagacagaaatgtctccagaagatcatgggagcacaaagaggaataagtgaagcagacccaggggtggttccttgggagatggaagcccgcagagaaagtcccataaatgatg

SEQ ID NO: 597514 - DNA, 137 bp, Homo sapiens
tggatccctatatagtagagatgtgatcacatgttggcaggtagtcttgaactccagactcaggtgatccactgcttggctcccacagtgctgggattataggcgtgaggcaccgtgcctgaatagcgtcgtcgaag

SEQ ID NO: 597515 - DNA, 288 bp, Homo sapiens
gaagtcctaatgagagcagtctaggcaagggaaagaaataaaaggcatccaaattggaaaagaggtagtcaaattatccctctttgttttcttttttttttgaatttaaaaaaaaatttgtagagatgggatctcccaatgttgcccaggctggtctcgaactcctggacccaagcagtcctccctcagcctcccaaagtgctgagattacagatgtgagccactgtgcctggcctgtttttctttgcagacgatgtgatcttatatgtagaaaaacctagactccac

SEQ ID NO: 597516 - DNA, 1019 bp, Homo sapiens
tggcgcctgaggtctgttgcctgacctccgctgctaaagccgctgctgccggctggaagacgatcctccagtaccctgcccgccgtcaccttgcagctgccgtgtctcctcccacccctagccgcaccccctcgcggagggatcagctgagctggccaaactgtgacggtcgggggagccccgagtccgcagctgcagcggggcctgagaccagagttggctgagggcaattgaaggagcggcccctgtggcagtggggtgctgggggcctgggcggggccctgagaacagcccgaatttggcctgagctgctgcctgagcgagtccgaggcgctgggccaggccggagccggactacgggagccgaggcgggcctgcgcggtgggcgcggagaggagcggagcggcggcgggcaggccgggcgggtggcggcaggcacgcggaggaggccgcagctgcgggtccgaggagcgtaaggcgacagcgaggcctatgcgtgacgttggtggcctggtgttggcctggtggatcccgggtgcccccgacggcagggctgtgacaagcggtcgggcagtgcgtgctggtcagggatgatccaaggcgtgtatctcggcgttgaagtcaagtcaccgaaatgaagcgaggtcgacggaagtttcgtgacagtggctgtctacctatatgggtccccgcccatccacaaagtaaaaggtgcgggttcggtcgggcgacaggtttggtgggcattccaggagatcggacgcatttaaacgggcagcgctaggaaaccctttggccccacgacccggttggtgaataattcacagcctttctatcaagagattccagacaacgggaaccttaccgtccaaagattacgaaggcgcttgggtccaatccttggtcccttgattcaaagggggcatctcataccagagaaggtggcgaaacgttctcggtgctgcagcgcttatagaggggtggccacagggtttaaccccgggttttattccgcccca

SEQ ID NO: 597517 - DNA, 318 bp, Homo sapiens
  misc_feature (27)..(27): n is a, c, g, or t
  misc_feature (30)..(30): n is a, c, g, or t
  misc_feature (196)..(196): n is a, c, g, or t
  misc_feature (210)..(210): n is a, c, g, or t
  misc_feature (216)..(216): n is a, c, g, or t
  misc_feature (264)..(264): n is a, c, g, or t
  misc_feature (293)..(293): n is a, c, g, or t
  misc_feature (316)..(316): n is a, c, g, or t
ggcccaagatggcggccacggttaccngtntttcttaagctctgtgaggaatggccagtggacgagaccaaacggggccgggacttgggcgcttacctgcgacacgggtagcacaaggcctttcgggagggagagaatacccaggttgcagaccttgagcctgtgatcagatgtacgagagcttatcgcgactccnttcaaactactacnaacacnagtaccctcgccccagagacaccagcttcagtggcctgtcgttggaangagtacaagcctgatcctgtccacaaganacccttggaaagagctttaaggnaa

SEQ ID NO: 597518 - DNA, 132 bp, Homo sapiens
cattctgcacgccgaatgataactaccactggcaatcactgtaagccaggaaaatgacaagatcaaacgtgtaacatatgtaaaacacttgtaacatatgttgcaacatatgtaaaacatttcagaaacggg

SEQ ID NO: 597519 - DNA, 161 bp, Homo sapiens
tctgaggttacccacatacgcaccacgctaacagcgctcgcgagccgcacgggaccggcttctccgcagcactccaactctgcctgaacagggcgctcccgggcaagacaaggttttgaggacttgcggcagtgggacgagcacaatttctatctgtcttc

SEQ ID NO: 597520 - DNA, 124 bp, Homo sapiens
taccacagcctttgaggcagcttcagcatgtggtgtactttgcagaattccagtgagctacgtgaagctcgtggcagaatattttgactccatacccactgtgatgttctagagaccctgctca

SEQ ID NO: 597521 - DNA, 291 bp, Homo sapiens
  misc_feature (71)..(71): n is a, c, g, or t
aatcacttaattcgtcgggggagtggggaggcttgagggggagaaagaatttcctgaattgtaacaatganatgtgacaattaagctgcaacccggatgatgaggagaaatcaaccaaaggggatggaggccttctagacagggtgaccagcatgtgccaaggccctgaggcatgaaagcccagtacattcaagaattgaaaggaaatcaacgaagatgaaatgaccatagtaaaggaaaccagagtagaggccgcgaatttaagtgatcaccgacgaatgtaagtgatcg

SEQ ID NO: 597522 - DNA, 104 bp, Homo sapiens
gccccggttaagtttagggccaaccaattttcagaaatctctgtaggacaccgctatactaatactttcgtctcgtgttatattctccgtgtcaccatgtggtg

SEQ ID NO: 597523 - DNA, 593 bp, Homo sapiens
cggcacgaggagagagagagagagagagagagagagagagagcgatcctgacgattgcccaaataaactatatactgtgtgtccctatgtacctgatacttctttcaaaatgctacggactgtcaatggggaagagatctaattgttgattgataccattcataaatttctacactttctatcagtaactggtcatttatcctattttgatgctttacaagtcttctgacaggaagtccactggtttacaccctgaataaatacgttgtggttctgcctgagccctttttggtgcccttggagacctttgcactgtttttacattgttgttagggcttatgaaggattctttttagagcttacctcgtgaatgtggaccgctttggttttataatactaaagcttccgtcacctttccaatgttttaccgcgcatatgtcgtttaatatttatctatacgattacctccctgtatggtggactctgtcgttgcgacattaaacaatattttctatactggtctttaaaccaaggtttctatcatcaacatttgtgtggagcttgactaagcgttatcgttctctgtgtaagcg

SEQ ID NO: 597524 - DNA, 947 bp, Homo sapiens
  misc_feature (55)..(55): n is a, c, g, or t
  misc_feature (73)..(73): n is a, c, g, or t
  misc_feature (76)..(76): n is a, c, g, or t
  misc_feature (106)..(106): n is a, c, g, or t
  misc_feature (168)..(168): n is a, c, g, or t
  misc_feature (198)..(198): n is a, c, g, or t
  misc_feature (227)..(227): n is a, c, g, or t
  misc_feature (266)..(266): n is a, c, g, or t
  misc_feature (302)..(302): n is a, c, g, or t
  misc_feature (376)..(376): n is a, c, g, or t
  misc_feature (392)..(392): n is a, c, g, or t
  misc_feature (410)..(410): n is a, c, g, or t
  misc_feature (414)..(414): n is a, c, g, or t
  misc_feature (443)..(443): n is a, c, g, or t
  misc_feature (447)..(447): n is a, c, g, or t
  misc_feature (450)..(450): n is a, c, g, or t
  misc_feature (465)..(465): n is a, c, g, or t
  misc_feature (549)..(549): n is a, c, g, or t
  misc_feature (584)..(584): n is a, c, g, or t
  misc_feature (599)..(599): n is a, c, g, or t
  misc_feature (626)..(626): n is a, c, g, or t
  misc_feature (652)..(652): n is a, c, g, or t
  misc_feature (677)..(677): n is a, c, g, or t
  misc_feature (702)..(702): n is a, c, g, or t
  misc_feature (708)..(708): n is a, c, g, or t
  misc_feature (731)..(731): n is a, c, g, or t
  misc_feature (747)..(747): n is a, c, g, or t
  misc_feature (756)..(756): n is a, c, g, or t
  misc_feature (768)..(768): n is a, c, g, or t
  misc_feature (783)..(783): n is a, c, g, or t
  misc_feature (785)..(785): n is a, c, g, or t
  misc_feature (789)..(789): n is a, c, g, or t
  misc_feature (797)..(797): n is a, c, g, or t
  misc_feature (801)..(801): n is a, c, g, or t
  misc_feature (807)..(807): n is a, c, g, or t
  misc_feature (815)..(815): n is a, c, g, or t
  misc_feature (870)..(870): n is a, c, g, or t
  misc_feature (944)..(944): n is a, c, g, or t
ttcaggtcctggtgctgtcaggttggtccgggcccctcggtccgctacatctggncctcccaggctggtagtnttnggtaacggccccccgcccacgttcccagcngcgcccccgtggctcctccggggtgcggccagtccggaagccgggggaccccggtagaagtngggctcagctcccctcccgaggggacaggngggccggccgctcccaccctgggcccgtncaccgagccccgagttacgtgagttgcggtggggcagcncctcttctctgaagcacgtgaaaacccagaacaganatggggagggagaaaaagccaaaacgaaacaaccagaggagacggggaccagcacaaaacctccgtgaggagtntgttgtctaaggagcnacgggtccggccctagtnaggnaaactcggcaagtttattctggtggtgtnaggnctnctccgtgccagagtnatcctcatcgtccccgaagcagctgttggcctcctcctccacctcgccgtcctcgtagtagttgtcgtagaagaggtctgagcnctcgtcgggcgccggcgccttggtcttcacgcatncttggccagcgtggngggcaccttcacgccgtcacgctccgntccaccttggtcccaggacctgcttncggatgatgtttgttttctcccganccttccccttgctctctttccactncctgtncatcacggaggcgtccacgtttncgggcgagaaggtgtngggctcgtncaggagggagancacactcaggagatngncctnacgttctncgtnggggtncacctctnttagggcagcccccgctctgggggtcgtcaccggcgggtggaggatggagaaaanacgtccccgtctcgtagatgtgagggtgcaaaacttggtcaggaccgaaagctggggagagtctgggtagtganggg

SEQ ID NO: 597525 - DNA, 447 bp, Homo sapiens
tcgctactgcagcttgacatcaggcagtcctcctgctcagtccttcccaagtagctgggcacacatacgcatgacagcgtgcctgggtaattttttaaaaagtgattgtagagatgaggcttgtcatgttccccaaggccggcgtcaaactcctggctcaatagatcctcctgccttggcctcccaagtagctgggactacaggtgcccaacatcacgcccggctagtaatcagtatttttagtcgagacagaggtttcgtctattggaactcatgatctcaagtggtcccacccaactcgggctcccaaagtgctaggataataggtgggaagccacgtgtgcctggcctcagcctgatttctacagtatatcacaacttgggggccagcattagccaccagagaccattttggaatgtctggagaccattcggttgtcagaactg

SEQ ID NO: 597526 - DNA, 163 bp, Homo sapiens
cccaatggactcatcgctctgcccaaatcatctgccatgtggaaaagacttcctacattgtgtctctggaactagggaaggagttgttgagttgctccatcacctcctctaaccctgtgcttgtgtcctggggaggactgagaagatcttcctcacccatgga

SEQ ID NO: 597527 - DNA, 352 bp, Homo sapiens
ccgaggaccagctcggtctagggagaccctaacctagcggtgctagaggaattaaagacatagacacagaaatatagaggtgtgaagtgggaaatcaggggtctcacagccttcagagctcagccacaaacagagatttacccacgtatttattaacagcaagccagtcattagcattgtttctatagatattaaattaactaacagtatcccttatgggaaacgagggatgggccgaattaaaggataggttgggctagttacttcagcaggagcatgtccttaggcacagatcactcatgctattgtttgtggttagatgccttagcgttccaccggcagcagggtctgc

SEQ ID NO: 597528 - DNA, 297 bp, Homo sapiens
tctgaaggcaaagtctcgctctgtggcccaggttgaagtgcaggggtgcaatctcggttcatggcaacctccgcttcccagtttcaattgtatgtccccgggtagcgggaaacattcatttcagagatgattgggattatttgactgtcatttgtgaggaggaaaaattaaccctttttaaaaaaattgacacctaccatttattggaatccccttttacagggcattgtggttaagtatcttcagaaaccattcacatttttttacctctcagagtaggttttttagaggcaagga

SEQ ID NO: 597529 - DNA, 289 bp, Homo sapiens
gaagtcccatgactggccatctgcaagctggagacaccgggatactggtagggtttctcagtccaagtccaaaagcctcagagccagggaagcctttagagtaattctcagtcaaatgccaaagacctaaggacctgggaggggttcactggagtaaatcctgggagtcccaagtccagagagcctgggagtcccaagtccagagagcctgggagttcttgatgtccaaaggcaggaggagaagagtatccttagctccagggaggagagaggaaagtttttttttcct

SEQ ID NO: 597530 - DNA, 402 bp, Homo sapiens
  misc_feature (14)..(14): n is a, c, g, or t
  misc_feature (106)..(106): n is a, c, g, or t
atatcggcacaggngaaaagattaagcctccacctagagttttatttttattttttgggatggagtcttgctctgtcacccagactggagtgcagtggcatgcaancctccacctccatgggttcaagcgattctcatgcctcagcctcgagtagctgggcctacaagcacatgccaccacgcctggctaatttttctattatttttaatagagctggggtttcaccatgttggccagactggactcgagttcctgacctcaggtaatccacctgcctcagcctaccaaaatgtgggtattaaaagtgtgagccaccacgcccagccccagaaataagagtttagaacgtctgatagaaataaatttcatgtagaaataaaattttgttaaggagatttgct

SEQ ID NO: 597531 - DNA, 94 bp, Homo sapiens
cccccccccccccccccccttttttaaccagggtttcttgggccggggaaatttttccgtctttggtatttttaaacttttaaattaattggga

SEQ ID NO: 597532 - DNA, 116 bp, Homo sapiens
cctttctttttcttttaaaggcggttggttttgtttttcccccctttggccgggctcctggcccctgtacctttggactctcctatcgggggtttaaaaaaaaaagtaaattgcca

SEQ ID NO: 597533 - DNA, 334 bp, Homo sapiens
tcttcagtgcatgagcaagcagaaagcaatctcaccagagaagagccactggttgggtgaagaatggtactctctttgataacagatggagaggcagagcatgtgggtgtccatgctggtcctagtggtgatgggagtcggagcacatgagcggaacatcacagaagccaggatatcagctgaaagtcatggtggggggcaacagcacatgtaggatgtcacaagcaagggaaggattcaattcaaggcttcagcatccttctctgtctatatcagtatcatggtagacactcaacatgattttctcatctgtatcatgctgacatgcatcact

SEQ ID NO: 597534 - DNA, 685 bp, Homo sapiens
agcggagtatctgtgggtacccggagcacggatatctcgccggctatacgtgcacctcggtgtctgcgagaacctccggcttgcctctcctaggcgacgaagacccagtggctagaagtgcaccatgtctatgctcaagatccatgccaggctagatcttggactctcgcgggaatcccactgtcgaggattgagtctcttcatcctcgaaagggtctcttcagagtctgcctggtggcccagtgggttgcttcaactggtatctatgaggtcctagagctccggtgacaactgataagagtcgctactctggggaaggggtgtgtcgaaggcctgcttagagcacatttgaatgttaaaactatgtgcgcctgccctggttagcaagaaactgaacggtctcagaacaagagaagattgacaaactgagtgatctgagagtggactggaagcagacaaataaatctaagctcttgggtgcgaaacgccacttctgggggtgtcccttggccgtctgtcaaagcattggtgccgattgagaagggggtccccctgtaaccgccaacatcgctgacttggtggcaaactctgaagctcatcctggccacgtcggcgtggcgttcaatgtcatcgaatggcggttgctcatgcatgtgcaatccagtctgcgcattgcaggagttca

SEQ ID NO: 597535 - DNA, 342 bp, Homo sapiens
tgataaaaaataaaagagttacatgacattcagagaccatccaaaaaacctgtgggttcccggctgggctcagtcgtcacgcctgtgatcccagcactttgggaggccaaagtgggtggatcgcttgacgtcaggagtttgagaccagcttggacaacgtggtgaaaccccgtctctactaaagatacaaaaaattggccgggcgtggtggtgggtgcctgtagtcgcagctactcgggagagggagctggagaatcacttgaactcatggtgcgcaggttgcagggagccaggtattcaccattgtgctccagtctgggcagcgagcaaaactccatctca

SEQ ID NO: 597536 - DNA, 721 bp, Homo sapiens
  misc_feature (192)..(192): n is a, c, g, or t
  misc_feature (443)..(443): n is a, c, g, or t
taacgatttacactctgtaataggctttgtagagtagatcgattattcttgagctaagcatatctaactgcctcatcatgataggactaccagtaaattataaattccaaaggttagaagatagttttcccacccctttaaattgggtggcagcaaactattacccataacccaatttcaaccccaccccanaaatatttgctatcggccttttcaagaaaaagtttgctgaaggtgtttgaatttcggacagatggtttccaatggaaccagggaagatttaaatttgctcccttaatagattcaaaatccattattcttttgataatatcatccacttggaaaacaaataagttatattaaccaaagccttccatccttaaatgtttaggaccagcaaaccaatcatatataaaagcagtatatttctaagaaaaaaaaancaataaatgaacaatttaaattacattttaagtaccaatttcagagatcttcagagaatgcaggcagttaaaggacagatctcaaaaatccatatagcagatttctggtttccaaatttctgggatacagtatttaacacagtatttgaaactctacaattgctacggaagcgacattgtggagagttacatattatccaaaaacacatttttcacaagtaagatattttaaaataagaaaccaaccaaaaaagaatggccaacaatctaaatctttt

SEQ ID NO: 597537 - DNA, 875 bp, Homo sapiens
ggacgagccaaccaataacctggacatacgagtctattcgatgctctaggggaggccatcaatgaatacaagggtgctgtgactcgatatgatcagccatgatgcccgactcatcacagaaaccaattgccagctgatgggtggtggaggagcagacgtgttagccaaatcgactggtgcactttgacagactacaagacggagacaggtgtaagagaggccctgggctaaagtcatggatcagccggaccccgaagagtgacagctcttccttcccagcaagtctcccgagagacatattctcgtagtggcctacgaagtccatctgtggatctcccctcctctgaagacatgcctctggcctcgcagctgacctggcaaaccattccacggcacaatgacaggtggacagtggtgaacctatcgcatgatgacccgaggcatccgcaactctgactctgagcaattcacaatatacaatactgaaatacgactcagcaagcggatacaagactatccatcgtggcaatgatacaccctcgacgccctgcggcaccttcatccgctatgctacaattaccaccataaaaagcgaaaaccaaaagcacggttgcacccacacctaccatacggatcgaaccgatatcacaatcccagagccggaaagtcacacatcgcataagacccctacaactacggccatcccacgcggacatacttccagttcacagtggtccggaacagaccactttgcgcctatccttgcagtatataaccacgcctaagactcatcatttcccaagcgggccccaactctttgtcacgtccgcccaaggtaactattctagaagaccgagcatgagaatagataccat

SEQ ID NO: 597538 - DNA, 775 bp, Homo sapiens
  misc_feature (687)..(687): n is a, c, g, or t
ctcgggggaagtaggcgatcctcccccccagtgcgtgtggtctcctgttcttctcgcggaggcgtgtgtgttgacctcttcgtggaagatagcgcctttctttgtgcgaggtaattgattggttctctgcgagcatgggggcttttccctatggagcggtgtctctctctcccgcgctcttcggcacgcctcccacaggggcaagctcccccccgtcacgtgcgtggatgtctgccccccgttacgtgttggacccccgcgagggctccctcctctcactctgagcgcgatcttgtagagggcactcgcttttcccttttgtgctttcattctcttcttgaaactcttctctatgattgttgaataacacacacttgcccctcacaaccagtactccgcgttgtgaaggtacacccacgctctttctagttcgattctctctttgtgggtacaaacacagtttactcgccgcacacacgactttagccctcctttggcgtaccttttaaataagaaccaccccgtaatacccctgtgtctggacagctccaccttctctttctattcagatatgctcttccccctcatggagctacaacttatattcccccgtacggcgcacactgatatacagagatagtttaattgtactctgtcaccacacttaaagataatgtcgtgataccncccacggacgccaccccataccgtaagagaccaaaatatcctttccaataaacaacgtacaagttaaacaaactcatcaataaacgca

SEQ ID NO: 597539 - DNA, 264 bp, Homo sapiens
tcacacgctactctggtattgtgtgctctgaggggatattgcagcttaagtcccagagaaaagcgtgagaggagaaacatttggaggagaaaacgggatatgataaatcgggccagagaatagtgctaggtcatttagcaagtccattcttctgttcctgtagattgcgatgcaccttcccttccaggatgggattcacaatgggcccttggtgtctggaagcaccaactgaacgcaggccttggatgatgaagactgtgccca

SEQ ID NO: 597540 - DNA, 106 bp, Homo sapiens
  misc_feature (2)..(2): n is a, c, g, or t
cnggtcgactctagaggacccgttggtgagtgacgacactgtccgctaccacaacgacctcaaggccccgctgctatgcgccaacgtcattgaccaaccaaggatg

SEQ ID NO: 597541 - DNA, 370 bp, Homo sapiens
  misc_feature (346)..(346): n is a, c, g, or t
gtgcaatcctggctcactgcagccgcgatgtcccaggctcaagtggtcctcccatctcagcttccttgtatttgggctcgcgggcatgtgccactatgcccagcttttttttggtagagatgggctctccctgtgttgctcagggtggtctcaaactcttgggctcaagcaatcctcccaccttggcctcccaaagtgctgggattgcaggcatgagccaccatgcctggccaattcatttcaatttaaaatgtagaccggacgcggtggctcacgcctgtagtcccagcacttgagaagccagagtgggtggatcgctgaggtcaggagttcgagaacgtcctgnccaacatggtgaaaccctgtctcc

SEQ ID NO: 597542 - DNA, 202 bp, Homo sapiens
gacctagaggatcccctggagattgggctgggatttgtggggagggagcatgagacagcatgggggcgtatggctttcttctcccactgacgaaaaggttgtaaggagaaggattatgatgtggagggtctgggagcagtctaaaaagtccttatcaagaggtgctatgaaaatacgtgtgatgtttatgaataaagggagc

SEQ ID NO: 597543 - DNA, 744 bp, Homo sapiens
tcgggactactatagcagatcatacagaggaggaggtggaggaggaggaggatggacagctgcccaacacaggcctctgatttatagaaggcggccaccttctccttactatagtcgcggcggatacagaccacgttccacatctcgatcatactcaccttgctgttggggaggcctgacgactttctgaaacctgccctagagctggcatattgtttgggggctgctccttttattgtctcttgtttaaaaggtgaacagcgcctactgaagttaggtgactcttacaccttctacgatgactactcctgctgggggcgaattgctgctctcattctgcctttccgttttctcgctgctttgttccaagctccgcgctgcgcgaaccgcctcttttgcgtgtttttggtactgcccttgttttgcccgctcagaagtccccattgcgcaaaccttgcctgtgtgggcttttttaccgggttccggcctcctccggcgaggcccccctcgtttccttgtcccgggattggcttccttctcgctccacagactgggttcctctgttcgcttcttcgtgccaatgggtggtcttcctctccccgtgggagcccgtaaggccccgaccaagcgtccccgcccttcagcccccgcgaccccccaacctatatactcgtccaacgtcctttgacccctccccgcaccccttctcgccctgccccccccagccacccgaaaaaaaaacaa

SEQ ID NO: 597544 - DNA, 710 bp, Homo sapiens
gatgacctgggcagccagccacatgaggaccgcgagccagtcgaccccaccaccaaaggccgcgtggcctccttctcgatacctggctcctcatcccgctactcgctgggccccagcctgcgccgtggggcacgaggtgagcgaacgtgtgcagagcagtgagatgggcacatccgtgctcatcatgctagcccatcctgcgctttctgcagctgctgtgtgagaaccataaccgggacctgcataaatgacatcggcagacggaagaacaaaaccaggtacaagtgggtatgggagacgctgcagttgctggacatgatgtgcggaagaaccacgggcggcctggggctagctggggctctacatcaatgaaggacaacgtgggcctcgtcatccaggagcttggagaccctcagctgagatactggccagggaaccccatgacaatgaggaaaccagaatatgcatagtgactcacagagatccaagtggacataagaccatcatcagccgaactgatccgtcaaatgacagtcgagcccactgtgcaagtaccgacatggatctgggtgctgaagatcaaggacaatgggctccaagctgctcctggctctgattggagagccggaaatgacagtgcacaatgctgagcgaatcctcatcagcctgaggccacaggagctgatggaagtcatcaagaaagcctacca

SEQ ID NO: 597545 - DNA, 206 bp, Homo sapiens
  misc_feature (198)..(198): n is a, c, g, or t
ccccgcggtcatgtcttacgtttcccatagggcattatacttactcaagctatctaacagatcttaaaatataggatattgtaataagtttttgattattctgattaattcattcgacgtatacttcaaatagcaatatcatctgctacatgttctgatgcttcaaaggattgattttgcattatactcgtagacatntccgcagt

SEQ ID NO: 597546 - DNA, 115 bp, Homo sapiens
tcgataagggccaatgggcaaagtggctctacttgtagtcccacctactcagaaggctgatacaggaggatccttttgagcctaatgaagtttcaaggctacgagtgagactgtg

SEQ ID NO: 597547 - DNA, 239 bp, Homo sapiens
tattcagaaagagccacaagccggatggaactggagagacggagctcaggactcgagtttaatgaggcgcgtcaaaaatacgcaggatcaaatgccatctcatctgacatgttctttgggcgcgacgtgaatgcggagtatgaagccaggtctcggctgctccatctctcaggtggctctgccttcagctcttcagacttctttgatgacctcttttgagctctatgcgtagccatcgt

SEQ ID NO: 597548 - DNA, 989 bp, Homo sapiens
gtcaggcggggatacagcctgtgaacggtaatcgcatgtccatggtacacaaattcacaagtttggagaccctgacacacgccatcgcttctcacctgtggctctgcgttatccccgcagcctagagggaagatgaagcctaaactgatgtaccaggagctgaaggtgcctgcagtaggagcccgcacaagtgagctgcccatgaatgagattgaggcgtggaacggctgcggaagaagaaatgcccgctgggtcctgcttggtcctcattctggcggttgtgggcttcggagcccattgatgactcagctgttcctagtgggcaatactggcgactatgcatctctttagggacccaacgcatgagccccagtccccctggctatgaccctatgcgaagctagttgcatggtggaaagcgattccctgaagtgggcctgtgatcttacacccaattgcgctcacactgtgaggaaccccgttctcacctatgcctagcgccattgggttggggcccgttgcgtctgccctggtagccgcacaagcaagcgcattggcactatctggccttccctttcttaactggtgcaccccttcgaacctaaagcacatgaaagacactcgacgaacggccaggaaggcccctactgaggccaagctaggggttgagcggagggtcccttccgggctagcatgctagaaccccttagggcaccgaagaggggcgctggaaaccggtcccgtcatttcggcctgatgaagcccaaaggcgccaagcctgagcggccccccaagcgcaacgcaggggcgggtacacttggccacgggcctccttagcctcgcacgaagacgggtagccccaagtggtccccgtcgatttgggccgcggaccaatgcaagacacgcgttgaccccagtgggcggtcccattggcattacccagaggttcttggaggtggtatggaccgaaggacccaggtctcgtaacc

SEQ ID NO: 597549 - DNA, 162 bp, Homo sapiens
gaagatgcatgtgtgacacatttaacattcaaatcaggccagcgcggtgctcatgcctgtcatcccagcactttgggaggccgaggcgggaggatcacttgagcccaggacttggagaccagtctgggcaacacagtgagaccccatctctacaaaaagtta

SEQ ID NO: 597550 - DNA, 433 bp, Homo sapiens
tgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccttctcatccttgatgtcatagttgagcgcacccaagtggcacccactggcggccaggggcacagcctggtggtggtggcaatagcaatgtgcccttcctgagctccttgctggttctggcacagcattgtccttaagcatgcatgcgagcaatcgtgttgaacggttcacagtatcaatgctgcacggtcatgcactctggtggtttgtctcctacagaactcttgtgtctatgattttctagcacccatgttttcgagcgtttgctttgtaaaa

SEQ ID NO: 597551 - DNA, 423 bp, Homo sapiens
ggaccgcttccaagactttgccctgattgatgccccaacgttggaggatgagccccaagaggggcagcagtgggaaatagccctgcccaacaactggcagcggtacccaaggacaaaggtggaggagaaggaggcttcggacacaggtggggaggaacctgagaaggaagaggaagacctgtactatgggctgccagatggagccggggacctcctcccggacaaggagctgggttttgagcctgacacccaaggctgagatgtttgtgctccgtagcttttagtctggaactgctgctgacccctgtgtgacatcacagggcctcagtttccctatttgcaaaatgggatgatatggaggttcaatgagatggtggcattttgagaatggtaaagaaatacccagggaggggatgatgccta

SEQ ID NO: 597552 - DNA, 338 bp, Homo sapiens
  misc_feature (222)..(222): n is a, c, g, or t
gcactctatcagcctggtgatagattggacctgtatcaaacaaaaaaaaacaaacctgcttctggattggcttctggttttttccatgacacacacatctttctatttgtctctggtctacatattaactatcttcccccaggatagtataaaaagtgtcaggaaagttgggctttggagttgtggtaaattctgtctttgttactttcctccccttcaggnggtttcttatttttaaagatgaatgcagtgaggtataatggtgtgtgcctgtagtcccagctattcaggagactgaagcaggaggatcacttgagcccaggaatttgaggctatag

SEQ ID NO: 597553 - DNA, 705 bp, Homo sapiens
  misc_feature (607)..(607): n is a, c, g, or t
acaggactcgctaagtgttcgctacgcggggttaccggatcgggctgaaatgccaaaggtggaggagacactgaagagactgcggagccagaagggagtgcagggaatcataggagcgaacacagaaggcattcccatcaggagcgccatggacaacggcagcaggacccagtatgacagccttatgcacagcttaatcctgaaggcacggatcaccgtgcgtgacattgagcttgagaacgatctcaccttccttagaatacgctccaagaaacatgaacttatggatgcaccagataaagactatgtgctgaacgtgattcagaatccataccgagtagccactctctaggctccatgagtcattgcttaatttaatgtgccgcaagaatgataatgtcaatgatgtcagtgaactatgacatggaagatggttggacccactcacagccatccagtgaccgtatgtggactggcggctttctacctgacaacggaaccactgcgtgacgcaccttcccagagatccgatcgccgtatctcactccagagttggagcacgagctttgagatgccgactcagctacttcgacttaagtcacttgtngcgttgagacgctggatctgtagctaaatgacaactgcgaatattaataaatcctctttaactggggcgcttggccatgattttttaggcttctgcgc

SEQ ID NO: 597554 - DNA, 539 bp, Homo sapiens
gcagtgcagcagtcgtgctgcatgtcgatctaacgatcgccccccgacgtgttcactttaacctttagtaaagaaaaaggaaagtcaggacgcggatggctcacaatctggaaatcccaggcactttgagcagtgccaacgcaggcagatcatgaagtctcgagattgagaataccctggccaacagtgaaaccccatctctactaaaaatacaaaaattaccagggtatggtggtgagcacctgtagtcccagctattcaggaggatgaggcaggagaatcccttgaacctgggaggtggaagttgtggtgagccgagatcgagagccactgcactccaacctggcaacagagcgagactccatctcaaaaaaaaaaaaagaaaagaaaaataatttgcccaaggtcacacagtaaaagacagaggtagggttcctgctcattgtgattctaaacagttgtccacaaaatcaaagttaaggtaaaatactctctcagaaggccccgtaagggcaggtggcactttttctttgaagcca

SEQ ID NO: 597555 - DNA, 759 bp, Homo sapiens
tttaattttttttttttatattaaacagttaatttcagtaacatggtagggcaacaatataatcctcagataagtcagcaaaccagtgacaagaaatggacaaccactccttctacaggcttccgggagacaggcaggctgggcttggtgggcccccggggtgggtaacatcttaaggaatcctatcatggtttggtgttatattatgctaaactggtgaaaaacaaaccacttcatggcagacaatcattcttaggtcaaacacaagcaacgacactatttaggaaatcaattcctcacaacattttatcccggaattatagcagtactggtgactactaacatctaattctggtgagaaatataatggcattggtaagcggacttggtgaagagcttggaaaagacccttttagaaattatttaaatggatcactcttataacaacattttattaaatctcagaatctactaatgtgacagacaaagggtatgcttaacagagtctctacactacggggtataatggctagaccatttcgggcatttaaatgacctcccagaatattacaccaagccccggagaactagtgagcgtcttactacggaccgggtaaaatacccaaagctacaaaagggtaaagaaacccaaacaacagacaggagtacccgggaaaaaccctaagagcactggcaagacgaccaataaaaacggaaagagaaagggacctcccaaagggggaatcacgggacccaata

SEQ ID NO: 597556 - DNA, 1768 bp, Homo sapiens
gctgatatgaaacattggcccatttatggtgtgtgaatgatgctggcagtgcccaatggctccaagctagaatacaagggagagaccaaaagcttctatccagatggcaggtgtccttctactggttctgcacacaatgatgcaaggcaacattgccagcacagcctcaccatggcgaagactagttcaccaatgccttgtggtcacagatgcccagcattcacttctcacactgacctctccagcgtccaggcaacccacaatgactgcctggacacctactctgactggctcctcaactgctaccatctacgacactcacttacactgaccgccaaaacatgcatgcctcgctattccggcctctatcgggccttacgcaccaacacacatggcttcgcgcacgccccgacacgcggacacaccgctgcctaccaaattcctcttgcaacccctgccgcgacaacgactgaggccaacatatctccggacctgctcgcttcaccacctcccattccaccttcaattggcaagcgccactggccaaactccttatgcacacgcgctcccaaacggctcctcaacaagcgccattgcgcaagcaacacaaccacccaccactctggggcgtcgggccgcaacaaggccaatccccggcaaccacatcccccgtcacacactgtcgcctacacacccccacctccttccaactcactgcgcccttacccagactcttctcaccacgccggcccacacgtccacctcccagtcgacacatgtcaaccacttcccacacacgccactacaaacccaccagcacgacagactcgtgatccacattaaacgcgatcctccagcctaccacacgcgccactcatgcacatgagaccaccgttccagacaatacacgacccacgtcacaacccccactcacatcccaccaccacccaataacaactcaccacagcgacaccatcgccacacctctccgcaagcaaaatcctcgtagaccatcccatcactccatccactttcacatgcgacccacctctactactcattccatatatatacaccataaccacaactaacagtccacagtctgccactcctgacactactgtccacctaaaacctttagcactcttgccttcagcacccttcgctctctctgcttctcgcaaccaccattcacacccccatccctactcactcataactcgacccccattcctgtcacattgcctccacacattccaactccactctctccccccgaacatctccacttcatacaatttagcgtcacctgcgcatagcaacagagtaacatatcctaccattcatctctcaacacctaaaattcctcaacagtttatttccacacatagacatttcttcaactcggcaccaataacccttactactaatacaaccaactctctatcataaccaactcctaagccactttgtaacacacctatcaccatcaccacactcaccatccagcacacaccactccaccactccactaccaagactctctttatctccccaccaccccccctctcagtcaccctccatagtcacgactacactacctactccccctcttcaccccaatccacaccaccaacccacacagccaccgcctctcatccactaccacactccaccctcaccgtactactacccctcccccacctcctcactctccttctttcttccaccactcacactgcgtcacctccccacctccacacccagc

SEQ ID NO: 597557 - DNA, 253 bp, Homo sapiens
  misc_feature (3)..(3): n is a, c, g, or t
agnaccctagctggatacaggcatgcaccaccacgcccagctcatttttgtatttttagaggagcaggaaaaggcattcgaggttgcaggtattagccgggcacggtggttcacgcctgtaatcccagcaatttgggaggccaaggcgggtggatcacttgaggtcaggagttcgagaccagcctggccaacatggtgaaactccatctctaccaaaaatacaaaaattagctgggcgtcatggtgggtgcct

SEQ ID NO: 597558 - DNA, 934 bp, Homo sapiens
tactaatttctctcacgggcgtggaaatgtattctgttaaaagaattgtgttgccacaggggggttgtagtgaagccgctgcctctgtgatgcttataaacgtgtaccacgtggggcacgtgggagagttttggataactcccccggtgaggcccacaatagtgttgggggttctccaccgcgggtctcacagaatatttgggcacataccccaacttgagtgttgagagagcgtgtcacaccggtggaagattggtgccccaagaggctgttaccctcagtgggggtggaaactgtaggcgttttcggtgtctgggtgtgtgtcgctgtgtttggggtttgtttatgactgtaaatatatatagcgctctacacatatctaagatattatcccggtaagagccctctcttgtataggctttcacggcgcgcctctacctacaggtgcgctcgcgcgcatattttccgcggaataataaaagtagtgatgtggaaattccactgtgagctcccgagagaaggggggcacagagccacaagggaacgcttgagaaagaaagtgggtgccaataaatgtggaggttccacgagcacgcacctgggaataaagaacactgaggaataaagggtgtgccacaagtcgtgatgtgtatatcctgctctgccactagatagtgtttgtcgcttagaataagattaataatggctgtaagaagacccacagatttgatattgggagaaggctgtcactggagagctttcactggtgaaagccacgctagatttctgggaaaacccctcggggatcgcaaacacacgcgtgtctaaaattgatacgtagactgatggatatgagaccccccctccctagaatctgggtttaagttccagacttcctaagtaagtggcccaattaataagtgctatttgggaa

SEQ ID NO: 597559 - DNA, 942 bp, Homo sapiens
cgcggtggctcacgcctggaatcccagcaccttgggaggccgaggcgggcagatcacttgaagtcaggagttcgagaccagcctgtcaacatggtgaaaccccctttctagctaaaaacacaaaaattagccagatgtggtggcactcacctgtaatcccagctaccaggaggctgaggcaggagaatcgcttgaacccgggaggcagaggctgcatgagctgagattgcaccactgcactccagcctgggcgacagaacgagataccatctcaaaaaaaaaagggaaaataattcctactcattcccaaaccctttcctaagaggtgagcctctctctctctctctctagaggctctgaattcggggctaccccaagctcagagggagtcctggcgtgctctccgtggtacacaaacacctaaaatgaccagtgttcctccaatttatctccattctatatctctatctatctatctatctatattttttggagacggggtccattcgtggatccagaataattctacaagtgcaaagagagcttcccaaagaggacaagccacctagagcggacatggtcctcgtgtccatgaagaaccaggagttacacttgaaaagtccggtgatgggaaaatcagaaatacgcattagtggaccagcaggggccggggcatcatgcctggtaatcccaacactttgggaatgccaggtggggggatcaccggagggcacgggagtcggagaccacgctggcaaaatggtgacacgtccatcttctctagactcacatgtcgcgggatgtgggagcgcgggtaaaccagtactgggcaggcgagagaaacatgaccgggagagatggagacacaaggcatgactctcgcgcaagagaagaccgggcgaaaaaaaagacaaatggcgcgcccagaataacacacggggg

SEQ ID NO: 597560 - DNA, 282 bp, Homo sapiens
  misc_feature (224)..(224): n is a, c, g, or t
  misc_feature (242)..(242): n is a, c, g, or t
ctccagcaggttaggtgtagttaacttatttctcctgagggcagaccttgttaggaagaacagaatgctgtggcatatttaaaaatggttccttttctcttctccctgctggaggcatgagggaatttttctcctatatatactgtaaaaaactagttgaactcctggagataaaactcacaaaagcatgacttctgtctaatattttctgtaaatttcagggnacatacctatgactaggnacccctgaagttttaaagtattgggcttgttgacacctag

SEQ ID NO: 597561 - DNA, 505 bp, Homo sapiens
gatctgtttgtaatacaaggtatttgggcttgtctttaactgtatagtgatttgtgggcaggctgcaggagccaggataaagaatgcatgtttgaaatcttctctatacaaatgcatccacactctccttcaaagggatgagtttcttagccgttttcacttgatacaaatgctattgtttcctttggaaggagagaaaaaaagaaagctccacctgctccgtgagtagcattgctctcaactggtgttcccagccgttcacatgtctacccattctctcccttagctttcttaggcgccggaggatgaattatttacaaaataaaaagcctgtaggtttaaggaagaattgctttgccccatatatgtgaccatgctcagatggaacaatgttcactgccccagcactgagaataggacatttccttgctgtagaaatgtcctttgttgttttgccagctttagcagcattatgctgcaggtataggattcttaaaaaaaaaaa

SEQ ID NO: 597562 - DNA, 671 bp, Homo sapiens
  misc_feature (671)..(671): n is a, c, g, or t
gcccgcggcgctttcccctccgcggttcctccccgagccgccccctgtgcccaagcttccgcggctccgtctgaccaggtgccgctgcctgactgggaactcgccagggtgcgtagtcccactgcaaggcctgggtggccggctgatggccgcagatggcggtgatcggcctgatgcccgggctgccgagggggatgtacgcgctccgcctccctaggattccctccagccctctcccaaaccctgcctcgcagaaccgccggctaccgggcccaaggaccagcctgcctgctgctcagacgttcatgctgtgccccactcacgaagaatccgtgggattcgcagacgttggtccagctccctagccctatagcagcctccgcacgggcacattacgaacagggccagaacgctatcctagtcaagggtgaccgacgctctgacgcgtgggcagccatttactttccaatctcttctagccaatcagagggccctgtggttgaaacattacacggtcggatctgggagggattcgtcgcctagcacttgggccatgcttaccatgtgacacaggtccacactaaccacatgcgctacgcattggggacccgtacccttttgccacccttaccccaggttggcgacaactgactcatctcatgcttgtaccn

SEQ ID NO: 597563 - DNA, 917 bp, Homo sapiens
  misc_feature (131)..(131): n is a, c, g, or t
cagagctggggccgcggaggagtcggaggggcactatggcatacaaagttaggatgcagatgccgaggatgtgagtctgttggaccttgtgtggctgtgctcttggtgtatctgttggtcacctgagtgantacactgtgcagtgttatgtctgtggacctggatcagtgagtcctatgaaggtggtcacttgtcaatcctggtagttgcccatgcggaaattgtcttgcaataacggaatctcgtgatagaagagacaccggatgatcagtgaccctgaaaagagaatgaaagattctttggagacagtgcagcaaagttccatgggcggattcagaatccaaaggctacgacttgcgttacgttcctagctaccgtccatggggaagcaggcgtgataactctcccattgtagctctttaccctgggtccgcttcccgagagcatgatctgtctttgcgacccacagaggcctgctgtgcatctttcagatcattctcgcaggctgtccggtttcttcgcctgcggacgtgttggggctatggttcttcaattcttctcgttctctcatgctgatgattttgcagagctgtccatcaaggatgcagtgatcaccgtgccagtcttcttcgatcaggccgagcgcctaggctgtgctgccggctgctcgtatggctggctcggaagtggtgcagcgtcatcatgagcaacatcgccactggcctcaggtatgtgtgtcttccgcggaaagattttaagcatgccgaatatcatgtctatgacatgggttcggggccgtatgcccttggggcctcccaacttggcgcactccggggctgggttttccctgcatccggggggtgccccccttggggccgggccgtttaacccggggttctaccgcggacccggtgcgc

SEQ ID NO: 597564 - DNA, 601 bp, Homo sapiens
tacagtcgaggagatctcgcactgttgcccaggctggagtgcaatggcacatctcggctcactgcaacctccgcctcccaggttcaagcgatcctctttgcctcagcctgccaagtagctgggattacaggtgcacaccaccatgcctaggtaattaaaaaaatttttgtatgtagaaacagggtctcatgtaactcctgggctaaacgatcctcccactgtggcctcctaaagtgcgggggttataggtgtgagcctgagccgctgcacccagcctgtgtggtctgtttttagtgtctgttgtttctgctggttcatgctcctggctccttagtttcttgtgtgcttggctgtctgtggcagtgtgcagctcattatgtttgaagaattatttgtaggggttcctagatgccaaagacgaggtaccttcctccggagagggtttgcttttgcttttgctaggtgtctttgggtctgttcagcctgagagtgaccaagttcacaggatgaaattctgtgaaactcccaggtagcaagtcagtgtagggctgtgtcgggctgatccatggtcatgatttatcaggagagtctccgtcgaacg

SEQ ID NO: 597565 - DNA, 1060 bp, Homo sapiens
gtcagaaaggcaggcgctgcgagacggagactggcaatctgcagcctgtgtgtgcctgctctaatcatgatggacccccgattgacgccgtggaacggctcacaccggcactgtgctgcacctgcccaccgtacttaccatacacctagccacacctagctaggccaaggagagcagtactagcagcccgcggtgcgcgtagggccagggcctgcaccggagtgtacggtaggtagatagggcatacccgagcgtagcggcgcgaggtagcactacgtacctagactagacactactagcactacgctacatactaccgcagcctagcagcccgacagggagacagcgagcgactacgcgctcatacgtaggtagctagatacgaccgacgactagactacacacgtcacactatcgcgccacgtgaccagcagaacatacacaggcctatcgcaacccccaccggcagcatcccatcactaggcgctacctaggcacggtacatactacaccctaccacccacactatactcaccctagcactatctacaccagcctaccgcacagctaccataaaggcggacccgcaaggacgacgagtacagcgtggcagcgaccccaaaccaggaacctacggattaactagcttacctacatagatgtaacgcagcaagtaccaacaggccatctcaacttagcgtagcacggctcggcacggcactgaccatacgtagcgcccaaagccacaacctaccctggagcaccgactgacaggacactaacgcacacgtgccacgcacgaccatacgagcacggcactaggacatgcactacctgagcacgctacaacaccaagcacatgcggcaccaccacctcgcggcaccaggcaccgctccacaacggatcggcctgagcacgccacagcagcccctgacaatagcgacacaagcatccagcacctccacatgacaccaaaccccggcgaacccaaccaccaaccgcaacaaggccacacactggaaccccacaaccccgcgcgccgcacgcaccagcggacca

SEQ ID NO: 597566 - DNA, 202 bp, Homo sapiens
cacctaagacctcattttaacttaaaacctctgtaaggccaggtgcagtggctcatgcccgcaatcccagtactttgggaggctgacgggggcggcggatcatgaggtcaggagtcgagaccagcctgccaacgcaggaaacccgtctcaccaaaaatacaaaaataggcaggtgtagtggccggcctgcgcccagctacca

SEQ ID NO: 597567 - DNA, 100 bp, Homo sapiens
agcgttctgacttctgctggactctgagtgggggctggagtgtccagtcactcgagctggagatgcggcaggcactgttgtactgtcgggctagtcgggg

SEQ ID NO: 597568 - DNA, 566 bp, Homo sapiens
attcgccaccctccatgcccaggtgggccgacatgaaaaatgaagatggaggacagtgtggggtgcctggaaaactgcttgacggagcgtgaagaggaagcttccagaaggaaccttggagtggtcctgagcccagcaggcacgcagtgagcaaggtgggccgccttacgaccaaagccttggcacgaatgacccaaagactgctgggcttgccaggccaaggggaaggctttgtgaacctggtcccttagctttaggttggaaccccttggaacccaccctatagcatgcccatgaaaggccgcctgtttgcaatatccctttggtgatagaaacggaacagggcaagaaatgaaaaggtttttagaacccaaaggctttcccctttgtgtccagtggaatgctgataggacaatgaaccgcatttccttaccttgcccccataggggttaattttgccagtggactggagcatagcatgcctggaaccctggtgagcctttgcaaggtaggccaggagaatgggaggccgccagagagcgcgaagggaaaacagtggactgtaa

SEQ ID NO: 597569 - DNA, 411 bp, Homo sapiens
  misc_feature (245)..(245): n is a, c, g, or t
  misc_feature (314)..(314): n is a, c, g, or t
  misc_feature (368)..(368): n is a, c, g, or t
gttctgtggtctaactcatctacctagatgagttaggtagatgagttagcagtagaaggaaagaagtaaggttgaaggaaagtatagataaatgagtggattaaaagataggaaaattgagatttttatggaagataccttctcattttctttgtaaagtgaaataggtcatcttggaataaaaggagttataatctaggcaaaggggtcaatgtagtatggatcattctggtatggatcattcngataaatgggttaggggaacccgaacagttgttttaattaaaaagaatttacccaagttgacacaaggntgacctcctgaaaatttgaacctttttaatttttataaccaccccccatttggngggtcccggttgaatttttttccccaaactccctaccgccctg

SEQ ID NO: 597570 - DNA, 184 bp, Homo sapiens
aggatattaggaggtcagcacggtgctcatggtgtcgacggaacttgtacgagggaggcatgcaccgcaactggtgaatacacgtcgagcaggctccagctttaacgatattgggaggtcagcacggtgctcacgtgtcgacggaacttgtccagggaggcatgcaccgcagtggtgaatacac

SEQ ID NO: 597571 - DNA, 804 bp, Homo sapiens
cactctctgccggagaaccccatggtgacacattttcatctttctgaccagaggctgtttttttatttttttgaaacagtctcattctgtggcccaggttggagtccaggggctgtgatctcggctcacttgcaaacctcgccttcccgggtattaacaccaattctcgtgccagacagcctctcccagaagttatagccgtggaactaacagggtgcccaccaccacaccccacttaatttcggctattgggtcattttacagctagacgcactgcgcgggagtcactttaatttactacacaccacacaccacccacaacacagacttggggaaaattacgtagggcagcaacttacacacaagacagctagtaggcgctaccatgtgagaacatcactgttgaccatcatatgctatcacaagacacgcaataagggcactctccacacagttcgaggagaattacaaggttgttgacgccacacccgatgcaactgagcccggcacatgacccttcggccaacaacgccccttggtgtcacaacctcgatgagaggtacccagtactttatgaggcagctgcttccattttacgggcaaacagacaaagggcagcctgacatcaacaacgctaatcggagggcgatcataagcgccgaccccatacaatttgcatgatcttcccaacaacacacttctcggacacaaccaggctctgagtatcgtcgcgcataccacccaccgtctctcgtgcccactccacccgacgaaaccaaacacacactcattctgtatggggcc

SEQ ID NO: 597572 - DNA, 1086 bp, Homo sapiens
  misc_feature (341)..(341): n is a, c, g, or t
aaaaaaaaaagcccttttcagtttggtgcactggtgtatggtccgtgtagaattgtgattgcagatttttcttgaaattgaaatgtgtttggttttagacgagattcattaccggttaaagcaggaattgacaaagcttggcttttctctggtattgtttctagggtgtattgggtgacttttaacggggtatattattataattggccaattattaagttaaattattagatttattattatgtgttattagtgtgtttctcacaaaagcctttaagacctttataccttctccgagcaaccccaacagtgtgcttgggaatatttctcagaagtctcangtcattgtggttatattacatgtgttgttagttctccaaaagccaccattaagcctagaaagaaagaaaattatttttcataggaagacacttaccattcgtggttttctcaacatgtgaaagtggccaacacaacaaattgagaaagcttccaaacaaatcaaattctcccatttgtgccacgagacacttgacactgtggatagcctcaaatttgtgggtctcaccaagaaaattctttagtgggaaacgtgaaaatctcttaaagtggcttctcccaaaaaaatgtggcttgccttgtgggtttgggcacaaaattatctccaacaccattgtggctctatttgccacaagaaaacacttttatttcaacttttacccaaaacatgtgcaacgattttttatttcccccatttggggtgggttttatacaacgccgtgttaccgtagaacaccataaaactcgtgggggggaaacgtcgcctttgtggtgcaccctgggttaccaacaacgcacagaagtgtaattccaaatttaaaaggggcttaaataagacacttttaaagtaagtagatcaaaaacacgacagggcggggagccgcgcctctaaaagaaatttattccccccctgcgaggagagggggcccccccaagagaatattagaaccgagcgtattacacccccgggatttttcgttgtctgctaccaccacgtgggggggcccctaattaatgagtcggaca

SEQ ID NO: 597573 - DNA, 232 bp, Homo sapiens
accactggtaggagacactacatcactccctggttcagcatccggtttgttctcttcacaatatctatagcagtgagtctttcacaaataacagttacagtctagatagttcgaggaaactccatcatcctttttgtatcctagtacgaggccttgtcacttcacttaagggagcatgaaccactctgttcgtggcttaatttgacgtagtgttgtcacatggtgccgggcg

SEQ ID NO: 597574 - DNA, 163 bp, Homo sapiens
acttggtctgaagctgtagcctcgcccagtgaggatcttcatgaggtagtcggtcaggtcccggccagccacgtccagacgcacgatggcgttgtgggagcggcgtatccctcgtacataggcaccgtgtggttaaccccctctccaggagcctcacaacgag

SEQ ID NO: 597575 - DNA, 435 bp, Homo sapiens
gcacgagatctactgcaccggcaggagtaaccaaatcctctaattttttcttctcctcttcgttagaggcatatggaatcaatgattcgtaaaatctttttggtggtttaccgaaaatatccaaattttccacaaatgcttgtaagacggttcttgtttctaacaaatggtggttgtccttgttggggactaagacaacatcggattcatttagaccatagaaggttaagaattctttgaccaaagattcattgtttctggcatgaataccgagggcttcaccgatgtcataagtcattccagtaccagaaatatcgaattcaatatggaaaatatatctatcataatcagcaggcgtaacacgtctattttctttaactttcacgacgaagttcttgacgggtaaatcgggtcttagtttattctcaacttcat

SEQ ID NO: 597576 - DNA, 249 bp, Homo sapiens
ggtggtgacggttctggggcggcctggcaccccgaggcgaacttcgttcgtcggaggcggtgccaccgtcctgggaggcagcggctgtcttcgagaaggatggagccccctatctgccccgagtgctacttatgagcgcttctcggccaagcatgtaggcttcgtgcaacacaggacacatcacggcacgaaggatggtcgatgcgacgttgtggctatctcagctggtcgacccaggaggcatttctg

SEQ ID NO: 597577 - DNA, 464 bp, Homo sapiens
tgtctcatgtcggagacgcaagatcttcgaggagctcaccctgcgacaagcccacgcatgtgatgccctgccgggcgcccgaaggtgggcctgcctgatctatcatcgcgggcggctacttccgacagtcgctcacgtacctggaggcttactaacccagtgacgggacctgggtcctggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtatgagccagagcgggatga

SEQ ID NO: 597578 - DNA, 833 bp, Homo sapiens
ggcgttcggagatacgtaggggtgaattatgtttcggacgatgcatctggaggggtgtgtaagactcgtgtggctgaagaaagctattacgctctctatatgtgggtcattagttttaaaaatagcatttcgcttttatttgcttgactgcctcttctcaacaaattttaaagcccgccactacatgtgtttggtgttgccctaccagctctggggttggggagtgcacagttataggttattgtgtgctcctgtggccattctcggttgtcatccgccactttcacgattgtggcgtggtgtaattaaggtagactgagtgggatgtaatgggtaaatatgactttatagtcagctctaatcctggattcaactatcaagaattgtagattttcgaagctttgtggatgttcgacgttttagaaacaggtgatgcgaaagaggtgaaaattcttgttctgaagtcgttaaggaaacagagaaagtttttgcgtccttaagtgtgggacttgtgtgtgaccaacaatatgaaaggctctgaggtcagctggagaagaatatgcagattaagatgccagtgaagagacttgcgtgagggtagtttctcaaaatcatggcgatcattgggtccgctgaaagatgagttggccggtgttcctccggcatgtgtctgcaataaatcgtcttgcctgtttggaacggggactaagtttgaatgggacatcccggtggttccatcagagttaacttctggagaaattgggaccaggccctattagaaaaaccccggggtccgaaatgggtttgcaaagagggtggggggaaggtggctg

SEQ ID NO: 597579 - DNA, 215 bp, Homo sapiens
taaatagggggcaagtttccaaagatagggggggggggctccagaaatatttttggggggggaattcttaatcacagagggtttaatgctggttgggggctccggattaggacctaaaaaaaaaaaccaaaaaactttgttttattgtttcgggggaacacctttgggggctcccggggacccaaattttaaaaacaaaaaattcttggaggttt

SEQ ID NO: 597580 - DNA, 170 bp, Homo sapiens
ccgagcggacagcagggcgtcatcaagtgtccccagctcggcggaatggatcacacggagaagagggggcggatttacctaaaggctgaggtgctgatgaaaagctccatgtcagcagtacgagatgcaaaaaatctatatccctagtggatccaagacggggctttgca

SEQ ID NO: 597581 - DNA, 123 bp, Homo sapiens
ataaataccaaggaataaatacgactcgagcatttaagaacacaggccatacactgctggcttaaaatcctattagcagagagaatcttttaacattgtgaccactaagcactatcagcttag

SEQ ID NO: 597582 - DNA, 380 bp, Homo sapiens
ggcttccccctatttattactgaactattatggtaatgaagatgggccttttagggatcccccccacatataatagcctccagcaatataggcccgacttggtcctaagcccctgcctcagcagttgtttacattcagttgttttgccttaacgtctgccttctttcctttccgggccaagcctttaatgttggccccctttagccctgtgggtcccgccaggaaaaaggttggagcagggcttttccctactttggatccatcccgggtcccattttcctttaatataaataatttatgggtttatgcccttcccatcctgccttgtttcaaggctgaccttttttcctaaggaagggaataatccttttaggccccga

SEQ ID NO: 597583 - DNA, 687 bp, Homo sapiens
  misc_feature (150)..(150): n is a, c, g, or t
  misc_feature (154)..(154): n is a, c, g, or t
  misc_feature (170)..(170): n is a, c, g, or t
  misc_feature (178)..(178): n is a, c, g, or t
  misc_feature (180)..(180): n is a, c, g, or t
  misc_feature (191)..(191): n is a, c, g, or t
  misc_feature (200)..(200): n is a, c, g, or t
  misc_feature (208)..(208): n is a, c, g, or t
  misc_feature (211)..(211): n is a, c, g, or t
  misc_feature (216)..(216): n is a, c, g, or t
  misc_feature (283)..(283): n is a, c, g, or t
  misc_feature (335)..(335): n is a, c, g, or t
  misc_feature (345)..(345): n is a, c, g, or t
  misc_feature (348)..(348): n is a, c, g, or t
  misc_feature (369)..(369): n is a, c, g, or t
  misc_feature (387)..(387): n is a, c, g, or t
  misc_feature (411)..(411): n is a, c, g, or t
  misc_feature (420)..(420): n is a, c, g, or t
  misc_feature (428)..(428): n is a, c, g, or t
  misc_feature (435)..(435): n is a, c, g, or t
  misc_feature (439)..(439): n is a, c, g, or t
  misc_feature (469)..(469): n is a, c, g, or t
  misc_feature (509)..(509): n is a, c, g, or t
  misc_feature (519)..(519): n is a, c, g, or t
  misc_feature (531)..(531): n is a, c, g, or t
  misc_feature (572)..(573): n is a, c, g, or t
  misc_feature (581)..(581): n is a, c, g, or t
  misc_feature (666)..(666): n is a, c, g, or t
gaaggaaagccaggacctccggagcagagacagcagctgcagaggcaaggccagcatgtcgcccaacttcaaacttcagtgtcacttcattctcatcttcctgacggctctaagaggggaaagccggtacctagagctgagggaagcggnggantaagatactttcctgntctttagngncaaactgaagngggagtggntggggagnagncgtancgccgcgctctgggtgcctggacatgctgagcctccagggccagttcaccttcaccgccgaccgggngcagctgcaatgcgcagacttcttcatcagcgagctcgagagagttcattancatccactangancaggtctccatcgactgtcanggcggcgacttcctgaangtatttgatggttggattctcaanggggagaanttccccanttcccangatnatcctctcccctcagctgagcggtacatanatttctgtgagagtggtcttagcaggaggagcatcagatnttcccagaangtggccatgatnttcttccgagtgcatgaaccaggaaatggattcacattaannataaaganagaccccaacctctttccttgcaatgtcatttctcagactccaaatggaaagtttaccctggtagttccacaccagcatcgaaantgcagcttctccataatttat

SEQ ID NO: 597584 - DNA, 305 bp, Homo sapiens
  misc_feature (204)..(204): n is a, c, g, or t
  misc_feature (233)..(233): n is a, c, g, or t
  misc_feature (298)..(298): n is a, c, g, or t
caataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaataggancaattattaacagtgcactgtaattaaangtgatgttaatgtggatatgtctgtctctttcttcttcaaatttcttttttggtactggtacttnacccggt

SEQ ID NO: 597585 - DNA, 145 bp, Homo sapiens
ttaagatacaggtagtctctaatgtgcttttgaagcttgctttaacaatttacaagtcttttctgcggacagtggtggctctgggacaaccatattatttctatggtaggatagaccctatacatacaagcaccccaaagccctg

SEQ ID NO: 597586 - DNA, 200 bp, Homo sapiens
ccccccgaccgcggagagcaccatgtcggcgccggcgccaaagtcagtaaaaaggagctcaacttcaaccacggacggggccgacgagacctcagaaaaggacagcaagaaggcgtttaacaatttaatgaggacaaaattgatttggacagatcttaatgaccaggccattgaggaggtttttgtatagtaggacacag

SEQ ID NO: 597587 - DNA, 146 bp, Homo sapiens
tatgaagaagtgcagcactggccaacaccagggtttactgaatcatttcagtttaatacataagtgtccaataataatgtcaaccctccctcgccacagccaataatttgtcctcactgagttggcaacaagtgactgctgtgact

SEQ ID NO: 597588 - DNA, 580 bp, Homo sapiens
aaggttcacgagcgaggattagcctgctcttaaagcgggacgaagagcttcctcctggtaagggcatgggacccaggtcctcatagaacgagtcggcaggctctgagggttgcacatggtcatggtctggccttactccttcccacggtagtgaaacttgatgtccaggtcagacattgggagagagctaatccacagttctggagagctatagaagggctgtataaggtactggagtacttccatctccaggggttcagtcttagggccacactgactccggactagcagatctccacactgcaatagcccacactaggctggcgccttagactgggcctacaacaaaaacttgtggtgagcagacaggggtaccacacgtgccccttcacttgcttgatgcctctgagaactcacaaaggtcagtagacaagaaacaaacactgaacccagacccagtgtgatcttccagcccatcagtgattcccattaactgacgcaataagaaataaggttcccctgctcctgcttcccagtcatattataactcccacaaattcatagttgaaaaaacctttgt

SEQ ID NO: 597589 - DNA, 829 bp, Homo sapiens
gtaaccccacataattacacacaactttaaaaaaatttaaaattcagctggctcaggatatctgttgtgcgtcctacagataccacaacctggatcaggtccaagcaaaactttcagagtgctacaaaatgttgcgttcccagtccaaaaagaagtggaaaagaatctgaagtcatgcttggacaatgttaatgctgtgttcgtagactctgccacaccactattcaaccatttgatggataatgagtctgatgactgtctctttacttggggaagaacctgcagcatttttgcctagaaggcttttttagtttttttttttacaagagtctttttatttattaccttcgtttctcgtctcgattctcattaatttagcccttcctctcctcttttttctccctttttagttacctccgcttctccttttatttttctttcgtctcttattgtatgccgtcgtttagttaccagctcagaccgattcacatattttttatctctaatacgtcatctataatgactccaaatcaattacttctgttcctcctctcttttttttatgcaccatcttaattttttttgtctttgttcctcccttatatacccatttactgtgtttttcgactttcctttgctgttattcatatttattattccctttcactctgtttcagtcctttcgtttatcttttatcacccttttctgttccagacctgtccatttttctccttctctactcgcaccccacattcatacattggcatctgctttcatgagaaagatcgtaaaccgcaatttaatttctattatttatttatttttttg

SEQ ID NO: 597590 - DNA, 182 bp, Homo sapiens
atttggagaaataattttggagctaagtcacttcttaataaatatatcaatagttgtagtcataatagcaaaatagattactgatattgcattggtggaaaaccatgttgctgctgtcattctccttatgcctttcagccgtcgacgcggccgcgaatttagtagtagtagtaggcggccgc

SEQ ID NO: 597591 - DNA, 104 bp, Homo sapiens
gttgacttagcaggcatcccgcatcgtggcaccacagtgcggggtccggcagctctgcaattctgtcaatccagtggtccatcagcgttgtttccggtgtgttg

SEQ ID NO: 597592 - DNA, 275 bp, Homo sapiens
gcacgaggtagcggtcagatgagaagggcaatcgtcaggacttctgttgaaaagcggactaaacataggcattatcattcttagagttttacgagcaaatagaatcgagtgacctccgtcgttgctaacaggcgcagtaataataaccgcggacgaaagccacgcaggcaaagaatgctttcgctgaaatatcggagtcttgctattgttcagggctttgccggtgcgtaaataataggctgaagcgaatttatttcccgcacaaaaaatttttg

SEQ ID NO: 597593 - DNA, 658 bp, Homo sapiens
  misc_feature (156)..(156): n is a, c, g, or t
  misc_feature (193)..(193): n is a, c, g, or t
  misc_feature (456)..(456): n is a, c, g, or t
ccaagggctttcccgggcatgccgcagattattcaggcgccccgcattatgcccacatgcggggccagcggcccaacatgccgccccttggtatgatcccccggcaaggctttgcactgggcaagatcccaccaggggcaatgccccggcagcagnttatgccaggacagatgccccctgcccagcctctttntgagaatccaccgaatcacattttgttcctcaccaacctgccagaggagaccaaagagttcatgctgtccatgcttttcaatcagttccctggcttcaaggaggtccgtttggtacccgggcggcataacatccccttcgtggagtttgacaataaggtacaggcaggggcagctcgcaatgccctgcagggctttaagatcacgcagaacaacgccatgaagatttcctttgccaaaaagaagcaccttttccccccatgcntgccccttcccttgttttggggccacccctttcccccttggttaagccccctgaaggtaagtccccccttgggggcctttttggacccgtgtgtgagtgagtggtccccacacagcattgtacccaaagtttgtccccaaacattgcaccgggggctgttaggccggaattaaagtggctttttaaggtttggtttttccca

SEQ ID NO: 597594 - DNA, 687 bp, Homo sapiens
  misc_feature (18)..(18): n is a, c, g, or t
  misc_feature (58)..(58): n is a, c, g, or t
  misc_feature (94)..(94): n is a, c, g, or t
  misc_feature (102)..(102): n is a, c, g, or t
  misc_feature (126)..(126): n is a, c, g, or t
  misc_feature (137)..(137): n is a, c, g, or t
  misc_feature (142)..(142): n is a, c, g, or t
  misc_feature (189)..(189): n is a, c, g, or t
  misc_feature (194)..(194): n is a, c, g, or t
  misc_feature (206)..(206): n is a, c, g, or t
  misc_feature (223)..(223): n is a, c, g, or t
  misc_feature (237)..(237): n is a, c, g, or t
  misc_feature (246)..(246): n is a, c, g, or t
  misc_feature (266)..(267): n is a, c, g, or t
  misc_feature (285)..(285): n is a, c, g, or t
  misc_feature (292)..(292): n is a, c, g, or t
  misc_feature (296)..(296): n is a, c, g, or t
  misc_feature (299)..(299): n is a, c, g, or t
  misc_feature (317)..(317): n is a, c, g, or t
  misc_feature (334)..(334): n is a, c, g, or t
  misc_feature (341)..(341): n is a, c, g, or t
  misc_feature (373)..(373): n is a, c, g, or t
  misc_feature (377)..(377): n is a, c, g, or t
  misc_feature (389)..(389): n is a, c, g, or t
  misc_feature (392)..(392): n is a, c, g, or t
  misc_feature (400)..(400): n is a, c, g, or t
  misc_feature (412)..(412): n is a, c, g, or t
  misc_feature (426)..(427): n is a, c, g, or t
  misc_feature (438)..(440): n is a, c, g, or t
  misc_feature (458)..(458): n is a, c, g, or t
  misc_feature (466)..(467): n is a, c, g, or t
  misc_feature (470)..(470): n is a, c, g, or t
  misc_feature (472)..(472): n is a, c, g, or t
  misc_feature (475)..(475): n is a, c, g, or t
  misc_feature (477)..(478): n is a, c, g, or t
  misc_feature (483)..(483): n is a, c, g, or t
  misc_feature (510)..(510): n is a, c, g, or t
  misc_feature (525)..(525): n is a, c, g, or t
  misc_feature (542)..(543): n is a, c, g, or t
  misc_feature (549)..(549): n is a, c, g, or t
  misc_feature (557)..(557): n is a, c, g, or t
aatcactcggggagactncaaacagtgagcctagagctggagactagcgttaaccggnggggcggtcggttttatgaatgaagctatggctacngattcccnaagaagacccagtcgttgtactgntggagttgtgnttcgnccccaggctgtcacgtaagcacatttcagataaacccaatagctgangaaangattactcagantactaacatttaggttntctttatgaacagnggttacttntgtaaaaatcttttaactgnnggctttatgggatgaatnataatanttgncangaccaaatgaagaattgnagagttaagttggcgtnttcagcncatttacagagtacgtgaagagcactatgctnaatnctgaagagcagngtntcaaactncaggtttaacanattagtggattgtnnaatcagtttannnggtcaggagttgtagtanaaaatganntanangcngnncgcantggctcatgcctgtaatcccagcactntgcaggcccaggcangcggatcacgagatcannagatcnagaccatnctggctaaaacggtgccctgactctgctgtacacatgatgactcggaacatgtggcccctgtagtgccagctactcaggacgctgagtcaggagatgacttgaaccttgggtcgtactttgcatgggctg

SEQ ID NO: 597595 - DNA, 672 bp, Homo sapiens
  misc_feature (18)..(18): n is a, c, g, or t
  misc_feature (58)..(58): n is a, c, g, or t
  misc_feature (94)..(94): n is a, c, g, or t
  misc_feature (102)..(102): n is a, c, g, or t
  misc_feature (126)..(126): n is a, c, g, or t
  misc_feature (137)..(137): n is a, c, g, or t
  misc_feature (142)..(142): n is a, c, g, or t
  misc_feature (189)..(189): n is a, c, g, or t
  misc_feature (194)..(194): n is a, c, g, or t
  misc_feature (206)..(206): n is a, c, g, or t
  misc_feature (223)..(223): n is a, c, g, or t
  misc_feature (237)..(237): n is a, c, g, or t
  misc_feature (246)..(246): n is a, c, g, or t
  misc_feature (266)..(267): n is a, c, g, or t
  misc_feature (285)..(285): n is a, c, g, or t
  misc_feature (292)..(292): n is a, c, g, or t
  misc_feature (296)..(296): n is a, c, g, or t
  misc_feature (299)..(299): n is a, c, g, or t
  misc_feature (317)..(317): n is a, c, g, or t
  misc_feature (334)..(334): n is a, c, g, or t
  misc_feature (341)..(341): n is a, c, g, or t
  misc_feature (373)..(373): n is a, c, g, or t
  misc_feature (377)..(377): n is a, c, g, or t
  misc_feature (389)..(389): n is a, c, g, or t
  misc_feature (392)..(392): n is a, c, g, or t
  misc_feature (400)..(400): n is a, c, g, or t
  misc_feature (412)..(412): n is a, c, g, or t
  misc_feature (426)..(427): n is a, c, g, or t
  misc_feature (438)..(440): n is a, c, g, or t
  misc_feature (458)..(458): n is a, c, g, or t
  misc_feature (466)..(467): n is a, c, g, or t
  misc_feature (470)..(470): n is a, c, g, or t
  misc_feature (472)..(472): n is a, c, g, or t
  misc_feature (475)..(475): n is a, c, g, or t
  misc_feature (477)..(478): n is a, c, g, or t
  misc_feature (483)..(483): n is a, c, g, or t
  misc_feature (510)..(510): n is a, c, g, or t
  misc_feature (525)..(525): n is a, c, g, or t
  misc_feature (542)..(543): n is a, c, g, or t
  misc_feature (549)..(549): n is a, c, g, or t
  misc_feature (557)..(557): n is a, c, g, or t
  misc_feature (672)..(672): n is a, c, g, or t
aatcactcggggagactncaaacagtgagcctagagctggagactagcgttaaccggnggggcggtcggttttatgaatgaagctatggctacngattcccnaagaagacccagtcgttgtactgntggagttgtgnttcgnccccaggctgtcacgtaagcacatttcagataaacccaatagctgangaaangattactcagantactaacatttaggttntctttatgaacagnggttacttntgtaaaaatcttttaactgnnggctttatgggatgaatnataatanttgncangaccaaatgaagaattgnagagttaagttggcgtnttcagcncatttacagagtacgtgaagagcactatgctnaatnctgaagagcagngtntcaaactncaggtttaacanattagtggattgtnnaatcagtttannnggtcaggagttgtagtanaaaatganntanangcngnncgcantggctcatgcctgtaatcccagcactntgcaggcccaggcangcggatcacgagatcannagatcnagaccatnctggctcggtgccgtgtctctactaagaatgcacaacattagccggatatggtgggcactgcagtcgcacctacttgggaggctgagtcagaatactgacgtccctgataggggn

SEQ ID NO: 597596 - DNA, 183 bp, Homo sapiens
tgtacgtacacttttgatcggctattaatcaggatttctacaagcccctctcttaaattcaattaatttgctagagtgactcacagaactcatggaaacactttaattacatttacccatttattgtaaagggtattacaaaggatacagactaacagccaggcagaagagaagcataggaca

SEQ ID NO: 597597 - DNA, 701 bp, Homo sapiens
gaggcgactctacaggatccttaatccatgcttggttttatcatcaatcctgtgaaatcatgcataacatctggacgcagtattctccaggaggaatttattgtttcaggcttgatggttttcatggctttttccataacaatgatggcatcttcagtggtataatccttccagactttcacgatgttctatcagggttcgcttccatagagttgacagtcctttccatagagtaccatgtatatgtgtaatgagcctttaaggtccttacgaaccccttgatctagagactgaattagagacgatgtgtttggagacaagcagaccactttgacaccttcggtattgaactgatggggttcaatgccaagggctttgtccaataacaagagaattttaaaaggcaatcccaggccaggtgtggtagctctcgcctgtaatcccagcactttgggaggccgacgtgggcagatcacctgaggtcaggagttcgagcccagtctggtcgacatggtgataccccgtctctactaaaaatataaaattagctgggcatggtggtgcctgcctgtaatcccagctactcgggaggctgaggcaagagaatcccttgaacctgggaggcagaggttgctgtgagccaagattatgccactgcactccagcctgggggatagagcaagagtttgtttccaacaaaa

SEQ ID NO: 597598 - DNA, 188 bp, Homo sapiens
gcgtggtcatcaagctggtaccgagcgcatacttggatgacctctgtcattccattttcctgtgtgcccttgttctcctatatattctcgcaaataccacgggattcgtgtccagggagaaagaaagtgtttaactttctatttgcctaaattcttcattgttggactattgtggttggcttatcgag

SEQ ID NO: 597599 - DNA, 286 bp, Homo sapiens
aaaggggggcccccccccccccggggccccaagggggttttcccctcccaaaaaaacccccaaaaaccaaaaaaaaacccccccgtttggggtggggtttttggggggggccccagaaaaaaaaaacccccgggccgagaaaagggttgttttttctttccaattttggggggggttttaaaaattccccttttaaaggggggggggggcccctttcccgtttttttttttttttttttttttttaaagggttttttttacccctaaaggggggggggggaaggga

SEQ ID NO: 597600 - DNA, 786 bp, Homo sapiens
cggcctttcccgagcggtgaagaagttccgcagcaagccgcagctggcgcgctacctgggcggctccatggacctgtagcaccttcgacttccgcacgttggcaatgatgctgatgagcaatcatgaacaaggagcctgcgcatgcgcgtgacgctacagattcctcctaatcctaggtcaacggtgcaatgcccgacctgatacactggcgctgccctgtgctgccagacggctgtccatcttcaagcagccttgtgtgaccgaagattacctagaccaccctcgagcaattcaagtgtcatatgagcggaccctgcataagtgcgtgctgtgatcagcctgctgccacgctcttcattggcgagatatgagtgcttgagcggtcttgaagcgccttcgacatctgctgagtgaggcttggtcgtaggaccaatggacctcctcgctatggtggccttgcatgcggtggttgggacctttggctttgcatccggattgagcactgcttgctagtcaggccatctggcgcagcagccctgtcacactaggcatccatgcccttcgactgggtatctgctctcggctcgccgtggacgactaaccccgggtcgtatggctcaactccatgctgcccctgtgccatggccttcatggttgaccgacgagggcgtccgggagcaggaggatgctgttgcagaagtgtcggtggcggcttgaggtggctcttatggcggacatgcttctgcacgtgtggagctggcgtacggggaggcgccgtgaaagct

SEQ ID NO: 597601 - DNA, 803 bp, Homo sapiens
aagggctcctgcgaagctgacctggggctctggaattatggagaacttcagaacttggcgaaaaagcttcaaagactattgtgtgtgaaaagtctactcattggtctgggggacgttgccttcttgcctctgtgatggctgataagggatacaagaagagaggatccacgtttcaacagagtcgaaggggacggcatggagcatgggcccagacgtccgcctcgcggtgggacaggaacagtgctattctattctggcagcaaatgatgacatggtattcatgcatgtagatgaacctgggagacgactgggtttggcgagcaaatcgtttcacctcaggatgatcgagggatcggtctattccaagtctttggaccgagcatctctacactaccacaggcggagagacggactttaccaaagtgacctcgctccggcgggcgtgctacgataagcaagcgtgctctcacgatagcatgattctatccagaaccatgatcacttttgaccgaaggaggaaggtggacggcgcctgaggaagcctgaaacagagtgaatgtgatgctacggcagatagaaagagagaatgagtgcaagcctttcatattcaggcgttcctgacacgtcatctcccagaaactgaagtgttccaatggccccactcgtcagagccgaatgccgtaggccatgtcattgtcatggtagcgtgggggatgccagtcgtcagtgagtggttcgagatgggtactctcagatgatgggggttactcctgggccaagatgctggggggcccatattaaac

SEQ ID NO: 597602 - DNA, 320 bp, Homo sapiens
tggaagacaggttccttgttgcccaggttagagtgcaatggcacgatctcggctcactgtcaccttcgtctcccagttcaagcaattctcctgcctcagcctcccaagtagctgggactacaggagtgcaccaccatgcccagctaatttttgtttttaatagagatgggttttcaccatgttggccaagctggtctcaaactcctgacccaaggtgatccgcctgcctcggcctcccaaagtgctgggattacaggcatgagccaccaaacccagccattgaaaaacatcttgataaaatgtctagtcatgattcttaa

SEQ ID NO: 597603 - DNA, 664 bp, Homo sapiens
  misc_feature (89)..(89): n is a, c, g, or t
  misc_feature (117)..(117): n is a, c, g, or t
  misc_feature (228)..(228): n is a, c, g, or t
  misc_feature (234)..(234): n is a, c, g, or t
  misc_feature (251)..(251): n is a, c, g, or t
  misc_feature (258)..(258): n is a, c, g, or t
  misc_feature (280)..(280): n is a, c, g, or t
  misc_feature (300)..(300): n is a, c, g, or t
  misc_feature (326)..(326): n is a, c, g, or t
  misc_feature (334)..(334): n is a, c, g, or t
cttgagtagaacctgcccctgatactacgtttgcccatttggatgctaccacatgtactgtcgcgtgacatagctgagctgggcatatntccagctgtggatcctctagactccacntctcgtatcatggatcccaacattgttggcagtgagcattacgatgttgcccgtggggtgcaaaagatcctgcaggactacaaatccctccaggatatcattgccatcctnggtatngatgaactttctgaggnagacaanttgaccgtgtcccgtgcacganaatacagcgtttcttgtctnagcattcaggtgctgaggtctcacangtcatatngggagctggtacccctggaaggagaccatcaaaggataccagctagattttggcagagtgaatatgaccagtcgtcccagaacaggccttctatatggtgggacccattgtaagaagctgtggcacaaagctgataacgctggctgaagagcattcatcgtgaggggtcttagtcctctgtgctgtctctctccttgcccttaaaccaagaaagcttcatatatctgtgtaggctgcacaagagccttgattggaagatagtattctttctgaacagtagtttaaggtttccaataatagatgtacaccccgtctagaaataaaaagata

SEQ ID NO: 597604 - DNA, 514 bp, Homo sapiens
agcaaatggacaaaatgccatagttttttagaatctaaatgtaatgccccccaagctaagggtcattaagacagggactgttttgcactgtcaaaatcctagacgctagcaacgcatacagctatagaaggtttataataaacagtcaggggaaaatgaatgaaaatagtgaattttatcaggaatgctgccatagaaacatttacaatgcctcattctaactggtttcaccagaaagtttaatgaacatgagctaattaagaaagccgaatccttaccctgggaattcagttctcaatgcctactaataggcagttttgacatgacagaaccacaactaaatggcactaaatgtcacagtgtacactttaaacctcatagccttagagtctgatgagacccagctacagtgaccaacaccctggattccaacactctgagggcctatatgggcaggatctacgataggctggctacagcatgctccatccgagatttgatcatgccgccggtc

SEQ ID NO: 597605 - DNA, 411 bp, Homo sapiens
  misc_feature (89)..(89): n is a, c, g, or t
  misc_feature (117)..(117): n is a, c, g, or t
  misc_feature (228)..(228): n is a, c, g, or t
  misc_feature (234)..(234): n is a, c, g, or t
  misc_feature (251)..(251): n is a, c, g, or t
  misc_feature (258)..(258): n is a, c, g, or t
  misc_feature (280)..(280): n is a, c, g, or t
  misc_feature (300)..(300): n is a, c, g, or t
  misc_feature (326)..(326): n is a, c, g, or t
  misc_feature (334)..(334): n is a, c, g, or t
cttgagtagaacctgcccctgatactacgtttgcccatttggatgctaccacatgtactgtcgcgtgacatagctgagctgggcatatntccagctgtggatcctctagactccacntctcgtatcatggatcccaacattgttggcagtgagcattacgatgttgcccgtggggtgcaaaagatcctgcaggactacaaatccctccaggatatcattgccatcctnggtatngatgaactttctgaggnagacaanttgaccgtgtcccgtgcacganaatacagcgtttcttgtctnagcattcaggtgctgaggtctcacangtcatatngggagctggtaccctcagggacctcaagatcagcagtttgcagggatataccttcccacaagctcttattgtggcct

SEQ ID NO: 597606 - DNA, 689 bp, Homo sapiens
agcggggcgttgaggttgggccatgctgatagataacgagaaaatagtttctttttactaagaaatcttctagacctatacagtgctaattctcatgaactgtcacagtataggacaaagagtggggtttaagataataatgaaaagtataaactaagtcatggggggtttataaatcttgtaaagagcaatttggtgtgtaattggcgttggctgggattagaagggaattgcttgtaagtttttctaagaactgggcattaatgtcaggagtgtgctgatacaggaccagaatctgattctctgtgtttgaagcaacaaggtttccctagacatgttgatcaactcttagtaaaacagaaacatggcaagaggtttggacttgtaagttctcgaaactccgagtgttcgttgtgaaagttttcgaaccatcttgtgacctacagccttttccagtgtgtgacagcttctacctaattctcaaggttagaagtgctgctgttcacttaacaatgataattacatgtgtttggagtagacttgttcctcttaacgcctttcagattcatatgcctagggattaggataatcactgcatctcactacgtgtgatttgcaggtcatgcatcattgcttgctgcttatccttccttagctccttgaaaataggatacatatttgcttaacta

SEQ ID NO: 597607 - DNA, 626 bp, Homo sapiens
gcgggactcagaggacccgtcagctgcctatctgtcgtggattatatatagaaccggatagtgaacaatggaatgcgtgaatgtagtcagctacagtactccgaatacgaagtcacagatcatatctatgactcagaaagctcagatacatcaacaacagtagcgagtatcagaaattaaactggaatggagcaaggaaaggtgatggtcaaacgatagcaagagtacccccatgccgtgcgagctaactgaagaatagcttccacagttgaactaatatcagacaactagcgtactaggaagtaggtgagcgacgtctggaggacgagagggctatcatagccacccaataggccaaatgcaacaggtagataacagcatttatccaatatgagagccgtccacttcatataatatcaaagtatgtgaaccaataggttacagaactaagagacagactcagtccaacccgcgctggactctcaggggccgctgacccaggggttacctacttctggattctggtactcaaccaggaaagtgtgactacatgcccagcggaaggagaaaagaagctttcaattgtaaaagcctagaattcagaatgtaccccatgtccactaaca

SEQ ID NO: 597608 - DNA, 138 bp, Homo sapiens
ctcaggggagcctgaaccctcaatacttgatggtagtttttcggctctgtcacctaagccattagactcttctaaaatcagcgtctcgtttgggaaatagatgatggagctcagggataatgaaaaccctgggacaac

SEQ ID NO: 597609 - DNA, 1774 bp, Homo sapiens
  misc_feature (701)..(701): n is a, c, g, or t
ttcttggatttcagttctcgattgtctgtgctcggtgtgtgtcttactcccttgtttcctccctcgggtgtggctgtgtggtatctttctccatctccttgcttgtggttgtgttcttacttcttctgctctcctatgtgggtcgtatctttgattgtcttattcatcgtctgtggcgttgctttttgttgctacttacgttctgtggttggattgtcttcgcgtattattctcttctttactgtttcttttctggatgtgcttatcttcggtcgttttattttctctgcgcgctcattatcttgtttctctagctgggtgtttcaatgtgtgtgtgtgtgtcccatgtgtgttttcctcgttggattgatctatctgtcctctctcttgtgtgttgatattttggggtgtggtattatagtattatattgttgtgataatatcttgtgagtaattgatatatatttgtttgtttctttgtaataaatgtgggtgtataatcgaatatatggttatggtgtctatgtcacacatcggtggtaaatggttaatctttatggaacattggtgtgtatatatttgtgagattattggggtatgtattatacttttgaattttcggtttcccatcggtgtataataccctgtttttttatataaatcttttttctgtgtttgtatatctaatatagtcgtggtcntttttttgctgtaatggttttcaatgtcccattgctccttcgtttgtgtataacttccttataacgttctctttaacgttaagtgtatatatttgtgttttactgggtttcagcttcggtaattttggttttacaacttcgtgttcggggtgtcccctgttgtctgtgtctctttttgaatgtggaattttttgtttggtgtgacccaatgtgttgtaaaatattaagcttgtgtttcacccatactcttgggatttctctcacttttttttagttttaaattcaagttctttcaataatttagttttgaatctttcatatctttttttaccctgtctctctatagtattataatatttatgcctctttcctcttactggtgttcattaactaaaagttaagttcatatgcatatctcttttgcactaacttcactcttttccatatttcttttcccttctaaattaattatggttaatttctaatgtgtgtctcttaactcgtaattaattttatccaccttctccataaagggtgagtgtagaaatagaggtactctattaacgctgaagtgtgtttgtcccatttccctaaagggccgtcggagatattgtctagagtagtgtccttggttagtgtatttctacaattgctagagatttgtttgatgtttaacttgcttagcgtgtgtcacacaaaagttacgctcgaaagtgtcattgtttacttgttaatatggggtgtacacactgttcaccactatagtggggagtgtctgattcgcctatacggcttaacatgactatcagctcggagcttgtgagcatctctagctgcatatgatcttagacagtacgttcagtataaacttgtcgctttttttcttgtgctgatctagagcgataagcagggaatcttgttaatgcattgtttgtatgggaagaaaaggtacatgtttactaagaggttataatgaaagagaataaaaattgacttcttgcgttgtacatataggagctatactattagtagttatgtagtccgtttacatacagcccccagctttaggtttt

SEQ ID NO: 597610 - DNA, 167 bp, Homo sapiens
caagatgcgcgcttctggcatccagtctatatgccatttgctctctgaaataacactcaaaacataacactcctctaagcttcagtgtccttataaaaaatatgggtaaacaatactggtcccgtgacatatgtgtaaagattgaatagtacataatatgctgtatt

SEQ ID NO: 597611 - DNA, 919 bp, Homo sapiens
  misc_feature (1)..(1): n is a, c, g, or t
nctcaggggtgttgttgagcgacgagtgcggcgagagttgtcctggaggggtcgttcttcggtcttgcggccgccctttctcgggggttcttttttttgtgatgcctgacgaccgcatgctccttcatgtgtggtgcctctccttcggctgcggtttgtggggaacgacaaagataaggggtgtgggggtgctctctcatgtgtggactgtgcccgcctagcgggaacaccactccctgggtgtttttgggtggttgttgtggggttctgcctagagcagtggtgttggggtcacgctgggggtggttgcccttggtgttgcccgcatggttcgcaccccacgccacgcaggctcacgaggtggggtgttgttcccgtccacgaccccacggttgtgatgtgagtgtctttgtgttgttgttgttgtttttgttgtttggcgcaggatgttcccagaggatttgtcctgcccattgtttccagggggtcttatagaagttggtcgagtaccagagtcccccagggtgactcgtccaggttcccagtccaagactgggttgctctgggaagttaaccccagcgtgttgctctaaaatacctcccgttagcctgtagatggtgtatgtacttagaagtattctttatagaggtgtatacacagattagaggtggaataggttttgtagtactccttagaatattcttctggtcaccctgtattcttcggcctccattttaataacccgttctttggaccgatctttttcccttggtgctcttttgcccttagactaccctctctaatatgtatgcgacacctcccttattaaaatgtatgggaatgggtttgagcctcggaaattatagtgaaaaggttggtggacgtttaaataccgttgttcccaatataaaaaattaa

SEQ ID NO: 597612 - DNA, 251 bp, Homo sapiens
gaggagtatatgtatcagagacagcgagggtcaggcgactggtactcagtgagaaggaggactacaggacatgggggctaagggatgctatctctcctgggaaggacatgctgacgggatagtggacagtgggccacagtgatagaaagtcctgtatagggacgcatattgtatcgggactgaataggacttgggataatgaccctggtagccctaaaagcctggcgctcctatgctttgagaggtagggg

SEQ ID NO: 597613 - DNA, 506 bp, Homo sapiens
ctccggttcgtactgcatccccagtcaaggctattattcgtccatcagcatcaggcagctgacagcgttctgtgggatgaagctgctcgagtactgtccttcctgtgttcccagggcgggtctcctcagtcgtgcagacgcctgaggcatcagtaccaaatccacgtgttttcagaaccccttcattgcccaatgtagctgttatcatacatcgcacagtagaaccgagcactcctgttctcttccattgtctgctggcctagtgtctctggcaggtccttctgccagtcgctaccgcagccactcctaccccaggacctacaccacggtccactcttggttccagtgaggcatttgcttctacttctgcacctttcactagcctccccctttccaccagctcttctgctgcttctaccagcaacccaaattctgcttcattgtcatcagtttttgcagggctccctttgcccttaccaccaacatcccaaggcctatccaacccg

SEQ ID NO: 597614 - DNA, 131 bp, Homo sapiens
ggagttcgagaccagcccgggtaacatagcgagagcttttctctgtactcctgtagaaaggtggctgcagtgagatatcgtctgtgaagatggcatgcaatgacgaggctgccaaggcactccgtgtgtta

SEQ ID NO: 597615 - DNA, 946 bp, Homo sapiens
ggccgatgctcgcgcactgggagcgctcgcgctcgggtatgccgcacccccggccggcgcatggccgtgaaggtgctcaccggggtcgcgttgccgcgggcctttcccagtaccacggcgggcgcctgcaagtcgttcccgtggcaggagaggagctaacgtttgtgtgctgtatcccttgcagttggaagcgcaaacaggagagattcgactctttctggaagccaggaaactctaatttcgacactcattgcttgtaatcccagcattttggggggaggccagggcgggcaagaatcaccctggttcggcgattttgaagaccaagatttggccatctttgaacgaaaatgtgttctcgctaacttaacaatttagcaacaattttacgccacggcgtggtgggcacccaccccttgtaattcataggcattacctcgggaaggcttgcgacacgcggaaatattggctttgacggcctgtgggacggccagagttttgcagtgacgccaggagaataacccccactggcaaacgaagatttcgggcccagaagagattctggcttgggacgacacgagttgcagcacttctgtctcacattactactttacgtcacattagaaacctccgtgtgagactaccctgtggttaatacggacttcccagattcactttacggagacataaggacatacagcattagggaggggggaaatattgtttggcaacatttcttagctagcgaacctattgtttacgacttgggttactaacccattcgcgaggacctgagactattctctacgtgcggggacggacatggccaaacgtgaggacaatcacatgagggacgtttgttccctctggcgaaacacactcgtttggagggtccgccatcccttttttcacccccgcatggtagtaaaagcagacagaaaggccg

SEQ ID NO: 597616 - DNA, 247 bp, Homo sapiens
  misc_feature (54)..(54): n is a, c, g, or t
  misc_feature (56)..(56): n is a, c, g, or t
ctggaccccagcggcagacgatgggagttcccgtcgtggcgcagtggttaacananccgactaggaaccatgaggttgcgggtttggtccctgcccttgctcagtgggtctagatcatacacagggccatttcatgagtgatacactccactgtcctcaataaaattggctccagtgacccaggggaaggtgtgttctgggccaaaggtgagacgatcgcatcgtctgccgctgggggatcctctag

SEQ ID NO: 597617 - DNA, 450 bp, Homo sapiens
agatccctttccatccttcctttgtttctttttgtttgagacagagtttcgcgtcgttgtaccccgaggctggagtgcagtggcctgatcttgggtcactgcaagctctgcctcccggattcaagcgattctcctgcctcaggctcccgagtagctgggattacgagcacacaccaccacgccctgctattttcacccggctaattgttgtataatcactagagactgggtatcgtcatgttagcctggctggtctcaagtctttacctcgagtgatccgtccaccttggactctcagagtgctggcattacaggcatgaccacctcgcctggccaagaaaaatgttaccttgtaaatagcacagcgttctcatactggaaaccgttgcaaagaacataaagtacagctgagttacatgttacaaaagatgccaacaaaatatattcaag

SEQ ID NO: 597618 - DNA, 206 bp, Homo sapiens
  misc_feature (184)..(184): n is a, c, g, or t
cgtcgcaagccgatgacgatgaggacattccacatcttttactacatcattgctggagccaaggagaacgatgagaagtgactttgcttttcggagggcttcaacaacctacacctgtccatctccaactgagggtttgcgcccaatccctgtcagtcccacggatgactggagagtgttccangcgacaaccgctggtagggccg

SEQ ID NO: 597619 - DNA, 361 bp, Homo sapiens
tgagagcacacaccctacgaagacatgtacgccaccttgacccaaacctacagtgccgtgcagataggcgacaccctcaaggagaacctgcgggccagccagcaaatcgttttgtctggcggggtggatgacgatgggctgttcactttcagtttcgacgatgagcgttatttgccctttgagggtacgggcgctatttcaagctgggcgttggaattcacctcgactgacgtcgcggcgcggaaccgcctgttcgaatcgctgaccgacatcatccttaagctgcactacacggccaaggcttgctaggaggaggcatagtgaaccatgacgagtcgttgcatatcgccgcgccgtccct

SEQ ID NO: 597620 - DNA, 468 bp, Homo sapiens
  misc_feature (108)..(108): n is a, c, g, or t
  misc_feature (184)..(184): n is a, c, g, or t
  misc_feature (391)..(391): n is a, c, g, or t
  misc_feature (393)..(393): n is a, c, g, or t
tcagctacctcgtcgatcagtggcgctggagggtatttgatggaagcatcaccaaggagaactataaccaggagtggtggacctcaggctgaagtacccagcctctgncccccagtgcccaggactcaaaggtgactttgacccaggggccaaagttccacattccttcttagcgtgccttacnatcaggtactttgtcagcttcatcatccagttccagttccacgaggcactgtccaggcagcatgccacacgggcccccatgcacaagtgtgacatctacccagtccaaggaggccagggcaagcgcctgcgaccgcccatgaagctgggcttcagtaggcagtggccggaagccatgcagctgatcacggccagcccaacatgagcncntcggccatgttgagctacttcaagccgctgctggactgctccgcacggagaacgagctgcatggggagaagctgg

SEQ ID NO: 597621 - DNA, 731 bp, Homo sapiens
  misc_feature (190)..(190): n is a, c, g, or t
atcccaatcaaggtatagatgccgtcaccccaaaaatcaaacgtgtacccttaaaatgggtatattttattttataaattatactgtcgtagtagaaggtatgttactgtagtaattgactctttgaacaggtatgtgttgagtcattagctctggcccttgtgtgtaatttggagaagtactttctggnttctagtggtaccaacatgggtttactctgacaagactgtgtcgtgacagatctccgtaacaaattcctttactacggaaggtataattgataaaagtaaagatatacccagttttaagggtgacagtctcgagtgattagagcaaggttgaaatctatgaatcccaatcacagggtgatcaggactgccggtctagaccctgtgactagttccgatccagtatcccgattggcaggtcgagggacagttccgctagcctcgtggatcctacgatgatctagcgtgatcattgtacattatatgactcagcttgggctcagattcactggaaagattgtaacatgggaaaatctaagattagttcggtgaagtcaatctcatttgtgttaattacattctagtatcctccatccctctattagtcggaggaatgtcactccctagtagtgaggtttgagttggtttgacaccgtaagtttacatttgtctataaggtataccaatagtgtttacgtaactactccatttcaagaagcccta

SEQ ID NO: 597622 - DNA, 460 bp, Homo sapiens
gagcatgtctcattacactatggtcttaaaaaagcaaaaatgcttaactatcagcatgcgcaagcattcacttttgtcaggtagaggccctgcttcttcatgatcttcagttatagatctaacaaccacaagagaagaagctggatatctgtttagctatatgtatcattcataaactccaagtcaccatagatactcagcttctcagagggaacatactgctccacagctgtagcaacagttgcacaacaaatccaaagcaataacatcaccgagaggacaaagagttgtagttaaaatccacccagagttaagagagaggcatcttaaaaagccatcactttctccatcttcaagaaaattcctgtgcgcatgtgacattactcatttgcagataggacatattgcttagagatgattctctcaaatttgcaggctcctgctccacatgtggtgcgta

SEQ ID NO: 597623 - DNA, 102 bp, Homo sapiens
ctagctcggtaccccacctaagcctgattcacgccaacctgcgtgatagccattaacgacttcttcagcctcacaatttgcatatacttcaccaaattttag

SEQ ID NO: 597624 - DNA, 724 bp, Homo sapiens
cgtggtgatgcatgcctgtaatcccagctactcgggaggctgaggcaggagaattgcctgaacctgggaggcaaaggttgcagtgagccggcatcatggacatccatgcatcatcgcagaccatagcgagactctgtggtggataccaatcatcaaaaataaaataaaaattttatttaatcgggtttggagcaccaggaaatacgtcactttatgatagcccccaggaggtggagaggatggcgaggtggcgcgccgaattcgtcagaggcgtcaaacatgtcgagaccctatgagggaggtcccaagagatggaaggaggcaccggtggcatagtagatacacaagggaccgagtgaggaggtaggcccagaggcacaaacaagaggtcccaagaggttaaaccacagggcacgagagtctgtcaagtaacatagcctgaccgaatgaggtgaggcagacatagggagagggaaccaacacacgcaggacggggaaacgcatacacaaagagaacgctgcagagatcatctccacagaaagtgaacgatcacaccacaagttaactccaggatactacagcacccccaagccttggggggggggaccacgcggaagagaatgacaggagggaaaagacgtcacatagaacgcgaagacgaacgggcaaaggtggagcacagaagaaaacgccgaataaaaggcaacggaaggcaacaaacgg

SEQ ID NO: 597625 - DNA, 219 bp, Homo sapiens
atggaagaatgtgcatcgtatgttatggaagctcctcagcttaccatggggttacgtcctgataaaccattgttaagttgaaaataccataggtcgaaatgcatttagtgcacctaacctaccaaacattatagcttagcctagccttttttaaatgtgttcagaacacttatattagcctacagttgggtaaaatcatctggcagcacatcttccaat

SEQ ID NO: 597626 - DNA, 208 bp, Homo sapiens
  misc_feature (101)..(101): n is a, c, g, or t
agacatgacggcagcagggaggagaacggcgaaccgccgcgcatggctggcagggctagagaccgccaagacaggggggatggagggcccgggctgtcggncgggtctccaggggtaggctcaatatcgaattctggtgacttctgttttgctttgagcagggcgagtctgggcggtggcttggtgggggggcgcgtagaggggtctg

SEQ ID NO: 597627 - DNA, 746 bp, Homo sapiens
agcggactaaaatttccttaaatgtctgcagagaaaagagaaaatggtcatgtctcaggtaagactcgtgtgatagatgctacagggaaagctgctccgtgcccagaaggctgaaaccaaggaagtgtctgctccagaccagcaccaaacacacgaatcccagagattgtatggtaaaagttcctatcagccctgtgtacagccagctgtgcctaagaagcatatgtaatgctgattcccaataggctgaagtatgggactgacggaactgagggatacgtggctggtatgtactattcacttatgaatgatcaccagcgtcgtccctggattgctcctgtatttgtttaaggtgtacagtcaggttctagagatccaaagtagtcggtttcaatcatttattcccactcaatgggttgcttgggtggaagtacttatacctagaacttcttgccagaccatttcgcctaaagtctctgtcttcatctgtatttgtatctttttgaaaaatttgttatttcatctgtggatttagatgtcagatttacaaggatcttgtaagcatttgaaagttataaagaagtaaagtgtacggtattcttgtaatcttatttttacattaacattttttattaaataattgttaaagtttaagactttatcttgtattaacgtatatgtatgatgaggggtaggtggctcccgaaatcgtgattgtgatgttggaatttctttcggtgtgagac

SEQ ID NO: 597628 - DNA, 849 bp, Homo sapiens
  misc_feature (32)..(32): n is a, c, g, or t
ctgggggagtacgggcagatgcagaccgaatngaaaatctgccgcatcccatttatttctttgtgcttttccagtcacttatatacaattacaataaagcaaatcattctctatatttttgttaaatcatcacaaaatgtatgtttaaaaagtagtttaagtttactagaaagtactatctcaatagctgtatagctaacttatgtaaatcatatttatgctaattgaagaaaatatatttcaccttcaggatattgtattcattttttctagccttaatagacattttataaatactgacactggggataaaattactgcatatattatatttacttggggcttcgcaggagaaaaaattgatttgcaggcacatgcaaacattctggcattttttgagtcaatcctcaaactatctgggatgtaaccatctttacttagttataaaagaaacaagattgggggtttctcataattcgggaggtgttatggacgaccccgggcggaaagaaaggaatttggatttgatataatgttttgctctttgcatgaattataagggattccgcttgatttgagggatcttctgtcaagcctagagatcatgtctatacctaatactcgttggctcgtctttaatgcgtatttaaacctaatctatacctctatcgactatcccgagtatttttccgtgcgctgagctaagcaatttactaattgttgtttataggctgcggtgatacttatattgttaatcgatttgcaattcgaaagaatatagtgataagtatttttcttctagtgaaattgtccgattatactgttactagtggtggattatggtgccct

SEQ ID NO: 597629 - DNA, 339 bp, Homo sapiens
  misc_feature (48)..(48): n is a, c, g, or t
gcacacggagtctggctttgtcgcccaggctaggcgtgcagtggcaantcttggctcactgcaagctccgcctcccaggttcacgccattctcctgcctcagcctcccaagtggctgggaccacaggcgtgtgccaccacgccagctaatttttgtacttttagtagagacggggtttcaccgtgttagccaggatggtctcgatctcctgaccttgtgacctgcccacctcggcctcccaaagagctggtattacaggtgagccactgtgcccagctggaactttaagtgtattataatgcctaaacaatgtccaggggtctcgtgcttaaggcagac

SEQ ID NO: 597630 - DNA, 84 bp, Homo sapiens
  misc_feature (73)..(73): n is a, c, g, or t
cgaagaggcaacgcaaggcaggcagcgacccggcaacgggaagagaaggagaataggtattctgagaaaggangcttaagtttt

SEQ ID NO: 597631 - DNA, 175 bp, Homo sapiens
tgcgcacggagggacttattctgtcacagccgagctggactgtgggcaccaacctgggtgagcacccttctcagcagggggggcgagagattggggaaacagctgatccggccctctagctccagctgtgacgtgtcctcatagaagagggtaattctccccagggtgcgggggg

SEQ ID NO: 597632 - DNA, 1331 bp, Homo sapiens
  misc_feature (1063)..(1063): n is a, c, g, or t
gctcagtgtacattggtttacatgttccaagaatgattccacccattggcaaattccatggtagcgtcaaggctgagaacggggaagcttgtcatcgatggagatcccatcaccatcttccaggagcgagatccctccaatcatcataggtggcaggcgatgactgagcgctgatgatacgtcgtggatgctccactgtggcgtcttcactcaccatggtagaaggctggtggcttcattttgcatgggtggtgacgctcaacacacgggttcggtcagtctatctgactccaccgtctgcatgacctgcccacctagtgatgtcgtctccactgggggtgtgcagagccgatggaaggacacgctaattggacgaaacaaggccgtccagagcaatcgagtcgagtgcaagtggctcgtctcgtggaaaaccccaaacaaaacatggggtctaagaagaaccctcgcgtgagtcgcccacagggttcccatacaccgagtagagaacaacacacgttctttgaggggtaattccaggtggaggccactagggtccacgttctcaatttgacaccttcaacgaaggttcgccgcaatttggcgccaaaattacggagaggttgtcgccgaaggccccgaaggaaaaattgattccaattacccacctttgccacacgttttcattattcggtagggcggccacgtcatttggccccaagaagggggggcctttgtggtttggtgggtgtccccaccacccgtgggttgtcgagattggcgtccaccggtgggttagagagccccttgggaaaagcccggggtgcgcatagagggccctttccgacctcctcggggggggcgcaatttggggcccccctttattcccccggttgggttgtccccccatccaaacctttgtgtcaccacaaagaaacagggggtttgtgtttcaacagggccatcggggaatatggcggaccccacccgttttgtaaccctcggtttaggccccctcggattaccgttaaagggaaccaaaaaaacacatttccgtgtgggcgcncaccaatagatttacgttttgagaaacttcggaaaacgaggttccccaccaatcgccaccaattgtggggtcagggcctctcagagaaaaggcggccccatttaggagggcgcggattcacacgaggaaaaggggggggggaacccccggccgccgatttccacaaagaccgcggcgggtgtcgacaactgtttccccctttgttgtgggtgggcgctttaaacacaagaagcggtctggggcacacagagccatgacctgcagaagg

SEQ ID NO: 597633 - DNA, 916 bp, Homo sapiens
ttctggccccaatatgaaatgtggtttctcatggtgaatgtgccaggagatcccccctagcccttgtgtgacccccaacacaatctgtggtctcccaaaagagaggttggcgtgcccattacccacaggtttacacggtaacacacaaggggggagaatctcttggagggaccccgacaccatggtggcccacggagaacgtgtgataacatgcggcgctttattctccccacagagcaacgctgtttgtggccacacccccacagttgcccccgctggttttcgcgagaatcttgtgcgcctcggggtcgccactgctcaccttctgtcccaggagaccccggaagaacaccctgtaagagacccgttgccgcggattctctggagaccacaggggttttctccgcggctggcggtgaccactctgttttcctcaccacaggcactctgtgggtgagagagattccgcgcgctggctctatagtgcttccctgtgaatcttctttcacaagagaaaagaaatttttacatgtgggcgctatatttcccccactgagaccacgcgggccaacttttgtttcataacggacactatccgcggcgtggttcacttttgcccacacccgcctcccacgggttcctcccacagcgggaacctcggaggacacgcgaggccacacgccaacgacagggattggggggtaagtgggtatacaccccggctgggcccccccacaggaggtcaccacagaagagggcccccccacagaagaactcggggaacacacccttttgaagacaggggcccccgggggcatttcactgccccgccacatgtggggaaggggttcttaggcctccaaaggcggttcccacccctttaagttttccccattaaaccctttttaaaacccca

SEQ ID NO: 597634 - DNA, 192 bp, Homo sapiens
  misc_feature (6)..(6): n is a, c, g, or t
  misc_feature (95)..(95): n is a, c, g, or t
  misc_feature (169)..(169): n is a, c, g, or t
  misc_feature (188)..(188): n is a, c, g, or t
taattntcctctttaacattaaaaattggctctccctctccctctccctctccctctccgtctccccacggtctccctctccctctctccacggnctccctctgatgccgagctgaagctggacggtactgctgcctgattctcctgcctcagcctgccgactgcctgnaattgcaggtgcgcgccgncacg

SEQ ID NO: 597635 - DNA, 233 bp, Homo sapiens
ccagcgaggggcacccttcctctgtgccccagtgggattcaccgtcgatctcgctggctgaatgaagaagaccctgttactgcagaacctgccaagtctgtcatcactgcttggggtgtagcctgcctcagagggccctccaatcacctctctgagctcaatggttattttgagatttaatttttaactttcacccttcccctcaggagatttaacatttttgggaatgtatt

SEQ ID NO: 597636 - DNA, 509 bp, Homo sapiens
  misc_feature (103)..(103): n is a, c, g, or t
ttattcccaccacccaaaggaatctccacacacttaaccttctcattatcttatgattattataatatccctattttatatatggactgaggctcaaaaaaangcagagctgcctatatagaatcagacatagaacaaaatcaaagccaagatttactataaacagttattgattttggtgttaaaagcattttgttactaatgagaaatcaattctaaataatatggaggtcgggtgtggtggctcatgcttgtaatcccagcactttgggaggtcgaggcaggtggatcacttgagaccaggagtttgagaccagcctggccaacatggcagaatcctatttctactaaaaatacaaaaattaaccgagtgtggtgacaggcacctgtagtctcagctacgtgggaggctgaggcaggagaatcacttgcacccaggaggtggagggtgcagtgagcggagaatcgtgccattgcactccagcctgggcaacaagagtgaaactctg

SEQ ID NO: 597637 - DNA, 461 bp, Homo sapiens
ttacttgaacacggtatgaacagtaggacacataagataggacagaagtaggatgaacactcctagctatatgtagcaagtgaatatcaactacctgggtttgctatgtacagggcctcttatccctctgttaccattccttggtaaatacatggaacgagctttgatatatgagcccttttctcgttttggctttcctctacctcaggcgtgctcctcctcatttcatttctgtcacccttactctgcttgactggtcaatattagcgaacctcacatagctcactcctggatctttctctatacattcttcctcggtaatcttaccctgcccatgtgccttcatttcaataggaactgtgaaacaatgaacatcagacgataatctctagcctctgcccctctcctaaaggacaagactgttatcaattcatctaaaaaatatatctactcaacaactg

SEQ ID NO: 597638 - DNA, 1225 bp, Homo sapiens
tggtgggtgttgtgtggttgggggttgcgtcttttcgactttaggtgctggtctggtgttgaaggggcgttgtcggtggtcgcgtgctgttggtggggcctgctcgctcggtggtgcgttgttgcggcgtcgcttgtgtcgcggggcgcggggggggggggttgctagggggaggggtttgtcacgaggtggtggggggagtcggcgcgcagtgtgtttccgcggctcgttgttgtgctcgcgtggtgagttcggctctggtgtgggcatgttcgcccggtgtgtgggggggccggtccggcctgtgcgcccagtgttgaacagcctgtgggtgtggcggtccaggccggttgcccccgtaggcgcgggggcaaagggggtttggcgcatgtattccagcgctggggttgcgctgtagtttgggggggacccgtggtgtatgtagagtgggggggtgccgcagcgcgagtgggggtttccaggcgtgttggcgttcgtgtaaccgttttgttagcccgcggttgtaagtgttggggcgctggcccccgtgagaggagggccggggcacatggagctccctggcgatagtgcggaggggatgagccccgtgttggggagcgtttgatatttgttatgtagatcggccgagccaggtgaccgtgtaccgaagcgcgccccagtgtctcgtataacggtgtcccgaaccgctgcatgtggagaaagttgtccggtttgtgggcggagccctcggagaagccaggagacacccaacctctcctgagcgccagtacaaatgcttaaagagctgttctcagcccagtgccaaagccggactgactttaacctccaattgatacccgatgaacttggaccctcacgggcacccagtttacccttagggataaaccaggcgccaatcgcttatttcttagagtcccataatccacccatagggtttacgagcctcgaatgttggatcacggaacactcccgagtggtgcacgccgctattaaaggttcgtttgttcacacgattaaagtcctaacgtgatctgagttcagagccggagtaatccacggtcggtttctatctacttcacaattcctccctgtacgagaaggacccagagaaataaggcctacttccccaagcgccttcccccgtaaatgatatcatttcaacttagtattatacccccaccccccccagaacccgggtttgtta

SEQ ID NO: 597639 - DNA, 310 bp, Homo sapiens
actgaccagcagtatacagactcaccaagcacagacttgcttccacaagcacgtcttaccttagccacgaaggtcccaaagccacacggtctaaagggttgacccccaaagattatgtccggggtataaaacaaattaccagggggaccagttacctccaatacaaggtcaaaatcagcaacaggtcctacaacccagtgctgatatcagatacaagctccagggccaattcctttcacgaaggctaatcccagttccgtgaggctagcatgaggtggtgtgcatttcgcaggggcgaattccaatcctc

SEQ ID NO: 597640 - DNA, 641 bp, Homo sapiens
  misc_feature (26)..(26): n is a, c, g, or t
  misc_feature (537)..(537): n is a, c, g, or t
  misc_feature (588)..(588): n is a, c, g, or t
  misc_feature (640)..(640): n is a, c, g, or t
ttcctttatttattagaaattttctncagagtagcattcagggtctttggagaaatgatttagaaaatgactcctgaaggtagagtttattttatgaaaaaggatttcagaaaatgtctttagaccctggtttacagaaaaatctacaaaaaaaatcaataacaataatagaagtatgtagtagattactttagcccttctttattaacaattttcactctgagatgacttgaaatgccttataggaaacactgataaaaatcagactggcaaagaccttggcagatatagtcaatataacatttggatttgagctctgtggtaggcaaagaagagtatataaatttacccaaacatatgaaagcaggccacgtgctttcagaggtaaaaacttaactccagtttttaaggcgaacttctaaattttgtcttattacctgtttgacatcgtaaaagatttagaggtgaaagagtatccgggaaattttagccttaaagctgcccatcaggaccaggaacccagagttgcagctccgnggtggctccgggctgcccattgggatacccggggattagagcctgttagcncagtggtcctccagaaccttaatttccccaagagagtccgataatgggcccnt

SEQ ID NO: 597641 - DNA, 185 bp, Homo sapiens
actagaggtccctttgttgaatgaagtgaatcaatcactaactctgtgatataccaatatatcactatgatgtgcttgtgtcattgcctgtattgtacttggaaataccttcatcgagacaactagtacggtcactagccctgaccagctactttacagatactctcaactgacctacggtgtac

SEQ ID NO: 597642 - DNA, 202 bp, Homo sapiens
gtccaaagcgtactaccagttactgggactacggcatcacctcacgcccgctattttaatatttcagtagggactcgctttcatccatgctggccttaagtgatccgtccgccttggcctccaaagtgctgggatttcaggcaagcttcaccacacccgacccctcactagtatctcagcatctgggtactacgctttggca

SEQ ID NO: 597643 - DNA, 239 bp, Homo sapiens
ttataactgtggtgtaccgttactgtgagctgtggtgtaggtcgcagaacggtcagatgcacattgctgtggtgtggtgtaggccggtggttacagttctgattgcacccctagcctgggaacctccatatgccacgagtgcagccctgaaagaaaaaaaaagaccaaaagaaaaaaaaaggcagtctccctttccactccagacacactgaatcagaatcttctctggaacaaggtcc

SEQ ID NO: 597644 - DNA, 331 bp, Homo sapiens
aaacgtgtcgtcattgccataagtcctggcgatagcgttttgcacaacttcctctggcgaatcatccgcaaatcaccgttgtagatggcggtgatgagcgtgccgattccgtgctggcaggtctgaaagccgctggcgacgcgcagtgggtattggtgcatgacgccgctcgtccttgtttgcatcaggatgacctcgcgcgattgttggcgttgagcgaaaccagccgcacgggggggatctcgccgcaccagtgcgcgatactatgaaacgtgccgaaccgggaaaaatgccattgctcataccgttgatcgaaacggcttatggcacg

SEQ ID NO: 597645 - DNA, 715 bp, Homo sapiens
gcatttctttatgcctggcttgccccgtctcagcagccgtggaagccgagcgagtatcgagctctcacagggccggaactcacccaggaggtcttcgatgccaagaacatgatggctgcctgtgacccccgccacggcgatacctcaccgtggctgcgtgtcttccgtggtcggatgtccatgagaggaggtcgagtgagcagatgcttaacgtggcagaacaaggaacagcagctactttgtggaatggatcccctgactaagtgtcaagaacagtcgtcctgtgacatcccacctcggtgggcctcaagatggcgagtcaccttcattggtcaatagccacagccattccaggagctcttctgagcgcatctcggagcagttcactgccatgttccgcggaaggccttcctccactggtacacaggcgagggcatggacgagatggagtgcaccggaaggctgagagcaacgtgaggcgacgtcgtgtctgagtatcagcagtaccatggatgccaccgcgatgaagtaggaggaggatttcggtgaaggaggccgactgaggagggctaatgcagagcccccatcaactcaggcttctcagtcccttggcgtttactcagactggccctttcctcttcgctcagaacttattggacctgatgagatcgtcccgagtagcccgattgcatgggattggaaaccagggaggcaa

SEQ ID NO: 597646 - DNA, 113 bp, Homo sapiens
acgcagtggtcgctcacgctccagaacaccagccaggagagggaggtctcggtctaggacaccaagacgaggaagaagactggggaagtttctcgggagacttaggtggtgaa

SEQ ID NO: 597647 - DNA, 671 bp, Homo sapiens
agacaagcttcacccaaagccactttacccataataaagctataggcgatacaaattgaaatcctggcgcaagtagatatagtaccgcaagggaaagatgaaaaagttataaccaacgcataactatagcaaggactaagcccctagtaccttctgcataatgaattaactgagaaataacttgtgcacaggtagagccaagaggctatagacccccgaataccatgacgagctatcctatagtaacagtctacatgagagcacacccgtctatgtagcatagatagtgtggacagatttataggtcgaggcgacgaacctaccgagcctggtgatagctggttgtccaagagtagaagtcttagttcaactttataattggcccacagaaccctctaaatccccttggtgaactttaactgttagtccaaagaggaacagctctttggacacctaggacaaaaagcctgggtacgagcagtagtaagaacaatttaacacccagtagtaggcctaaaagcagccaccaattaagaaagcgttcaagctcaacacccgactacctaaaggatcccaagcatatactgaactcctcaggaccgattggtaccaatctatcagcctataggaagaactaatgttcgcctaagtccacatgaagacgtttctca

SEQ ID NO: 597648 - DNA, 984 bp, Homo sapiens
ggccgtcctttgtttgattttattttttctgaccagaagcgcattatattaccaaaccaattatatttcttagagttcaaaaccgttcgtggtgagaaatcgttctcgtggccgtggtgggagaatccacctttcttcttatatttttttggagaacgggagttttggctctggtgtggctcaggagtggaagtgcaacgtgacggtaatctctcagctctccagcgtgaacacctctctgtgcctctccagtgggttctcaagtgtgattcctcctgtgccttcagccctccggaagatagcgtgggacttatgaggcgtgtgtgtgccaccagtgccgtggcttaattatgtatggggttattttatagttaagaagacacagcaggtttcctctcccaagtgtgttggctcagaggctgtgggatcctttaaaactctcctgtgcaccctccgaggggtgcatcccgccctgtgcccttttacaaacaacaagagtgtgggtggagaattttacagggtcgattgtagaacccacgcaagcgccccgcggccagaggggagaactccgagactcttcgtatagagcccttccaaactcttccaaatttttcagaaggatacgtggggggggttcgagagtattaaaggtggattaagcgggaagcgttaaacacaatttctttgcgccggtcgcgttgtggcgtgtaaagtctatcttggcccaatcagaggaaatgtgaaagggcaaacccatggtgtgaaatgaagggtccccaaaagttgacacctctgaggaagttcgtagccaaaaacgttctttcatcccaaaggcgcacacagactgggaaaggaaccccgtggggccctcaaaaacctgggcaaaaaccccggggggagagaggcgaaagcgagccaaccactcaccagggtgggatcccgaggacaaacagagagccaggggacaccaacgaagtggcacaa

SEQ ID NO: 597649 - DNA, 82 bp, Homo sapiens
agccaacgcccctaccctttaattctgcctttttcttccgttcattgtgaggaaaaataaaactggttgagaaaaaaaaaaa

SEQ ID NO: 597650 - DNA, 106 bp, Homo sapiens
tccgggcataccggggcaaaaggaagccccaagggaagcccgcagaaacaggatgttgaaaagaaaaaatgaaagccctcctggggacttggaatcaggcggcttc

SEQ ID NO: 597651 - DNA, 744 bp, Homo sapiens
gcgcctcgccgccgtaggccccactggatcctacaactacttattccctcttttgctcacgcacctctgaagaactgtgtgctccctgctgggaagctgcacggggctgcgctaactgaagcgaaaggtgcgcggtcccagccgcgggatccctgctctacagtgcagctgtgctcctgcacgacccgtggccctcgcagctgatggctgagtgctgcacatgctgctggtgtgtgtgcaacttcgcattcaacccctggtgctgctgtgtgctgtggctgcacgcacttgtctgtgctctacctgtacctggtctgatgccctgatgcccgtgactgttagacttgtcaacctgcatccacatttgcgctggtcctgcctgttctgtgatggtgcttgctgctgcgtgtgtgctttgcttgtgacttctctgtgtgaccttggcctgcgccgcaacgcacttattcggctcgaatttggttgcgggtgcacttccagactggcgtgtctaatccttattcgacggtggacatttgtccgggactatccgaccgacgctgaagctctccacagttggacacgctggccgtgtacggcccatttggcgtcgctgtctgatccccaccacgggaagcggcaccgcacttgtgggcgccttgaaggggatccttacccacttttggacccccttggtatattccactacggcagaaacccacgggacacccccggataccgggtcta

SEQ ID NO: 597652 - DNA, 392 bp, Homo sapiens
gatccggtgacttctgctctggagtgcatgatactcagtaagggcatttcttttatcatcagcaagggtaaaaagacagctggaagctggaggagtcacctgaatttctggcattcaacttctcttctgtggcacaaagcacaaaataaggagggatgttcctgcggggtgtgtatctgcacaatgctgcaacctccttctccagaaacttgatgagcagagcactgaacagggttgagctcccaatcaccagggaatcctctgggtacacgaacagggagggcctcaggtaatggtgtttcttcagcagtaccaacggcttgaaacccatgagcatcaaacctggatcatcaaaccgttttagctcttctgtttcctcctttctccagtat

SEQ ID NO: 597653 - DNA, 167 bp, Homo sapiens
  misc_feature (25)..(25): n is a, c, g, or t
  misc_feature (49)..(49): n is a, c, g, or t
  misc_feature (117)..(117): n is a, c, g, or t
  misc_feature (134)..(134): n is a, c, g, or t
  misc_feature (149)..(149): n is a, c, g, or t
cagaagtcaccttctttcgtgaatnttttgattccctgaggctactttnttttggtatggctgaaaaatcctagattttttaaacaaaacctgtttgattcttggttctgatatggnctaggagagagactggntcaagtaagcttatntccctgaggctgtttcct

SEQ ID NO: 597654 - DNA, 805 bp, Homo sapiens
  misc_feature (18)..(18): n is a, c, g, or t
  misc_feature (108)..(108): n is a, c, g, or t
  misc_feature (122)..(122): n is a, c, g, or t
  misc_feature (126)..(126): n is a, c, g, or t
  misc_feature (140)..(140): n is a, c, g, or t
  misc_feature (142)..(142): n is a, c, g, or t
  misc_feature (163)..(163): n is a, c, g, or t
  misc_feature (169)..(169): n is a, c, g, or t
  misc_feature (172)..(173): n is a, c, g, or t
  misc_feature (191)..(191): n is a, c, g, or t
  misc_feature (196)..(196): n is a, c, g, or t
  misc_feature (215)..(215): n is a, c, g, or t
  misc_feature (217)..(217): n is a, c, g, or t
  misc_feature (226)..(226): n is a, c, g, or t
  misc_feature (270)..(270): n is a, c, g, or t
  misc_feature (300)..(300): n is a, c, g, or t
  misc_feature (302)..(302): n is a, c, g, or t
  misc_feature (331)..(331): n is a, c, g, or t
  misc_feature (337)..(337): n is a, c, g, or t
  misc_feature (349)..(349): n is a, c, g, or t
  misc_feature (383)..(383): n is a, c, g, or t
  misc_feature (414)..(414): n is a, c, g, or t
  misc_feature (418)..(418): n is a, c, g, or t
  misc_feature (434)..(434): n is a, c, g, or t
  misc_feature (449)..(449): n is a, c, g, or t
  misc_feature (470)..(470): n is a, c, g, or t
  misc_feature (518)..(518): n is a, c, g, or t
  misc_feature (524)..(524): n is a, c, g, or t
  misc_feature (532)..(532): n is a, c, g, or t
  misc_feature (536)..(536): n is a, c, g, or t
  misc_feature (563)..(563): n is a, c, g, or t
agattccaattcagatcntggagctgggcctgctactcacctccccagtaaatgtccaggcagcattggacagagaggctggccccgccctgacgggggctgaagaanaggcccccagcagncttnttgttgggctactnancacttcagagagttgggaggncctggnacnnttgccccagatccatgtnccttntgtttggggtacacctgantngcctctaanagcaactgattggtacaaagagagaatccaaatgttggcatcanaaaccttaagtatggagcagggagcaagtncntgggggatgtttgccccatcttataaatnaatagntctcgtaatgtntctggatttttggagatgggaagaaatggccaantaacagcatcctcattcccaaatctactganaacnaactacggtggaaaanaaaatcaggggatgnatgggtgtgcgcctcagtttncctctactgcccccaaactgactaatccaggagtttcccaaaagggangggganatgagganatangcatgcaaatgccatttggagattttnagctattctggccattatcccatttcagagcacaccagacaggaagggcaaagaggtcccatcatgagtgccaaattgattggtactggctgcccagaacactgtgctgggaagaattctgacatcacccatgtgctgcacttgattggtgatgtctgccatggtcacagccattcaccatccctcatcttcaagctgggctgtcccctttccctgaaccagagacaattcaccagcctgga

SEQ ID NO: 597655 - DNA, 930 bp, Homo sapiens
gaaggaacgagagggcggttctctggatgctgattgccgttcgctgtgccctaggaggccgagctctgtagcttcctacatctccatggtgtcacacctggtcatatctcaggatgcttcagcgatgcgagctatcccagaatggttgtcggaagatgcacgctacatacaactggtggaccgagtccatccagtatctggtcgtccaaggattgcatctcaaccaacatgagagctcaggcgagagtggtggtcaagatgtcctagctaccgtgggatctgattcgcggctgcttatgtgaatcctctgctctgtgactgagtagtattccctggtttgcagccctcacggcttcatggtcattggggcattggagcaaggtggtcagtgagtattgtgcatgggagaatgcccttggaaagagagctggcgatggcaagggcttgcgggacttacacgcatttagcgcttgagcttgtggtaagatatattgaaactatcaaggatgtgggcatttcgagaaagatgtcgcagtgttgtggaacgcctctgagcttttgggacttcatacttggcagactggatgtatgctctatgccaacttgttggtcaggccattgagctgcacataaggaagaaataccgatgagtcattgctgacagctactatcttatgacaagatagtttcggactgatctaggggaaggtgggaggaataattaagtggagatgagtgatttcgcggaaggggttgtcccggtgtgtgaatacgtgtactagatgaatagcttgcgataatttagtgtaaggaaaattattaaatgggtggaatcttgggggaaggcggaactcatgaaaatgaaaagggtgaaccaaggaccggtaagggaagagggaacaagggagaaggaaggtttacatttatatg

SEQ ID NO: 597656 - DNA, 1047 bp, Homo sapiens
agcggagtttctctaagtccggagctgaaaaaggatcctgactgaaagatagaggcattgaggagcctgaagattctcaggttttaaagacgctagagtgccaaaagaagacgttggaagctgtgaaaacagtttccgtgagtggaagaggcgaggaggggacaaaaaaaaaccaaaccagcacaagagaaaaaaacaccaagaaacccacaaaaaacaaaaaaaaaaaacaaccaccaaaaaacaaaaaaaccaaaggagacagagctagagaaacgacccagagaccctgagagaggaactagagggaaacgcgaacaagcccgagacagtcagtgaaggtaaagcaaggacagaggcaaggaaagaaacgagaaagagcccaaggaagaagaagaaatgagcgagggaagaaggatagttgaggatacccaaatacagtataaagagaataagtgagtataaatgactgtataatgaagtagaaccaagtaaaaaggactatagtgataaaaagattactgaaatgtgactagtgaactaataggagttaatgaaaattatctgaaaagaattagaatttagtaatgaggaaataaatgtagttcctagagttagagttgacagattcagaagtacgacgtagaaaagtgagtgagctgattaaaaataatgctactagtagaaattgaagtgactgtacagaagtctcaagtagtccttaatcggaagtgataatgtaaaaaatgtctccaattattaaaaaacagttgtagtaaaagaactgtgtcagtgactaagctgtcaataaataataaactactaaacataagtaatcaatcagaaaaatttacagatctaccgaaaatttaccaagattacataatgtaaactatagaattttattagccagttgacttgagatagtgaatcctgaatgagttaagttctatgaatgtattttattaccattgtagtgtatatagaccctgatgtcaagatgtgaaggaaatctgctaatttggtattgaagaatggtttctatag

SEQ ID NO: 597657 - DNA, 137 bp, Homo sapiens
acgtcacgccagtcagaccgtatatgtcaagaattaagcgtactggcggtaaacccagaggcattgagaacagggttcgtagaatattcaagatctggccctgtaatcttctacgaaccctgttgtcaacgcctccg

SEQ ID NO: 597658 - DNA, 703 bp, Homo sapiens
cttacattctgcgctcgttttctctcctcatccttcttacgctctggttaccccgccccctcccatgcccttttagactccccaggcccctctcatggcgtaagttgccccaaccctagacccgggttctcgatgacccacccttgtcctaggcattcagcctcgtctccattcggcgcctttgtagcctatctctcactgcagcttagcatccctcccagatcaccctcagacctttctgctccgtgtctgccgattgtgaaatggctgctgacatttctgaatccagcggggatgacttgcaacaggagaccaaggaacgagagccaagtttagatgccgattacccaccttccgagttcctttattagtggagtctgttacattaccaacagagctacctgtcactatctgcctgatgtcgctccacaagtagaaccacaggccagagacgacatatcccaaccttgaatcttgcaccaacttactggtacaaactcacccaaaccacaaaagctgcacgtaccgtgaggcgtccacgaacccgcgggacagcacgcgcgacaagcaccacaccacaacgacacgctgcacggcgccacatcaccaaccacaccgcagaccgaccaccacacagtcacactcgcaaactccccgacccacaccactcagtgcacccaacactgcccgcccaccccgccag

SEQ ID NO: 597659 - DNA, 963 bp, Homo sapiens
tggaaacggaatctcgctctgtcacccaggctggattacaagggcccggtcccggctcactcaacctccatttcccaggtttcaagcgattctccgtggcctcaggcttcccaagttagcgtgggaactacgagggtgcgttgccacacccggctaatttctttatttatatagtagaaggaacggggtttcaccatgttgggctaggtgggtctcgaaactcctgaccttgtgatccgcccacctttggccttcccaaaggtgcgtgggattacaggcgttgagccaccgtggcccagcccagggtgggctttctcaggaagccagtggaagcagagacagtgcttttccttttatacccatactctactggtgaacttggacaaaatacacgtgggggctctgggctggaaggcagattcctacaagtcccctcctcgtggaggaagctaaacagcaaaggcatcgagcggcccttgcccgctctccttttgggtgtgtatatccgaagaaacacaggaacagctgtccttctttcagtcattccaattaaaacagacttttggcttagagagaataccagcccactgggttctctgggtttaataatgggcgtcagctaggactatacgtggccttaaacgtcatgcactgatggccacgaagagacaaccgcggtgatcaaaataggcacaagggcggggcacacgaggaccgcgcagtgaacaatttgttatctaaaaactcttctaaattgatacggtaagtttgggcatttttaaattcaatgcccccatccagaccccttaaaggttccaaccaaagttgagagggtcacggcgtgacccggcccagtggttcctggactccgctcacaaggtggtgtcaaaggcaggttgtgtcgtaaatcctttgtatggtgtcacatgttcactttccttaacataatgggtctgactctaa

SEQ ID NO: 597660 - DNA, 202 bp, Homo sapiens
  misc_feature (23)..(23): n is a, c, g, or t
ggtgacctagaggatccccaggncttttcccctcaaagcacgctataagctgcatcccataagtatgatatatagtatcattttcattctgtctcaaaatatttcctttattattcttatgggggggactcctctcctgtcccccagggttgaatgggaacctgggcccggggaaccttcggcttgggggttccagccattt

SEQ ID NO: 597661 - DNA, 360 bp, Homo sapiens
ctgcaaagcattcttaaccctgaagcctatgtgcccatcaccagctctacagacactgctcacactaaactaccgaaccacaaacacacaccgaaacatcctgcttaccactcctgggtgcatgattgatgctgaagcatccaccagctcttcaagggtaccatagcatttgaatttgggctgtctcaatgtccccaaagcctgcgagctgcagtggcagtcgatggatgccattcaatcaatgaagaccttcactgtgacatcaaggcacaatgtaccccatgattacacactagaatctttatccttaactaaatcatatgcccaccctgcgcattgacctgtaccttgactgtggtg

SEQ ID NO: 597662 - DNA, 307 bp, Homo sapiens
tgtgaaagcacacttggcgtaatcacacaaaaggttcgcgagcaattttacgaactgacccgtaaagctttagcccagtttctgaatgatcaaatcaacgatcgtctgaagtccgcaatgagcggcgttattcaaccctcgctagcatcaatacccgttacaaacagcgcgaaggcagacgcacaagaacgagatgaagcagaagataaaattctgacgacgctggaagagctggagggttatcacattgtccgggctgttgtacgctcagtggtcgatgcaaaacgaatcgtacaaagggggtgtg

SEQ ID NO: 597663 - DNA, 214 bp, Homo sapiens
acggaccgttgttgcggccatgcaagacggggcgcagcgtgcttgagtcgtgaagtattggaaaaaatcggtatcgcgatggataaagtcgatactgatgcccatgggcgcgaactctcgaaccctgccgccgccggccagtactgcggcgacctggggcagtggattccgatggcatccagcacgttcgatccgggtgcactcgagttggcgg

SEQ ID NO: 597664 - DNA, 247 bp, Homo sapiens
cggaccgcgggtcgagagcgaggtcatccgcgccatgatgaccatgcgcctcaagacgatggcatctggccacaccggcgtacgtccgaaggtcgtcactgcctacgccgatctgcttaactccgggctcgtcccagtcgtgggggaatatgggtctcttggctgttcgggcgacctcgccccgctagcccactgtgccctcgtcctgaccggcgaagggaccgtcctcacccctgacggtgacgaa

SEQ ID NO: 597665 - DNA, 295 bp, Homo sapiens
ggctccgggacggctggagtggtaaaaggctcagaaaaatcctgcgacgtaaaaccacttctgaggtaatcaataggatgatcccgtatcgaaggccttacaccgggacaggaggagtgtgttgccctcccacctgtgccctcctcctgccaatccaagaagccgccacctacatcgcgcagccgacagacccaaaacaacacatctcatcattctaacactcggcaatgtaaccactattcgactgacacaatacacatctcacgtagaccaacataccacaaacagatccaaa

SEQ ID NO: 597666 - DNA, 714 bp, Homo sapiens
tttcgccgaacaatcattgtacccccacggggggtctatagggcaacatgatgccaattttgttcccccgcgcggccaatttggccgatggggccagcaaatgaggtatagctgcccaatcgaatcaaacaagtagtgtgacgaaccagagaagagtgtaaataaaagtatttgtatccctcacccccccattatgtttgctatctacagtaatccgcccgcccgtcccacacactatttggatgtgcctcgtcctcgcggatagctggatggcctctcggattcccccccggttgtcctcgcttattataggtgttcgtggcgggctttctctcgtgccgcctttatgtgagggctggttggcgcctccgcgctgccctcagcgccccctggccttatggagtctgtttgtctcgctcgccgtcgcggcgctcgcacgtagtgtcgtgaccctcgctggctcgcgggcttctccctccctctggttgagacgactctctcccgtcgcctcagcgtgagctttcaccctgcggcgctcgcccctttcctctacagtatcttgccctctcacacatattcttctttccatttttacaaaattctctcttctccactaccatctccctctctcgcctcaatgtgtgatgtgaaacacccaaattataaaactatcacctccaccccacctcctcccacaacaatagacagaaaaac

SEQ ID NO: 597667 - DNA, 96 bp, Homo sapiens
  misc_feature (28)..(28): n is a, c, g, or t
gccagcaccaaccagacatctatgtacntctgtgccagcagttgcaggggaaccggggagctgttttttggagaaggctctaggctgaccgtactg

SEQ ID NO: 597668 - DNA, 97 bp, Homo sapiens
  misc_feature (28)..(28): n is a, c, g, or t
gccagcaccaaccagacatctatgtacntctgtgccagcagttactcggggggggcgcacgagcagtacttcgggccgggcaccaggctcacggtca

SEQ ID NO: 597669 - DNA, 481 bp, Homo sapiens
  misc_feature (1)..(1): n is a, c, g, or t
  misc_feature (66)..(66): n is a, c, g, or t
  misc_feature (83)..(83): n is a, c, g, or t
  misc_feature (86)..(86): n is a, c, g, or t
  misc_feature (178)..(178): n is a, c, g, or t
  misc_feature (268)..(268): n is a, c, g, or t
  misc_feature (287)..(287): n is a, c, g, or t
  misc_feature (296)..(296): n is a, c, g, or t
  misc_feature (307)..(307): n is a, c, g, or t
  misc_feature (311)..(311): n is a, c, g, or t
  misc_feature (339)..(339): n is a, c, g, or t
  misc_feature (361)..(361): n is a, c, g, or t
  misc_feature (369)..(369): n is a, c, g, or t
  misc_feature (378)..(378): n is a, c, g, or t
  misc_feature (382)..(382): n is a, c, g, or t
  misc_feature (391)..(391): n is a, c, g, or t
  misc_feature (406)..(406): n is a, c, g, or t
  misc_feature (413)..(413): n is a, c, g, or t
  misc_feature (427)..(427): n is a, c, g, or t
  misc_feature (442)..(442): n is a, c, g, or t
  misc_feature (465)..(465): n is a, c, g, or t
  misc_feature (470)..(470): n is a, c, g, or t
  misc_feature (472)..(472): n is a, c, g, or t
ncgaacaaatagaaaagaataacaaaaaagaggcaggaaccggaccggaaatacccgggaacgganaacacgccggcataacnaanaccacggagtctgcagcaccctccgcatccactccgaggcgacgagacccagtggcaagaagttcaccatgtcaatactcaagaaccaagcnagggagatcatagactctcgcgggaaacccacagaagaggaagaacactacacctcaaaaggactctacagagcagcagtgcccagtggngcatcaacaggaaacaaanaggcccaanagcaccggganaaanaaaagacacgcaaaaaggggaagggggnctcaaaggcagtagagcacaanaaaaaaanaaaagcgcnagcnctggaaagnaagaaacagaacganacagaanaagagaagaaaganaaacagaagaacganaaggaaggaacagaaaaaaaaanaaagnanggagcgaac

SEQ ID NO: 597670 - DNA, 84 bp, Homo sapiens
agcatatatctctgcagcgttcccgggactagcaggggaaccggggagctgttttttggagaaggctctaggctgaccgtactg

SEQ ID NO: 597671 - DNA, 108 bp, Homo sapiens
gactgctgatatgactgctttcactgaggtcactgattgtcatattgccagctttgtaaagccattacagcagaagtttcttcagtgatcttctctctaagaaacacc

SEQ ID NO: 597672 - DNA, 505 bp, Homo sapiens
catctcttgaccggggtgttctcaccatgccctttctacaaacaaaaaaatgaagatgtggagacttggagacaggtggcacctcgtgcttcctccgaagggagagcccatttcctaacagctggatcaaaggcatgaaatgaacatggagtccctgaagatgaagagaaggcatggcttccagggagaaattgtacattacaggaatgcagatgtgattcctatggatgagggtaacctagaggctagaagaacaataggacagaagaagcctgggtacctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataaaaaaaa

SEQ ID NO: 597673 - DNA, 381 bp, Homo sapiens
atgcctgatccagctaagtccgctcccgccccgaagaagggctccaagaaggcggtgaccaaggcgcagaagaaggatggcaagaagcgtaaacgcagccgcaaggagagctactccgtatacgtttacaaggtgctgaagcaagtccaccccgacaccggcatctcctccaaagccatggggatcatgaattcctttgtcaacgatatcttcgagcgcatcgccggcgaggcttcccgcctggctcattacaacaagcgttcgaccattacctccagggagatccagacagccgtgcgcctgctgctgcctggggaactggccaagcacgccgtgtccgagggcactaaggccgtcaccaagtacaccagctccaaataa

SEQ ID NO: 597674 - DNA, 366 bp, Homo sapiens
cagactaccgaacggaaccacgataccatcttcacattccgattcaacatgactacatggaatcgatactggagaacccagtccatgacttaggatccatgggtccctccagactcccattccatggacgtacacgtcttgagggaatccacatggttcgttcatctcctgcaaaaacacaagcataccctcaaccccacattagtaaatctactgaaacagaagcaacaactgtcgtgactgtagctagggaggccactgatattgagaaacaggcccttccaacagaaggcaccaggaaagcaaatcaaggcttaaaagcaatccttaaaccttcaatatgcactgtacgggtgggtccactag

SEQ ID NO: 597675 - DNA, 352 bp, Homo sapiens
  misc_feature (76)..(76): n is a, c, g, or t
cggcacgcgaaacgccgaatacacttaacagcaccaaaaaaaaaccttgttgcgacaagcagagtgtttccggggntacgggaacctagaggctagaagaacaataggacagaagaagcctgggtacctgaacaaccttgtggagcatagacacctacgtggcctggactgccagctcacaatgggcctctctgtgagagaaggaaacttccctcttgtttaagcaactgtgcttttgagaatctcttggtctataccctaatgaataaggccatcataaatggatatcaaagtaaggaaatttgtgtaaatgatttaataaaacattacctcaggtatgaaataaaaaaaa

SEQ ID NO: 597676 - DNA, 114 bp, Homo sapiens
tcgaatcgacggttctctcagcttattgactggctcctaagtaggcctagatgatttactcttggcatggaaagcttgtctaggtcctctgcttgtgagggtcaaagctgtgtc

SEQ ID NO: 597677 - DNA, 322 bp, Homo sapiens
ggccctccggtttttttttcaggggggggggggctgggggttccccaacccttccaaacccggggggctgccctttttccccaagggaggggggctcccccccttgggggtcattcaaacttttggggttaggggcccccgggggggatttttgggggtccccatcaagggaaccgggggtccctgggccaattacgggaacaggggttggcccagggcccgggaggcctggggttttaacccccccgcctggttctggccccggctggcccccccccgccccgccggcccggatggtttaagaaagctgtttcctctttga

SEQ ID NO: 597678 - DNA, 232 bp, Homo sapiens
gaacgggtgatgcggttgcattgagctgagatcgtgccactgcattccagcctgggcgacagagctgagactccatctcaaaaaaaaaaaaaaaaaaagaaggggttctctcttttttgggccgggttgtttttaaccccttaacttcgggaaaccccccggcttgggcctcccaaggtgcgggggataacgagggcttgagccatgtggcgcccaaacgggattcaccggg

SEQ ID NO: 597679 - DNA, 1293 bp, Homo sapiens
gaaccaaatgtgtccttgtttgtagaagcagctcacagaggtgcacgcgtttgtgtttggactggagtgcggcccgactgtttatgggcctcgcccctgttgtgaaagccaacgaagcgggggtgggtaggccgccacccgaagttcgaccgtgggcggtgccgacaatatttgggtgtgacggttgctccacacgcaccagtgtatcatttgctgtggggaaaaatatttatgggccgcgcctgccctgttattcgggcgctaaattgtatattgacggcgcccttctagacactctgcaagtttgggctcaaaactgctcccctcgtggtgaccgctgtaatcccccttttttggcgcgtatcccccccgcttaccacatctggtggacgcataattccccccctatttgagcgggcacattaacttttatttctgccaaggcctgcgctaattctggcctttacgcgcaccgtgacctaggaacccctttgtaatatattctcggcgttcacaattcggcacataaccttgtgtgtgccgaaatgctgacgcccgcaacatatttacgcccccctttctggttatgtcttaacccacgcccccatgttgggtgcgaattcccccctagactcccccctgtaaggttgtctacctggctcacaaggtcaagttctctcaatatagtctcgcccacatccgtgacctttacaaatcacgctcaatatttaccgttatctccctggcacattccgcactaatcgctctcttacgcttacccgtgtacacgcaccggtcacacagttcgccactccactatatccctctctctctccacaggagacttcgcaaccttctcacactccccccctctatagactcttcttggagtgacatcttcttgtcatatgtctctccctacacccttgtccacttagcccccccaacctatttataccctatcctggcgagaacttcttctcgtgtctatgttacccccgcttttcctcgactcaaactattcacctttctcctaccttacaccggatctcacaccactacctcacgctccacacgcccgtattacctccctctctaacactactttaccacccagcacccactgcgcgcgcctcactctatcccacccaccagttacacacacttaatcccctcaccttcacccccgccgccacaccacccctcacatgttctattcaccctattcccccattttcacatcacatatcacaatcaaacacccagacatcattaccagggttttccctctta

SEQ ID NO: 597680 - DNA, 1014 bp, Homo sapiens
  misc_feature (87)..(87): n is a, c, g, or t
  misc_feature (259)..(259): n is a, c, g, or t
tgggtaagatattggaaatacaacctttattctggattctaaacgaaaagggaatggggaatggacagtaacaaacaaggatttcanccactggaattattggtggatggtggactggcgagcaagtctttattattatggaacacctcaagggaatgcaactggcggtctcacaaaacgggtctaaattatggcagggtcacaaaacaatgagaaggtatattttttataaacgtggcgcaacatttcacttccaganaggccacactcattcttccctttacaggaattccacaacagattagaagcgcacatgtgtctccggcgtataggctaagaataattaatggaggggggcacaccacgcgctggcaccggtgtggaacttcaccagggacagtctggcgctattaaaactaagacttctggaccgctggggcctccagcttcattctccacagggtcatcatcctacatccggggaagaagcatgttggtctggagcaacctctaaagtcgggcccataactggggctggccaaagcggggtccacggaccaacttccggggggggcagagagcagggcagggcaacaaattccaagttagggtgctccaatggagcttcctaggaagccagaggaagggttttcaaagtggtgagttacttgtgggagaaatgtcgtagtactgaaggaatctcttcggggggggacatggatttcgccttcaattcgtgtgcttatatcccttggttgcacaaacacagtggggggtttttccacaattgtaccaattctttgcacgtatgggagacatcttgtagaaacccagggtatataacatttttgtgacccggggggaaaaaaagcatttcacagaatggggggggccacagtaaaaacccgggtggaaaggggacacagggaaatttaaaaaaataagggggcaccaaaaagagcaaaggaaagaaactaggatgaggtagggatttcttttattttttttttccgc

SEQ ID NO: 597681 - DNA, 254 bp, Homo sapiens
tcgtgtgataagctgatgctgcgtcagagtcaacttgtgagtcgcacacactgtgaggtgcgcatcatggcattgttgctttccgctcttgcttgtatcatcagctgtgcctttgccttgttttccaataaacaatcttgtcattcatcccaaacttgcattcaggcatgcccactcaggtagctctctcaatcacccaacagtgaatttcggggtaccgcagcttcgaattccgtaaatccaatgggtccatt

SEQ ID NO: 597682 - DNA, 139 bp, Homo sapiens
gattcggagaggccatccacttaccaccagacaaccttagcaacattaccaataagctaggcgatagacttgatcctggcggaatagatatagtacgcagggagagatgagagattatatccacgcatatctagcatgg

SEQ ID NO: 597683 - DNA, 109 bp, Homo sapiens
cattttagcatcactcttaagtccaaactctcatctcaatatcatctaaatcaggccagatgcaaggactcacacctatatcccagcgttttgaggggaaaagaccctg

SEQ ID NO: 597684 - DNA, 165 bp, Homo sapiens
tcatgtaaacagttgggttcattaccactgagccatgaccggaactcccattgtcttcatctttagaccctctagcctgggaacctccatatgctgagggcgtggcccgattaaaagacaaaaagacacacacacacacaccacagatacggggtacccgagctc

SEQ ID NO: 597685 - DNA, 414 bp, Homo sapiens
  misc_feature (1)..(1): n is a, c, g, or t
  misc_feature (9)..(9): n is a, c, g, or t
  misc_feature (107)..(107): n is a, c, g, or t
  misc_feature (121)..(121): n is a, c, g, or t
  misc_feature (137)..(137): n is a, c, g, or t
  misc_feature (155)..(155): n is a, c, g, or t
  misc_feature (176)..(176): n is a, c, g, or t
  misc_feature (276)..(276): n is a, c, g, or t
  misc_feature (299)..(299): n is a, c, g, or t
  misc_feature (364)..(364): n is a, c, g, or t
  misc_feature (368)..(368): n is a, c, g, or t
  misc_feature (384)..(384): n is a, c, g, or t
ntccgcctncaaatagtcattccctggtagggtggagggtaagacatagggtctggaactgtttggaacctttgggggatgtcctgtgcctcccagattcctcgatnctgggaggagaggntgccgcattctgttgntcctcacagagagcaaantgaacccacttacattcagtntttccctggaactacaaagagtgggaaggcctgggatttgctgctgctcccttagagcagcgcccctcttttcagaacttgggacacctggagacccagncctgttatttaatggtagtgggnaagtgtgtgtgcatacttgtcttgccactgattcttcctgccccatgcagagagcctgtccctgncagnccagctcttagcccanttgggaacaagtgaacatgatcatggtggg

SEQ ID NO: 597686 - DNA, 192 bp, Homo sapiens
gatattcatgactcctgttagtgaggggcaacctcgaaagctcaagcgggggctcccctagagtcgaactgtcgtgcatgctgctagtgtctcagtggcgtatcctaaaaatcgctgtcgccttaatccaagcctacgttttcacacttctagtaagcctctactaaccaacacactaaccatataccaatg

SEQ ID NO: 597687 - DNA, 126 bp, Homo sapiens
ctcgcgaacggtgtactgagaatcgttgccttccttttaacaagaaatgctaatgtcacctcaaaaagcagaaagagagaacctgcttgcgattatgctcgtgaagaatagaatttacctctcata

SEQ ID NO: 597688 - DNA, 203 bp, Homo sapiens
catagaccttgtcttcacaaaaaaaaaaaaaaaaaaaaaaaaaggggaaaaatggtgggggagggtacaaatccccggggctaaaactattttaaggggggggggaggggccccctttgaccaaaggggttggggttaaagggggctttaaaaaaaaaacgggcacaaagcggggggagagaagaaaacccccttttaaaaaa

SEQ ID NO: 597689 - DNA, 146 bp, Homo sapiens
gtcggtaccgaggaatggcgactccctgctgtggctacaatggatgcccctgcttgatcctgctcatcatcatgtgtgaacaaattccaacgtattccatcttccttgggaagatcttgcctctggccctatgatatggacggtgg

SEQ ID NO: 597690 - DNA, 101 bp, Homo sapiens
ttagaggatcgctgggctaagtgatactacaaggcgggtggatagttgagctcaggagtatgagactaagtgggcagcatggcgaaacccatactactacc

SEQ ID NO: 597691 - DNA, 717 bp, Homo sapiens
ggtccaggctgaggtggtctcagatggagataagccacttcttaggaaccggagtaaaggtaactcttgctatgcaaagagactcacagcattttgtccctcccctagagatctgtggaactttgaacttgagagaaatgattcagggtatctggcagaagaaacttctagaacgacaagagcattcaagaggaagcagagcataaaagttggaaaatttgcaggagatcatttcggaattttaaggtttaatgactggcctattggatgtgatagaaaagaaaagccccattttctggggagaaattcaagcccaatgcagaaatttgcacaagtaatgaggaatgttaagtcaccaagataatgtggaaaatgtctgcagggcatgtcatgagaacttcaaggcagtccctcccatcacaggcccaaggcctaggagggaaacaatggttccatgggcctgggccaggcacagggaccctctgctctgtgcagccttgggacatggtaccctgcatcccagctgcttacagctgcagcagtggctaaaaggggccaaggtacagcttgggccattgcttcagagggtgcaagccctactcactgggtggcttccacataggtgttgagcctgtgggtgcacagaagtcaagaactgaggtatagaaacctctacttagattctagagcatgtatggaaacagctggatgtccagg

SEQ ID NO: 597692 - DNA, 735 bp, Homo sapiens
  misc_feature (476)..(476): n is a, c, g, or t
gcttctttaacctggtcggggtgccacgtgaacgatcctgttgtcgccatgggcgtcgccctgcccgtatgtaccgtgatgtaagaacaggcgtatccaaagtctcgttcatgccgaggtgtccctgatgccgaagatacagcaattccagactcctggggcggaagaacagtgcacataggtgcgtatgcagttcacgcggcgtccgtgcgccaactatctggtgttcagcatgacatcatcgcagcccagtgtgtccttctgatagcctctgtgaggtctgccccgaatttgtgtgcccaatcaagtcagcatggcgtcaaacaagtttgtgcgcaaaagaatgggcttcccatatccgggtgtgcggctcccacccctttcacacgtcatcccggcatcaacaaggatggttgttccttgtgctggggcctgacagggctccacaacagggcattgcgagtgttgccttgtgnacaaggcccccagggcacttgtggccaggcgttcacatttggccaaagttcatcatgtccaatccggcacccaagcttgcagaacaagggagcatgttgattgaggccctgccgcaggggcaaagttcaacgtttccttggccgccagaaagatccacatctcacagaagtggggctcaccaagttcaatgctgatgaatttgaagacatggtgctgaaaagcggtcatccagatggtgtggggtcaggtacatcccag

SEQ ID NO: 597693 - DNA, 952 bp, Homo sapiens
gaaagtctgctaattacgcatcgttaagagctcatcaggagcacgcagtcaaagcttcccgcgggccccctccccaccggcccgtatgttgggtcttggtgctctttctctagggggtcccttgtcctatggatattgccccttgggtgaccaccccctccggtgaagcgtttccccaacagtgccaacggggaatacatgtgggcccggacccacgtattctcggtatcttagaaaaacggcggtttccaaaataggcgcagacggttggtgcaaggccagtcacagacatggaattgtgtgcggcctccccaaacggcgggggtaccagcgtgtccacccgggcgcggccctgccacttcttttggggcccaaaacttgtacaaaccctgtccccccccgaagtacgtgcggagtgtagtgccggcccctttgctcgagacgcttgggaattcgtggccctcattaaggacgcccggtcgcttttagtcgcgtcgaggtcctccgcggaagtatgtatattgccgcgcccttaatgggggtcatgtgtgaccaccaccccccgcaagtgtcgtggaatgtgcgctcaggctacctgcggcctctactcgacccatgtggtatggttgacaaaaacggctagaaatattctccgctcgcccccgatcgacgtcctcggcgcctctcgaggtcagtacggggtgcggccgccttgtcagcaactccgtcccaatgttctgtaccttctccgccctccctcgctagttgtgcgccccgatcctacccctttcctctgttaaatagacgacccccgccccggctgttgcttgctgtcgtcgcccacccccgcatcggcctcccccccgggcccatggtgtgcccccccccccccccccaactccaattctaaaacctcaccccccacataacaaaaaaaaccagaacataaaaa

SEQ ID NO: 597694 - DNA, 832 bp, Homo sapiens
  misc_feature (549)..(549): n is a, c, g, or t
ttcaaaatccatcttgagctgtgtcagacacaggtcagatgggggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaagcatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactcataggaccgtaaaaaattctgtaagaatgctgaagagtttacaaagaaatatggggaaaagcgacctgtggactaaaatctgccacgatnggtccagcaagtgtgagcagagaccccctgcgagggcttaagacaccccgcaaagaagaatctgtggaaattgacacgtgccaccgcctggcggttggttgtggaagtactaacttctatccgtttttaataaaaaggggctaggtacctgcaagaagggataaaatattagagggcttgtctgtccctttgtttaaaaaaacaggctcatcacttcaaagaagggggttgttttttttcactttttcaaaacttaaggccgtaaccccagggctgaaaaagg

SEQ ID NO: 597695 - DNA, 320 bp, Homo sapiens
tactagcctatgctacagatttgaaatggcgctcactttgacatgacacacggtttatattacagaaaatgaatgaaacgacaatgtgctaaaaataaatgagacagtctgcacacaaacagatgaggactgctactttcctcccatcagaaaagtactcaaaaagggagtgtttaaaggcaactcaaatcagtagaacccgaaagtcatcagagtttcaggacaccaaggccttagagctgaaacactctttaacccaagccgggcttcaggtgcaagcccaccaacagaccccaatttccacagctgaggcagatccg

SEQ ID NO: 597696 - DNA, 216 bp, Homo sapiens
  misc_feature (32)..(32): n is a, c, g, or t
  misc_feature (35)..(35): n is a, c, g, or t
  misc_feature (39)..(39): n is a, c, g, or t
  misc_feature (46)..(47): n is a, c, g, or t
  misc_feature (55)..(55): n is a, c, g, or t
  misc_feature (89)..(89): n is a, c, g, or t
  misc_feature (97)..(97): n is a, c, g, or t
  misc_feature (129)..(129): n is a, c, g, or t
  misc_feature (135)..(135): n is a, c, g, or t
  misc_feature (153)..(153): n is a, c, g, or t
  misc_feature (181)..(181): n is a, c, g, or t
tcgagcacctcttgcccctcttcctggctcanctnaagnatgagtnnccttaggnacggctgaacatcatctctaacctggactgtgtnaacgaggngattggcatccggcagctgtcccagtccctgntccctnccattgtggagcttgctnaggacgccaagtggcgggtgcggctagnccatcatttgagtacatgcccctcctggctggaca

SEQ ID NO: 597697 - DNA, 705 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (35)..(35): n is a, c, g, or t
  misc_feature (38)..(38): n is a, c, g, or t
  misc_feature (44)..(44): n is a, c, g, or t
  misc_feature (48)..(48): n is a, c, g, or t
  misc_feature (54)..(54): n is a, c, g, or t
  misc_feature (85)..(85): n is a, c, g, or t
  misc_feature (111)..(111): n is a, c, g, or t
  misc_feature (114)..(114): n is a, c, g, or t
  misc_feature (121)..(121): n is a, c, g, or t
  misc_feature (125)..(125): n is a, c, g, or t
  misc_feature (127)..(127): n is a, c, g, or t
  misc_feature (149)..(149): n is a, c, g, or t
  misc_feature (160)..(160): n is a, c, g, or t
  misc_feature (167)..(167): n is a, c, g, or t
  misc_feature (175)..(175): n is a, c, g, or t
  misc_feature (190)..(190): n is a, c, g, or t
  misc_feature (198)..(198): n is a, c, g, or t
  misc_feature (203)..(203): n is a, c, g, or t
  misc_feature (412)..(412): n is a, c, g, or t
  misc_feature (502)..(502): n is a, c, g, or t
  misc_feature (622)..(622): n is a, c, g, or t
  misc_feature (653)..(653): n is a, c, g, or t
  misc_feature (673)..(673): n is a, c, g, or t
gtgaaacacagcttgtgtnganggggnggcaaaanaangaagcnagtnctgaanttcactcttgattgcacccaccctgtagaanatggaatcatggatgctgccaatttngancagtttngcangnaaggatcacagtgaacggaaanagctgggcaanccttggntggagggngtggtgaccatcganaaggagcnaagangcaatgatcaccgtgaacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattnttgtatgagcttcttgaagtaaaacttggggaccaaaatggtggtttatccttgtatctctgcagtgtggattgaacagaaaattggaanatcatagtcaaagggcttcccttggttcgccactcatttatttgtaacttgcttcttttctttttctgcttaaaaatttcaattctcgtggtataccagagtagaggagagggtgctttnccgactgcagccattgggagcagtgcgggtntggcgtgtggctgaggagtnctgttgttttaaaaggtgctgcagttgatctg

SEQ ID NO: 597698 - DNA, 658 bp, Homo sapiens
  misc_feature (19)..(19): n is a, c, g, or t
  misc_feature (22)..(22): n is a, c, g, or t
  misc_feature (27)..(27): n is a, c, g, or t
  misc_feature (35)..(35): n is a, c, g, or t
  misc_feature (38)..(38): n is a, c, g, or t
  misc_feature (44)..(44): n is a, c, g, or t
  misc_feature (48)..(48): n is a, c, g, or t
  misc_feature (54)..(54): n is a, c, g, or t
  misc_feature (85)..(85): n is a, c, g, or t
  misc_feature (111)..(111): n is a, c, g, or t
  misc_feature (114)..(114): n is a, c, g, or t
  misc_feature (121)..(121): n is a, c, g, or t
  misc_feature (125)..(125): n is a, c, g, or t
  misc_feature (127)..(127): n is a, c, g, or t
  misc_feature (149)..(149): n is a, c, g, or t
  misc_feature (160)..(160): n is a, c, g, or t
  misc_feature (167)..(167): n is a, c, g, or t
  misc_feature (175)..(175): n is a, c, g, or t
  misc_feature (190)..(190): n is a, c, g, or t
  misc_feature (198)..(198): n is a, c, g, or t
  misc_feature (203)..(203): n is a, c, g, or t
  misc_feature (412)..(412): n is a, c, g, or t
  misc_feature (502)..(502): n is a, c, g, or t
  misc_feature (622)..(622): n is a, c, g, or t
  misc_feature (643)..(643): n is a, c, g, or t
gtgaaacacagcttgtgtnganggggnggcaaaanaangaagcnagtnctgaanttcactcttgattgcacccaccctgtagaanatggaatcatggatgctgccaatttngancagtttngcangnaaggatcacagtgaacggaaanagctgggcaanccttggntggagggngtggtgaccatcganaaggagcnaagangcaatgatcaccgtgaacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattnttgtatgagcttcttgaagtaaaacttggggaccaaaatggtggtttatccttgtatctctgcagtgtggattgaacagaaaattggaanatcatagtcaaagggcttcccttggttcgccactcatttatttgtaacttgcttcttttctttttctgcttaaaaatttcaatttctggggggaaatcccgggttggagggggggggggngcctttttcccggccttgtcngccctttgggggggg

SEQ ID NO: 597699 - DNA, 337 bp, Homo sapiens
atacgaagatccaacacggatccccccacatggagcaatgcttgatcactcagcgaggtgcaagcttcagtgagccattatcattacactgacatacagacctatgttacatgagacgagactccttttccaaaaaacaaatatacaaactcaatcctttctaatattttgctatgaattgccttatactatacatcagtttggggagtattgatgtcttgtactatgtaatatttaaccgctgcctactgaacactcagtgcgtctctgcagttgtttacgatcttgaatattacgttagcaattttgtaattttcagcatataggatcctgcata

SEQ ID NO: 597700 - DNA, 728 bp, Homo sapiens
ttaagtgaagacggtacgccttgtacggtggaaatcatgccgtagccatgagtttcttgcctgtgtgtgctagccctagatgtacgtgagcatgtgctgtgagcttttacggttcccctgcccctgcacatgtgtggcggtggcctactagtgcctcacgggcatcccacggatctcaatgtaggcctcatcttgcctgtgcaatggtgctgccctgaagactgctgggatgtgctgccattgtctgacttgtgtttgcttactgccatggcaagctgatgatgatgctgaatgcctggatgaagtgcttgatgccctgagccggatggaaaggagcgacgtgctgtgttgtgcatcacataccagttctttgggagcccaggatattaatcgtgggagagcatatgatagcagcatttactcataccactggaatgaccacaatagtggtccctggaccatatggcattgaccatacagaaacacacattaaagacttgcactggaaagccacgacacatatataaccacagcagccccgacacggcaacgcactaacacacacaaccaccaacacacacgcaggaacacaacaccaacacgaagaacaacaaagaccaacaacacgcacacaacacacaccagccaacaaaagcacacaacacacagaaaaggcacaacaaacagcacaagcaacaagcaccccccaaccaacaacagacaagaca

SEQ ID NO: 597701 - DNA, 221 bp, Homo sapiens
tgagatccctctaaatgggtacagaaattatggaattacttcataaattcatggtaatgtatacataaattatatgcattaacatacaattgccattctacttatgaagtccatcagtattgacacataaagtgtcacatgacatgcatatattaatttactacataacccaaaatataattaccatatagtgtggtactagcactctcactgtaacatca

SEQ ID NO: 597702 - DNA, 345 bp, Homo sapiens
tcatgaatcttagcaggggttgcttgggaacagttatcagaccagacagcaaaattgactagtaacagccacacagattcagcagagaatatcttgaacgaggtaatcattcagttctcggtccacaatgaaacacagaaatactactatcaatgattattattgtgccagcatagagacagaaatagcattacagcagatattagagatcaggccagagggtaaggactctctagagatcgcagttaaaagagcagtaaaaattttcaaaatataaatagtatgtattgaggcgagggtaggtaggtgtgccgagtctaagggtaagggagaaaactggttggg

SEQ ID NO: 597703 - DNA, 501 bp, Homo sapiens
cgacgagtgtccgagtagaatgagatacaccaggattcaagactagaatatctgacctcgtttgctgtgttctttccaccaaatcatgatttttttttgtttggacatgtaatctcctagcgggtcgggcagccttaattcattcccaattgcccaaccaattaaagatgattattaaatcatgcccacggggttcctcctcatcagagcccttgggggtttcccagaaacatctgcattaaggtcctgatccagtgctcctagtggttcaccaaccgtgtcagtgggcttgggcttactaccctagccggttgtaaagcaaaatttttctggaagggtctgtctttggtgctgactagaggatgcccccggagacccgtggaccatgaccacagtggcagggttttcctgtcctaaaagagccagggagctcctcggaacataacactcgaggctaggatacggttctacaaagctcagtacaatctaacctattggtca

SEQ ID NO: 597704 - DNA, 456 bp, Homo sapiens
ttctccaggaacacatgcactgacttggccgggccgatgagtctgaccataggctgttgatcaggccctggaagtggttcaggtttttgtggcaaaacaacattgaaacgttagcggtcatgaggccgagatcactcggctcaggatttgaaatcctgaagaagaattgagaagtatgtgcatgaaattgaaaaagaaaaaggaagaaaaggaaaagaagaaacaaaaagaacagcatcatgatgaatcaaccatgtctttgcatgtaattctaacattcatatcaatcatggactgagtctcgatgtgtaaggcctttccattccatttattcacactgagtgtcctacaatcaaacttccgtcatttcaaacaacataaaggaaccaacaacacacaacaccaaaaagcactagtctcgacctctcctcaccccgcgaagacagcttatcaaac

SEQ ID NO: 597705 - DNA, 2005 bp, Homo sapiens
aaaaaaaaaaaaaacaaaaaaaaaacaaaaaaaaaaaaaaacaaaacaacacaaacaaaaaaaaaacacacaaagaaaaaacaacaaagaacacacaaaaacaacaaacagacaagacaaaacagagaaccagaacaaaagacccaaaacaaaaggaaatgaggcacacgacgcacgggggaccagagagggagacagaagcatgagcgctaacagacagcaaaagaacatagcagacacaccagtcgaaaggaaaaaacagagcatagcagacagagacagaaccgtacacaaaaaaacacaacaacgagaaacaagagaaaaaaaaagacaacaacaaaaagagagacaccgaacaacgcacaacacgaaccaccgcgcaacagggacgcacatcaagaggcgaagacaccaacgcaaagaacaaggagaaacaagtgagagacgaggaacaaaagcaactagacgaatacagacgcgcgcgcggccccccggacgcaacaaacacacacaacacaacaccgaagaagaacaggagacacagaccacacaccaaaacagaccacacctcagcagcaaccgacacacaagcatagtaacacacaccgcacaacaagagaacagaccacagcaagcagccagagacgagagacaagacgatagaaaaaaagatgacagaagaccgagagaagaggaggagcacgacgagaaaagaagcgacgagcacagcctcgcaatagccaacgagatagaggggacggcgaggaggacgacagcagacagaaggaaaagaaagagatgagaagcaaagcagatgcagaagaagtagaagaggcaacgaccaggatagaaagggaacgaacacgcataggagcagagagaagagcggagaaacacaaaccagcagcagacagaacaagcgagagacgacgcacagacaacgaagaaaaggagcgaacacacaacacacgcacgacggaacaaactaacccagtagtagaaagagctacgacgaaagagaaaaaaaaccgagccagacgagacagccacagcagcagaacagccaaacaacaacgcgcgaggcaaagcagacaggcaggcagcacaagacagagagacgcacacgtaggactcaacgcaaagacgaaagagaagagaaggaccaaacagagcagacatacgaggaggggaactgatgacccacagcagaatagccagcgcagacacgagccaccgcgcggaccgccccgacacaacgagacagaacaaacgaccacacagaacaggaacagcagcagcacacacctagtagcaaaagcacgacgcggacacacgcgctcacgcacacgcgacggaggaagaccagaatagacagagaacgaaaacgaaccacaaaacgcatgagacagagagacaaagaggatgagtagacgacgaggagacagcacaacgaagaagcaagacgagacaaaacatgacaccacgcagcactaccacgcaacaagtgagcagacacgcaacgcaagaacaacgaagaaagagcccagtagcacggccgacgcggacggtagcagacatgcagagacgagagagaacaaacgtagagagcgataggcgaagcgacaagaacaacgagcgcgagaacgagaagagcagtacgacacagacaagtgcaagaaaagcgaagtggtagatatgcaagagagaaaagcgcacgcagaagaccacacgccagtatgaactaccagccaaaagcaagaggagaacacacgagacatagcaagcgaagagcgagcgacgcacacgagccaaggtatccacacgaagacatcgcagtgaagctgagcgagaggcggacccgacataagcgaaatgagagcaacaggaaaatcttgagagcagcacagacagaccaaccactacgcagtgcggcgggtggacggtatagcaacatataagcaacacgacaccgcctgatcacccgctgcgagatgtaaggccgacc

SEQ ID NO: 597706 - DNA, 407 bp, Homo sapiens
gggcaggtctccctctcagctggactctcagaggaggagtgagtgttcctcctcagaccgcagccctcaagcgctgcgatctgtgccacctctttgaccggtccctctgccctcagactagcggaagcaaattacacctgaaagtggaggagcgggtctctttctttcttagacccagggcatttggcaaagtcttagaagcagaaagaatcagcaggggtcccatttcatccccaaaagctttagaccccaaaggcagaaacatttctaaaggaagatagaaacggaaacgaaaaacccaacagtcccaaatgtgcccatggtgggattgttggcagatgagctgtggttcttggatcctggacctaggacccatttcctagggggggggcttgaggatgggtacc

SEQ ID NO: 597707 - DNA, 125 bp, Homo sapiens
actgggggtgatttttgtcccccagtttgcagagtctgcagacatttttggatgcaacaattggggcgaggggtggttgctgctagcatctagtaggtagaggccagggatcctcatgaccattc

SEQ ID NO: 597708 - DNA, 473 bp, Homo sapiens
  misc_feature (12)..(12): n is a, c, g, or t
  misc_feature (85)..(85): n is a, c, g, or t
  misc_feature (128)..(128): n is a, c, g, or t
  misc_feature (139)..(139): n is a, c, g, or t
  misc_feature (253)..(253): n is a, c, g, or t
  misc_feature (336)..(336): n is a, c, g, or t
  misc_feature (344)..(344): n is a, c, g, or t
  misc_feature (416)..(416): n is a, c, g, or t
  misc_feature (459)..(459): n is a, c, g, or t
  misc_feature (463)..(463): n is a, c, g, or t
  misc_feature (470)..(470): n is a, c, g, or t
caagttgggccntccactcatccccaaaagaacccccagctccagtttacccaatgatacatcagatgagatcatgaccttctgntcagtcagtaccaagacagtcctcgtccttagctgccttaagncaacgttcccnggaaccgcaagtctttgagaaggacgttgaagagtgggctcggagatgacctggtgcaggcactgggactaagcaagggtcctggcctggaggtgtgaaggtgctgtatcccgnaatctatctggccctggactggcagtgcaggagatgacagagtgaggaggcccagagcaggaattctggcccagaactctgtnccaggagncatccttgagcagtattagccgtgtgtgtatgcatgtgagtgtgtgtgtatgtgtgtgtgtgatggcatatnatgtgcatgtgtgtgagtccttgaacgcacggaggaaaataanattntccctgntca

SEQ ID NO: 597709 - DNA, 1111 bp, Homo sapiens
tgacgcggtgggatctgcattctgcactgctagtgaatagtagtatatcggactcactagctcatgtcctccgtagtatgcctagaagggatagtagtattgttgggcattatagcgactctcataagcgtcaagaactcatgccctcttagccaatgtggtggctatagtcatattagtcgttgccgcctggacatgacggtgggccgtggcctacgtactactcaatcgtcgtgaccatagtatggcctgatacttaaggtgaattaaaactatacacacgtactcgcagagtgtcgtaaaggagagggttgggaacatgtgagtgatgacttctcgtactacttgtgttgtacattgtaggaacacagtagtaatagagttggcagtcgaatgagtacatgcacatgtataggtatagttatgagatgtgattccagcagatgaactgctcgacaaacagtagatatggagtatttctactttgtgcctgttggaggcaagattatggcaaggtgagtagataagggtcaggtcactaggtttcgcggttatgcgcccacgaagaagtgacaggagcaggtggagcatgaatcgcgggggatttctggtgctaggagatttgtctcaagtgcggattttggtaatagaatgaggggatagtggcgatggaaacctgcatgagttgcaagcgtgggaagaagtatgtaaggcctggttatgctggatcttacttgtggtggtggaaaggggattgaattccgggacatggtggcggactaaaatgatgggcccggcaaggggttcagaccataaaaagtggaggggggaaaacggggcgtgaaacataggaggataggtcatggcccagatggtggggcgtctacactggggaaagagacgaaccgcagtggagttggaacaaaagggggctggcagtggaaatcacaaagatgtaagtccaaggtacacacacagtaaacgccaacgacacacaacgaggagatgaggcaaagacacgacctagacacaaaaacacggaagtaaagctgaggaaaaaaataacaagcaggacgtcccactcacctatctattccgtgagaaggggcgc

SEQ ID NO: 597710 - DNA, 238 bp, Homo sapiens
agggactcggagaatcatgcagcagaagcagaaaaaggcaaacgagaaagaaggaggaacccaagtagcatttgtggcttcgatgatccaacccatcatatgccattcgcctgtgatgcctggagccagtcccaccacgctcgcgtatcctcctgtagtgcacacaggtcccagcaccgatggcataccctttgccctgagtcagcaagcgggatcccatttagtgcttccggacgaa

SEQ ID NO: 597711 - DNA, 340 bp, Homo sapiens
  misc_feature (288)..(288): n is a, c, g, or t
cgacaccagatcgatggtcgcggtctcttccagattgtcgtcggcgaagtcgcgctcgacggtcttgccgctgtcggccgcggtgaggttgcggctcatccaaaggccgccgccggtgccgtagatcagctcgtccggattgaacggattgatcttcacgtcggagatccagctgcccatccattcgccttcgcgccaggggaagcgcgtcgcgccatgggattgcttgcgcagggacgaccaatgagacccgccgtccctggagatgaagatgtcgtccgactccgnccaccagtggtcgagggtggaggcgacgatggtgccgggatgggagggatcg

SEQ ID NO: 597712 - DNA, 798 bp, Homo sapiens
  misc_feature (236)..(236): n is a, c, g, or t
tctcctcaaacattaaaaatttccaacatcctgaaaaccactgtgccctgaaacgggttctcctgggggggcacagggctaaattccctaacctcccattcctttttaaaacccattatgtgtggttgccaagcggcaaataccctccagtggttctgacaaaggtcactaagttcccgtgttcattcctaacaccaaggggatctttccaatcttcctcggactgggcccctccntaaacctcccttaacccaaaatcttccttcgtggaaagcttcctccttctttggctgctctttagaacccgccagccttgccttccattgaccacccccgcccaccccttaactaggggtgtgatcctcaggactgtatctgtcttggccctcttgttgcttgtcccacctgcccaggcttcctggaaaggttctagtcccttggttccacctagactgcattttttttttttttttgaggcagagtctcattctattgcccagactggagtgcagtggtgcagtctcggccgactgcaacttttgcattccaggttcaagcgattctcttgcctcagcctttcagttagttgggattacaggcgtgcaccaccacacctggctaatttttgtatttttagtagagacagtgtttcaccatgttggttgggctagtcttgaactcctgacctcaggtgatccacccgcctcagcctcccaaagtgctgggattacaggtgtgagccaccacacccagccccagactgcactccaacctgcacaagagtgagcccttatctca

SEQ ID NO: 597713 - DNA, 1019 bp, Homo sapiens
atcgagagcacatcaaagtgcagcagctcatggacaagggcagtgacaagcgtcggggcggtcctccaggcccatcccatcagccgtggacttcccctatgtggatgatggtggctggaccacagatatcccatcagcaaaggtagccgccccattgagacctcacgactcaccaagatcaccaagcctggcatccatcgattctaacaaccagctctcagcacctggagggcgactgagctggggcaagggcagcagcggcaggctccaggagccaagccctccagcacgccagcatccagcacagctgctcgcccagctactagtcactttcgcacatcgctatctccagacccttcaaccaagcggtaacccacagcacaagccacagcatcaatagcacgtgtggctgcagaggcagtcagcttgagccgcagcacgaggcgcagcaagctggagcacccgcaggcagaccggactcagagacgagagtgcacacggcggccagaggcgcaccgacgagcggcaccaggctctgcatccgctcgcagccgagcaccccatagctcaccaccagccgagcaagcctctcagccaagggcaacagtgccaccgtgacgccgcgaacggtcgcagaaaccgggctccatccccaaagccgcgacacggagactggctccacacggcacagaatcaggccatcaccccgaagcgcctcgagcaaaccggtgagcagcggggaaattgcccgagcacaagcagagcgcacgcatgcgcactaacccccccagtgacgcacaccagtgaaaaggccgggcacacctccggaacggagggcaccaaccagcgaaagaaaagccccacacgccctcaatcaaacgaagacactagatagacacagccaacggaacgagacaacaaaggccgcgcccaccgcgatgccacggagctgcaccccaccccgcccacgcgctaacacacaacgaaccgccagcgacacgcgaccacaccggaccgcc

SEQ ID NO: 597714 - DNA, 604 bp, Homo sapiens
agccggcatgtttctactgaacgtgtggcagctgccattctccttcgtaactgcaaattggactagatacctcagataagtggaatcatacagtgattgtctttttgtgactggcttttgttacttagtataatgtcctcaagttcacccatgttgtcatatgtatcagaattcccttcctttctaaagctgaataatattccattgtatatatgtacaacattttgtttatccactcatctgtcgatggacacttgttgcttccacctcttggctatgtgaataatgctgctatggccttggctgtacagagatctctttgacaccttgctttcaattattttggatatagcctcagaagtggaattgctgggttgtatggttagcacttgttgtcttgttttgccgagaatccctctcaaagaagaaaaaggggcggggaggatgatgcatctctgctgggagataattaccattgattacacaatcaaggtgatagtatttatggaaacttactgtttgccatgtactgcaagaagtgcttggagtcatttcacagtaaccctgtcagatagatgtgattaatcatccactttctacagag

SEQ ID NO: 597715 - DNA, 185 bp, Homo sapiens
ctctggctgactagaggacccgggatgaggaacgtactccatgccttcatcaccatcggcaaggtggatggcttgttgcctgagaaaaggctggccccgcctcttgtaccagttcctgatgaatggcatcctgactgtgcaccctatgggctggcttgagcgctggtggctaacctgcacacagc

SEQ ID NO: 597716 - DNA, 896 bp, Homo sapiens
ggcaagattatggagtccagagcaactccagcccccacagttcagctccgcacagtacccttacgacccctacaggtcgacagtgtggaccatacttatccccggcctgtgatcccacctagcttatcatcttccatgcgcaaatccaatgcagtgggcctcaattccacttgaacatccccgcccaggcacattattcgaatagtcactgccaagcagatttaactgcaatctacacatagttacatgtaaccttctatgctatatgctaattgcatgcattgtgaaccttggagctgtttataaaagttcacggcaaagatctgcgtccaatagatgactttttaagtatcagtaacatgattttatcatctaggcagcagctgttacccttaaacaaaggccagatgttgatgctccgctgggatgcgggaggggcccaaagtaactggcatttattgacatttcagtggctgtggctaaccagataaataggctttacttactccattcataaatcagatgctgtctgctcaaagcgttatccaggcaatatgtgcggactctgtaagatggctctatccaagaaaaggcctgagcatggatcaatggtttgcctggattcgaattaccccaggatggatctgatctgtatgcccaacttgcggggattgttcgtgcatcggacccaatttctactgtcagggatttaaccctcctcagtgcctggctttcgggtggctgggagggttcccgactggtgcgcgaagctcgctgcgtgcttgatgtgggcgcacggccaaacgggcggaggggcactgtctccactggtctcattgtccctgctcgtccgtgggggtgctgccccactggccccgggtttctccaagtgttcg

SEQ ID NO: 597717 - DNA, 361 bp, Homo sapiens
acctcctaccccacggaaaaaaaaaaattttaatagagacagggtctcactgtattgcccaggctggttttgaattctggagttcaagcaatctcccgccttagcctctcaaagtgctggaattacaggtgtgagctaccatgcccggcctatattagattatcttgaccagtgctgtctaacagaactttctacaatgatggaaatgttgtatagtttatgctgtccaatatggtaggcactagccacatctagctattgggcacttgaagtgtggctagtgccatcgagcaactgaattcttaatttatttaattttaataaatttaaattgccactgtggctactggctactactgct

SEQ ID NO: 597718 - DNA, 213 bp, Homo sapiens
taagcagcggcttacagcatacacaatctaattgcacaataaaatctacaacgtggtcgaagaaagtttttggagttccctgtcgtgatgcagtggttaacgaatccgactaggaaccatgaggctgaggtttcgatccctggccttgaccagcgggttaacgatccggcgttgcctgagctgtggtgtaggtagcagacgcggctccgatcc

SEQ ID NO: 597719 - DNA, 163 bp, Homo sapiens
ttccccccggggggggaaaatttttcctttttcccccccccccccccccccttttggggggaattttgggggggggcccctttttaaaggggggggggggggggggttacccaaagggtttttttgggggtgtggggggccccctttaacgggttttttttta

SEQ ID NO: 597720 - DNA, 299 bp, Homo sapiens
gcatagctagtagactctagtagtatatttgtatatccattcatctgttaacagacacttaagttatttccacatttatgggtattataaagtagtgctgctgcgaacattggtgtacatgtatctgtttgagtccctgtatttagttattttggttatatacctaggaatggaattgctgatcatatggtaattctgtgtttaactttttgaggaactaccactgttttccacaatggcatcaccattttacattcccaccagcaatgcacaaagatttcagtgtctgtctccttgct

SEQ ID NO: 597721 - DNA, 125 bp, Homo sapiens
ctcctaccgtaaatatatggtgtgctcacacgataaaccctaggaagccacatgatatcatcagctccagcacccatcacctcatgtcatccgaaatggttccgtttttttctggcagtcagtca

SEQ ID NO: 597722 - DNA, 211 bp, Homo sapiens
tatctcaggagtatcgagatcagagacaggggtgaagataacatttcaccatatagagaatttttttactatttatgattatcttttgagacaaggtcttgctctgtcactcagaatagagcacagtggtgcaatcacagctccctgcatgcctcgagccaccagcaggctcaaagtgatccgtctcatctcagcgctcctgaagatagct

SEQ ID NO: 597723 - DNA, 909 bp, Homo sapiens
gaaatagtgataagtggaggaaagagataatataacattggctttcaagtgagacccaaaggaagaactggataaaatcttccaaatgcaaaagcatgagatgtttctatccaaagtatgcagaaaatgacccatagagaactttctcattttgctactgagtcacacaacgggaacgtggaacggaaagaaacggttaaattatataggaagtgacaactataacatcctgatgacctgggtggtcaacgatcttttacatgataacgagggggaagaaatcacagtaaaggtcatacagacaacattgttttaagaattcataacagcaaccttgacaagagaatagacttaaatgaatgcttctagaaacttccagacggctcacaaagaataagactgccttagggctggcagagcatcgtaagcctctaagcagcacagggcaagacgaagatatcttaccaggcgagcctagtgacaattaaccgcagaagcaaggcttcgggttggatcttaggctggactcttattactgcatgccgatggttggacgatgcacgactggtggttagagtcattccgttcgccagcatttggctagaacgtcatcactcacacacgacattagtaagggagtcacatttagcatcatagcatgaggacacgtccattcatcttagttacaatgggattgagaatgcctatcggagttgccaggaagaatgattgatcacgcatgaaacgaagacataggtatattggttgccccagagaacatttcgattttagtgtgactaagtaatccctagccaagaaagggaaaagcactaaagaaaaggactcggtggggtcggataataaaagggcaaaagagaacttaaggagttggagctccaggcaaaggga

SEQ ID NO: 597724 - DNA, 289 bp, Homo sapiens
gcctcccaagtagctggaagtaacagtgcacgcgttagcatgccagccaattggtggtattttcactagagactgtggtttcaccatatgggtcaggctggtctcaaactcctgacctcaaatgatcccccaattcaggctcccacagcactgggattacagggcgtcagccacctcaccgggccctggccactatcgtgtgtgtgtgatgtgcgtgtgctgtgtgtgtatgcttgaaacaaggactgaatctgttgcccaggctgggcgctgcgtgtggggctccctc

SEQ ID NO: 597725 - DNA, 981 bp, Homo sapiens
gagacgtgtgcgctggctcatgcctgtagtcccagctctcaggcatgctcgagagtgcgggaggatacgttgatgcgcaaggagtcgtagacctgcctgatgcatatacgcgataccccgttctccacgaagaacaggagcgagacacccatcctctggacgaaatgcaggacataccataggtccagggaagatatttgtgggcacgcaaggacctttcaaataacatgtttcaagacaccaccttgttccggtgtgcccgacctcttccgtgaatagggagagagaacgttcgttggtggcctgagcccatgcgggaattcataccagtggccgtggatcctacaacactgaatagataacagcgagcggtatgtactcggattcttgggcaaaatctgtgtaggggtttatgcgaagaacatagtgtgtgattagcagcgggagacctcagaggggccgtataagaaaataggtgcccgtggtggttgtggaatcaacaaatatggttccctttgttgcacgacctttggctgataacctcaatgaggcaaaaactttgcccaagctagaagaggcgaagaaggtttccatccaacaaatccagattgcaattgatacgggagacgtcaacaaaggacttggttaagaaagcgcaataccttttgatgtgcaagggaatcacaatggctagggttgggaagttcttaccgggacggcgtgtttagagatataggcagcaaaggatggcgggcatatattttctgggagacaatatgcgtgacggacagacatgataatggggagagccgtgtgaagattccaaacgaagaaagggcaatgcagtgtggacataggtgtgaagacggatggcagcgttattttcctgcagaaggggcaggaagttagacgttgagggaaggagacccagagggtaagagcaaggataatcgcgagaagagcaggagttatgaaccgctg

SEQ ID NO: 597726 - DNA, 826 bp, Homo sapiens
ctgcccccgcccggtgtgatcctcgcagccgtgtggtgcgcgccccgcctatttttggggcaacccgggggcgcccctttgctgaaaaacacaacctggttgttcccaagaaaccggccctggggaaaattattatcgcttgttgggaactgtggctccccccccgcggcccaccccaacatacaaaggcgcagggggtgtttgccccccccactccacgaaggagcggcttttcccactaagtagctcgcgcctcatgatagtggattgctaatggctacaagagccacacccacgccggttaacaccggcaggtcgtcatctctctaggaagtttttagtatattttctggaattcgcccaaacaaatggttttgccccctgaacatactatatcaaaaagcatctttacaacgaccatcttctttgaacctatgacaaaacatgctattgtctgacgcccgctctcccccccacgggtgtaggaacccccccttcataaatcgaggtttactactaattatctttatctccccaacaaaactggtgtacaccacctcggcgtagttgagccccatcggctccacgaataggggctgcggtgaagacgagcctcgtagcgcaccagctggtggtcggcgccccccctgcatccccccgcgctctttgtatacaacatatcctacaggtggatcactacccgatgtgacaagttatgtcatgctgctcataaggcgcgaggtgcaccctcctccggggcggtgcaacccggtataaagatgcttgttgcatgaacagcacaggacccccctcgtccataaaaaca

SEQ ID NO: 597727 - DNA, 404 bp, Homo sapiens
  misc_feature (321)..(321): n is a, c, g, or t
atacgctgaactatgcgtgaactatgtgggtcttttgtcttgttttgttttgttttgagatggagtctcattttgtcacccaggctggagtacaatggtgtgaccttggctcactgcaacttccgcctcccaggctcaagcgattcctctgtgtcagcctcccacatagctgggattacaggtgtgcaccaccacacccggctaatttttgtatttttagaaaaccctgttttctaaaacagggtttcaccatgttggccaggctggtctcgaactcccaacctcagatgatcctcctgtttcacactcacagagtgctgngattacaggtaggagccaccacccccagcctcattgtggttttgatttgcactttcctgatagccagtgatattgagcatctg

SEQ ID NO: 597728 - DNA, 291 bp, Homo sapiens
tgagttcaagaccatcctgggcgacagtagtgagacctcgtctccagcaaaaaagaaattttttttaaccagacaagcatggtggtgtgtgcctgtagtcctgtagtcccagccactcagaaggcttaggtgggaagatcacttgagcctagggggtacaggttacagtgagccaagatcacgccactgtactccagcctgggcaacagagcgagacattgtcatctttcgtttgtttacttaaaactccattgaggctgggcgcggtggttcacgcctgtaatcccacta

SEQ ID NO: 597729 - DNA, 105 bp, Homo sapiens
catcagtgcactgctgtgtttagattgcattatctttcggactccaatcttgaatctcatcttgtagcagatagaatgttctcgtcttattagagaggaatctac

SEQ ID NO: 597730 - DNA, 740 bp, Homo sapiens
aaccatcaaataaatgacaagagtaagtcctcatttatcaataatagtcctaaatgtaaatggattaaataccccatttaaaatataaagattggctgacatgtagaacaaaaacaacaccttactatatgctgcctacaagaaacttacctgacctgtaaatcctttcacatagaattaaagtgaagggataaaagagtattccatgcaaagtggagaaacattaagctaggtaagaatagtctatacttccagtccaaagaaagacagatttcaagtcaaaagctgtaagaaagaaactatgaagaacagttatataagtaatacaggtagttaagtttagtgaaatagaatgtaacaagtgctaaatgtagtgtacaaccaagaccagaaaacccagacatataagggaaatattgattagatttaagagggaaaatatgaatgtccaatacgaatgaaaagttggaaacatcaagatcatagtttcagcattggacagatcatctagacagaaaatcagcaaggaagacattgggtgcaaacgtgaaccatagacactgatggacctaacgcattgacagaacatttcagccaatagcatgcagaactaacacaaatcgcttgcattgggcaccatggaaacactggcattaagttgaaccatgatattcacgatcaccagaggcaagttgtcgacatctgtatcaaagagaaatcaaacttattaccagcgcatc

SEQ ID NO: 597731 - DNA, 134 bp, Homo sapiens
aacagcgcaagtgtttcaccattgcatgccaagcagcatgcaagcacacttgcaacaaacagcatactcatggcatcaattgggcagcggtcaacacagcttgggtcccgcagctcgcacattcgtcacatcca

SEQ ID NO: 597732 - DNA, 394 bp, Homo sapiens
  misc_feature (11)..(11): n is a, c, g, or t
  misc_feature (57)..(57): n is a, c, g, or t
  misc_feature (87)..(87): n is a, c, g, or t
  misc_feature (93)..(93): n is a, c, g, or t
  misc_feature (110)..(110): n is a, c, g, or t
  misc_feature (198)..(198): n is a, c, g, or t
  misc_feature (242)..(242): n is a, c, g, or t
  misc_feature (317)..(317): n is a, c, g, or t
  misc_feature (363)..(363): n is a, c, g, or t
agaatgatttnataaattttaattagactgagtctcgctctgttgcccaggcaagtntggtggtataatctcggctcactgcaaccnccctcncctggtttcaagctatnctcttgcctcagactcccacgtagctgggattacaggtgcgtgccaccacacccagctaattgtttgtgtttttagtaggaatggggnttcaccatgttggccaggctggtcttgaactcctgacctcaagncatacacccacctcagcctctggaagtgctgggattacaggcgtgagatagtccactacacccagcccagggatngaatttttaaaaacttttaaaaatgttcacataggaaatgttattnttgctttattcattttcatgacacaaggtat

SEQ ID NO: 597733 - DNA, 168 bp, Homo sapiens
gctacatagaataatccaccccttacgagtgcgggttcgaccctatatcccccgcccgcggtcccttatctccatcagaaattcgttcttatgtaggctattacctgtcttacttattgtggagtcgtagaaatttgcctctccgtttgtaccccgtcaccatgtagc

SEQ ID NO: 597734 - DNA, 443 bp, Homo sapiens
atatctagaggctggcctctacttccagcatgcgtgtgcacgcacacatggacacacaagtgtacacacacattgttcgagtgactcttgggatttcaaggtcaaagtaaacacatactcacagttttgaataaaacaagcacaggtgaacatgtgtatacatacacacacacacacacacacgcacacacacacacacacacacaaccccagtggaaggaacgctcatctcttagcgcaaatatgtgccaagggaagaagggggagggtctctgtagactcgcttcaggtgaagttgcaacataaacactgtaatatacagctaaaaaaatacatacaaaaattgcacacatatccatagaaggggagcacaggctgcacacatggtgaacagctctcaatcacccacctcagcaatcagaattcctacagccatttaggta

SEQ ID NO: 597735 - DNA, 352 bp, Homo sapiens
tcccgttttcacgctgatctcatgagtataggagtgtaagagcaaagggtgagataggacgagttatagggaaggcttctggggaccctcagtccccacgatgctctagggtgcaggttagaaaagatgtgccctaggccaggcgtggtggctcatgcctgtaatcccagctactcagcaggctgagacaggaggattgcttgaacccgggacgcagaggttgtagtgatccaagatcgcgccactgcactctagcctgggcaacagagcaggactccgtctcaaacaaacaaactagccaggcacggtgccacatgcctgtagtcccagctacttgggaaggctgagacag

SEQ ID NO: 597736 - DNA, 124 bp, Homo sapiens
  misc_feature (20)..(20): n is a, c, g, or t
tttctgaaaatgtgatacangtctacagcatacaaccgtatcttctggtaccaaagaacaacaaatgagttcacgcttatatttctatttcaaatttagtatacggttttacacctttttctca

SEQ ID NO: 597737 - DNA, 355 bp, Homo sapiens
ttgatgttatatggctccccttgtcagatcatctctctctgcgcctgtgagagagcttcacataatgtaagtgtctgagctcccagcatgcagactgtgagtcataaccctttcttataaatatcagtcttggtatgcttatagcagagatatacaaaccaaaccaagcagtcacagaacgatggttgctatgagctgaagcatgtgcatgcatgagccagtcataatgatgagtaggagtgatgcggaagtcagcagagccacagttacatgtggacaaatggattgtcttacccatggctgatgctccaaagaggagggtaatcacacgatgggcgaaaagcaatgatacagg

SEQ ID NO: 597738 - DNA, 102 bp, Homo sapiens
ccgcaaaggaagctgaggtgggtggatcacctaaagccagaagttcgagaccagcctgaccagcacgtggtgaaaccccgtctctatttggcccttatcgag

SEQ ID NO: 597739 - DNA, 815 bp, Homo sapiens
ggcgtcagtttgagtctaggttggagttggaacctgtggagatgctggaaggaaaccccacccccccatagtgccccctggtggaccggtgagtggaatcttacccccaaattgcgccctgcctagcataggaactgtgcatgttagtgatgtgctagcagcagagtacctgtgtaccgatgtgtgtgcagctatctccatcgtgagtgccatccagcacttgagtgttgctgcattgactgtgtgcactgtgtctcacctactgatgctttattaaatgtgaacccacatgtttgcctgaccccagcaaactagaaaggagcttacttgtcatcctgacacctggaagtaccaaagaactgatgatagtgctatgtgatgattgtgacttgaaccatcgactattgagtagtttgtggtgaggacggatgtgtaattactatggttgtgagctaccgtgattacatgatgttgcattgtatatgacatattgttgtgtgacactagagatagaatgaattgaaagacactatatattgtcaagcaatgttcttgcaatatatagacgcattgaatgacatttgttgtctacatgtcatgttgtctttgatgctcgtggcacacaatgctgtcagctgggtatgcaaacagacatcttgcaatcaatggttttgttgacccttgcttcagcagagtggtacttgagttcataaccgatgctcattgccttggctcaggtcaccttttgtatgcttgactcttcctcacaagggactcttgtagtttctatcattgcatctgatgacaatagaatt

SEQ ID NO: 597740 - DNA, 543 bp, Homo sapiens
  misc_feature (499)..(499): n is a, c, g, or t
tcaaatgtatttctggttctaggtctttcaggaattgccacactgtcttccacaatggttatactaatttacactcccaccaacactgtaaaagtgttcctttttctacacaacctcgccagcttctgtttttgtttttttttcccccttttaataagctgttctaactggtatgagatgatatctcattgtggttttggtttgcatttctctaataatctgtgatgttgagctttttttcatgtttgttggtcacatatatatcttcttttgagaattgtctattcatgtccttagcccacttttggtgggattgtttgtttttgtcttgctaatttgtttgagtttgttgtagattctggatattagtcctttgtcagttgtatatagattgtgaagattttcgcccactctgtgggttgtctgtttactctgctgactgttgcttttgccatgcaaaagctctttcgtttaattaagtccaagctatttatcgttnttaactgcatttgctttttggttcttcatcatgaaatccttgtc

SEQ ID NO: 597741 - DNA, 417 bp, Homo sapiens
  misc_feature (12)..(12): n is a, c, g, or t
  misc_feature (294)..(294): n is a, c, g, or t
  misc_feature (313)..(313): n is a, c, g, or t
  misc_feature (348)..(348): n is a, c, g, or t
  misc_feature (357)..(357): n is a, c, g, or t
  misc_feature (369)..(369): n is a, c, g, or t
  misc_feature (378)..(378): n is a, c, g, or t
  misc_feature (386)..(386): n is a, c, g, or t
  misc_feature (390)..(390): n is a, c, g, or t
ggaaagccctcngcggttacagcgcacctcccaaccatcaaattgagcctgccatcaaggcctccttaaagttgcatatagatgtgaatgctcacacacagatctcctactccatccagtcctgaggagccttaggatgcagcatgccttcaggagacacttgtgggcccccggcattcccttgatatcagtccccttccctgcagagccttgcctttcccctctgcctgtttccttttcctctcccaaccctttggttggtgattcaacttgggctccaaaacttgggtaagntttgggccttcccaaaatnatggccccttcctaaaccctcatgggtggtgtttnaaaggggtnaagggcctggancccctttgntaaaaaanaccnataaagggcaggtgtggaaccggccca

SEQ ID NO: 597742 - DNA, 260 bp, Homo sapiens
agcggctacgctgctggagtgggaagatgtgagggaaaaacagggttatgactcactgcagccttaacctccccaactcagtctcctgagtagctggggctacaagagtacaccatctcatctggctaatttttgtattttttgtagagacagggttttgccacattgcccaggctggtatgaactcttgggctcaagtgatctgcctgcctcagcctcccacagtgttgggattacagtagtgtgagccacagggtacc

SEQ ID NO: 597743 - DNA, 542 bp, Homo sapiens
gagcggttgactgttgctagtgccaaaccaaggatgacaaggtcaccaggactgaaaacacgtgaaatagagctgtgtagggttgccaagagtgcaattatatgattgtgagccatacatcgcgggctggagcttaatgattcataacatttggatgtagtggaccacccctgcttctatttgagtatacggcatacgacaaaaaatcgattgtgcgcgtttaggaagaaactactgtagacttagaaagatctggatgtacgacggaacggaaatcattttgttattgctaagtgtaccatctatcagactggttaccacttcatctgactgcaatacaggccataaagaagggcttggatttttggtgtacccagtattcacagaaactgagcagagacatgagggcatgatcccaggtggttccagggactgaattgcttatgtgagacctttgcgagagagaacagagcaagatatggtggtacgatatgctatgagggaaggaatgccttcctggacgtacactggagccagtgtgg

SEQ ID NO: 597744 - DNA, 515 bp, Homo sapiens
  misc_feature (11)..(11): n is a, c, g, or t
  misc_feature (226)..(226): n is a, c, g, or t
  misc_feature (254)..(254): n is a, c, g, or t
  misc_feature (266)..(266): n is a, c, g, or t
  misc_feature (273)..(273): n is a, c, g, or t
  misc_feature (280)..(280): n is a, c, g, or t
  misc_feature (282)..(282): n is a, c, g, or t
  misc_feature (285)..(285): n is a, c, g, or t
  misc_feature (305)..(305): n is a, c, g, or t
  misc_feature (399)..(399): n is a, c, g, or t
  misc_feature (401)..(401): n is a, c, g, or t
  misc_feature (416)..(416): n is a, c, g, or t
  misc_feature (419)..(419): n is a, c, g, or t
  misc_feature (426)..(427): n is a, c, g, or t
cagcagacggnatccaagacgtcttacaggacacactggcccagccctgggtgcagccagccctgcatccaccgctgcgctcgccaacttcagccaccgcccccatggggactccagagggccgggctgcttaaccatttcccctgcgtctgcacgactgccctttccctttatttcctcctccaggattggagtgcactccctccacgaaggaagtgctgtggcngaaagtggggagagcgagcggggatctncagggcactgangcttccnccaagcntngcngcatgggcgcgcatgcaggnagcttgagggagcgatgcgtaaaaaaagaaaaggaaagaaaaaacaaaaacaaacccaccccaagtgtgtgttttctcaaactaaaggagagantnagggatggggtgggntgnggcgggnntggcgtagtgaagagaggaggggtggggaccaccggggcagagtgagggtgtgtgcgctggctgagcgcttgctcgcggatgtgctga

SEQ ID NO: 597745 - DNA, 810 bp, Homo sapiens
  misc_feature (727)..(727): n is a, c, g, or t
  misc_feature (744)..(744): n is a, c, g, or t
  misc_feature (767)..(767): n is a, c, g, or t
aatttcccagcgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccaagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgacttcagccagggcagcattaatagaaaatctacccccacccttcttcaaaagcgaaatcctttnctttccaaggctagcangcttctttagaatatgggatttncaactttggccttctaagctcatccctttatgaagtgggccaa

SEQ ID NO: 597746 - DNA, 690 bp, Homo sapiens
ggagggtgtgatcgtgtatatgagtagcatgaggaggatgtgactgaatgtgcatgtgtgggtgtgacagctgcaggtgtgactgcatgtgaaggtgtcactgagtggtgccccgatagggtgtgactggatgtgagagtgtgtgactgcatgggaggatatgagtgtgccatgactgtgcatgtcacggtgtgagcatgagttgcatgagagatgtgatctgcactgtgagatgatatgtgatgtagtgacactgtagcgaagttgagtgtaacccgcggagagtctgccgagtgttgacatgtaaatgtgcactgcgggatgatggttgcttgtaaggtagtgagtgatcggtgcgtgatgactgctaaggatcgtgagtgatgacgttgtgagagagtgtgaaggcgatcgctgggaggtagctccaccactgatggagcgacagacttggtcacatatatcctaacagtgccgagagagcagtgcctccctgtgtgccgagtcaaaagccggcgaggggttgagcgctggtgtcggcgcaccggagatttccagtgcatcaggccggattcggtgcgtgggccgtggtcacaccagctcagaaagatcggagaggcatcttttgcgttgactaaacttacagccaaggtagacaagccacctgccgctcccaaggggcccggccaa

SEQ ID NO: 597747 - DNA, 852 bp, Homo sapiens
ggacccggtgggggagaggctggtgtttcctcctcctcggctcaccattccagaccaaatattgaaaaaatggtggacctcacccaggtaatgtatgatgaagtatcatggctttggcttgctatggatcaaatgattctttgcaagaaatgatgctgtatgaggtagcctgcaatctgcttctatagatggacgaagaaaggttctgccaatccagaagagtgtgtagctagttggtcaaaggagaaaatgccaagaagtatcttcgaacgagatgacggagttagaacgtgtacgcagagcccactgaatgacttgaaaacattagttattccatttccttggaagtgtggctcctgtatcctttgagtggtcccgaggccctctacaggccatccgtggatctatcagaacgtattctgtggggagacacggatctaccacagcatgtgcatattggataccccttccccagcaaatagagctcagagtgttggtggggatatgggagtctagtctttccatggcttacaggtctgctgaaaagtaaattggtacctgttaaggaaaatcatacaatcagacagtccagttggttgtataggagttctgtacctttcaatttataactgaatacttcttaggatgttaggtaaggaggggggcagaggaattatgaactgcgggtaacccctttctgatattggattgccaaaatcctgtatccttgttccccttggttcgaagtttacctagtattctcaagcctggggggtttaacagactcctttaaagggcaccatgttgtcgacttcccaccctcttggatttaaatggcgtgggaaccctttg

SEQ ID NO: 597748 - DNA, 117 bp, Homo sapiens
ttcgagtagatttatcattactactagcaaagaaagaagcgtgagacttcctgtcctcctactcgtaggtgtatcatattctactagcaacgaaagaagccgtgagacttcctgtcc

SEQ ID NO: 597749 - DNA, 736 bp, Homo sapiens
ctgtcgaccaggatagtgagttcgccgaggggtccctagccatgcggaactgtgcagcaggtatgttggagacatgaagcagtaagcacgaggatggaggcctagaaatacatagggcgtggtggtgcatgaaagaagagcagagcctggaggcccggctagtcagattctggctccaatcatgtgtggccaaaagtgagtttgattctatacaggcgtgtgaaaatgaccagagtagagaccatctgcggtactattgtgcttgttcctgggcccttcagcaaaaagagttgctgatcaatggcatcccaagtctaggctggataatttccttatctggaatagaatcgccatcagccgcagcatgaaggcagatgcgtactgataactccagctcgcatccaggcacagcacaggacatagcagccctctcagtcatatgatattacgttcatttcgctgacacgaggggggtcctcgggatagggcaccctggttcagctggaggcgagtagaacgagggcgtttgtgtctcctctgcttctcagcgtcgtgaatgctgttttgctcactccctctgcagtaagtcaggtcggcctcttctctggggagcatgcctcgcttagacagctttgaaagtgtgaggtaaatcgaaggactcaaaaatcagaagcaatgccttgctaaacccagggactgggggggaggagggggcctgggtacaagtgcgggaatt

SEQ ID NO: 597750 - DNA, 627 bp, Homo sapiens
ttatttatgaaatcctctggaagcctttaatgttagattttgaaataaacaacatcagaaaattctacaaatgtaattctaagaaagaaggacaaagaagaaatataacaatctcagttttgtttaaaaatgcaatatacatatatacatacccataggagggagacaataaaaagcattagcagtagtgaatgtctggcattccaaacaaaggggcaggaatgggtaggtttactttatgaaatccgctccctgtatttctgagttcttctgcaatgaacatgtagtacagtgtcacttgaagatggagcaaaagcagtatttttaaaaacaggaaaccaagtccacaatattcatatttactcattttcatcttcactgtcaaaagaaaggagactgctattttttatttgtttttgtgagttctttctaactgaactttgcttatttacatcatcttcattggttttcttctttttggagcttgctgttaaacctgaacacttttcatctgaggaacgcttaactggttttcgataaactattcttccatcagctggaggtggttcttcatctgttttggcagcctttatttctgctttaattttcatgacaataggctcaggc

SEQ ID NO: 597751 - DNA, 559 bp, Homo sapiens
tgaatggaaccttcctctctgtttcctactcccaccctgagagtattcaggtcacagggcggccatctgtgggccagatccggtctgcagatatgtgggaaattactattaccttggccctctcaggttttattatgatgattattatttttatttaaaggtattttccacatttaaaaagcaagagattttaaattccacttgctccgtgagactgtaatgctccagctccttcccagcaggacaaccttgtccgggattgagcagccaccaccttccccaaaagggcttacactcctctcagaggcctctggggccagtttaatgcatttatgttacttgtggaggcagtgggaggcaggctcaaatttgggaggtcaaatttgtgctgtgtgactttggacgaggtacttaacctctctgtgcctcagttttttcctctctaaaaatggagcaaataatggtcctgacttcgaaggattggtgcgattaaatgagtgaaatatatataaagaactcagaacactatcgggcgtgtagtaaatgttcaaggaacgtt

SEQ ID NO: 597752 - DNA, 788 bp, Homo sapiens
ggctggtacgctcggattaacgggactcgccggctgctggggcaggctggcgaatgttcctgaatatatcacatgtgtgtgataaacatgaagatgtatgaaaaattgtgtctgtagagagaaaatggaaggcttttcattctacttccacattttcattccagcagctatttctgttttggaagatgagtactgaatcttgcaatgaaatttttttaacttataacaagaccacaggaaaatgaagcgcagagacgttaaataactctctcaaggtcatgccagctgagaagcagatgcagactttgaactccagtgccagcccttgttaatcactcatatctgtacttgtctttcagtgttcattatgcctattgttttgaaaaacatggttaccctgatgaaattttacatgtagcaagaaagcttcacacgtacgagagctctcaggatataattatttcagacagatactgggaacataagatggcttatcaatctaagatggccttcctgtccttcggattgaactgaaaccatccctgattccagggataggtagatgatccgggtttggacaatcaagatattgaaccagcctggagctacaagtgtactggagatgggaacaatgcaaacgttggtccaacattgtagtactaagaagccagtacatttctacaatgcctgatggaatgatagggtatgcataaatgttacatagtgaggatctggagtataacaggaactgaagaaaggtaaatggaagtttgaatatttgtaaatga

SEQ ID NO: 597753 - DNA, 216 bp, Homo sapiens
  misc_feature (33)..(33): n is a, c, g, or t
atcccgaagtctgaaggagagaaccaaccaggntcaaatttcttttaatagcgtgtttcagcctctttaatctctttataagttaactaataaatctattttctgtcagactctgcaaatagtctttataatcacaacagtaagcaagctgacttttgtaatgtgctcaatacaaatacttgtgaacttttaatatgtcgagtgcttgcattgtga

SEQ ID NO: 597754 - DNA, 217 bp, Homo sapiens
ttgggggacgcacacatacaaatctactattttgacaataaatatactcttcaggtacaatgtggactttgttcaattgtcgttggcattgtgcaagagattcaggtagtgactgagagaactttggagtgaggtcagggatgggtggttagccaagacttgtaacttccaggcagaatgaaaagttgtaagtcttggctaaccacccaaccccgag

SEQ ID NO: 597755 - DNA, 358 bp, Homo sapiens
aggagcgaggctgtgctggcaggccacagcgtggcgtgggaacccagtgctgcgcacctcagaatgggatactgccctcaatccgatgccatctttgagctgctgacgggccggagcacctggagctgattgggcgctgcgcggtgtcccggaggcccaggttgcccagaccgtggttcgggcctgggcgtctgggactctcatggtacgcagaccggtcctgcaggcacctacagcggagggaacaaactgcaagctgcgagcggccctggtgctgtttgtgggccccagccgtggtgttcctggagcgagccgaccacaggcatggaccccagcgcgcggcgcttcctttggaaac

SEQ ID NO: 597756 - DNA, 1227 bp, Homo sapiens
tcccgtcaccgccacctgcgtagtctatgcgtcgccactattgacgtacggctgctctcactgaagtgatccttgaggatgtgtaaacgcatattccttgtgcgctgctgttggcgaacagcaggctcgaaggtgttggagacagtgggagaacagagagactagacgacatgagatgtgaagttaagagaaacgtattgttctgaagccagaagagaacagcaagcaactatcgacacaaaacctcattctgttgaacagatgcttggatagcctggccaacacgtacttaggatggaggagtgcgagcgactcttgcgataccagtgcatatctctacagcccttcctattgagtggggcaagccacttcgtaaacgtccagggtaggtgatacggagtgacctggagcccattgtgttcgtagcatgagtagtagaacagtccaactgcatgtaatgcgtacagcaccactagtggcatagtaagtcattcctataggagagaggcacggatagggacaatgaatggaacgaagacatgcgctcatgttggcatttcgctcgcgaccgagacagtgactcctgggtaaacctacacccgtcgagttactgctcgaccggtctcgatccacggctctatttgcacacgatagccggatctcacggggatgttatttatctaaccatcaaatatcggaaagcgagattgagacttttgcgtgagaacagaatttgcgcccggtatgtaggggcgatccaaatatgtcgcgccgtttgaggcaattcccattcgcgagcgtcatcataggtaggacttccaccccatggtctgtggtgactcgcggttatagtactccgttgacgcccttgcaaggcgtgttggaagcgcgctagacgcgtgatatgcgaggacggggaagcgcaacacagtgacccggggaatctgtttgtcactctcaacaaggcgtcgagtgtcgttaccaaaccttggtgttggattgacctatggaaaggacctaagcgctctaataaatggatccctaagagataccaaagaaccctagcggcaaagagtccgaggcaaagccgagcaactaagaggatgtaaaatacgccacaatgcccctatggcgtggccccccacagcgtttgtccccccacctgttcgaactcctcaagactttggccatctggccccacaactaagggcaagcgggtcacttgca

SEQ ID NO: 597757 - DNA, 178 bp, Homo sapiens
gccgacttgcaagtacaagtttgagaactggggtcgtgtatgggggcacaggaccaaagtccgccaaggcaccctgaggaggcggcgtacaatgcttcagtgccaggagaccatccgtcgtaccaagccctgaccccagaccaaggcaaggccaaggccaggaagggaagggaaggac

SEQ ID NO: 597758 - DNA, 612 bp, Homo sapiens
  misc_feature (52)..(52): n is a, c, g, or t
  misc_feature (61)..(61): n is a, c, g, or t
  misc_feature (64)..(65): n is a, c, g, or t
  misc_feature (70)..(70): n is a, c, g, or t
  misc_feature (73)..(75): n is a, c, g, or t
  misc_feature (84)..(84): n is a, c, g, or t
  misc_feature (92)..(92): n is a, c, g, or t
  misc_feature (97)..(97): n is a, c, g, or t
  misc_feature (99)..(99): n is a, c, g, or t
  misc_feature (102)..(102): n is a, c, g, or t
  misc_feature (111)..(111): n is a, c, g, or t
  misc_feature (115)..(115): n is a, c, g, or t
  misc_feature (121)..(121): n is a, c, g, or t
  misc_feature (143)..(143): n is a, c, g, or t
  misc_feature (151)..(151): n is a, c, g, or t
  misc_feature (167)..(167): n is a, c, g, or t
  misc_feature (169)..(169): n is a, c, g, or t
  misc_feature (257)..(257): n is a, c, g, or t
  misc_feature (279)..(279): n is a, c, g, or t
  misc_feature (284)..(284): n is a, c, g, or t
  misc_feature (462)..(462): n is a, c, g, or t
  misc_feature (493)..(493): n is a, c, g, or t
tatagtagggatcgttaacttctttttgagatagagatttgtgttatcatantggaggatnatnngctgntgnnngaatgtaanactttganaatgnanaangtgagttangtgngaggtnttccctgcagtgtgggatttangctgattnaggaatgggttgttcntngggatatggttctgacgcgggaggagcttgtaatcctgaggaagtgtatgcacgtgtgcctgtgttgtgccaacattgatatcatgangagcatgatgatccatggttangagtnctgggctctccactgtcattgttccagtcccggttccctgcagtgcatagccggcgggcaggttttggccagctggtttaggatggtggtggatggcgccatgtttaatcagaggtttatatggtaccgggaggtggtgaattacaacatgccaaaagaggtaatgtttatgtccagngtgtttatgaggggtcgccacctaatctacntgcgcttgtggtatgatggccacgtgggttctgtggtccccgccatgagctttggatacagcgccttgcactgtgggattttgaacgtcgacgcggccgcgaatttagtagtagtaggc

SEQ ID NO: 597759 - DNA, 195 bp, Homo sapiens
tcgagctcggtaccaaatatcgagagctacttctacttcttttccccagagtttactgtgcaagataaattagattttaactgctaagtcaaacttaataggtattctttcactctttttttttttggaggtaagctcacagcagtctccaactcccaagctcaagtgattcctccggcaaatgtgggggggatc

SEQ ID NO: 597760 - DNA, 776 bp, Homo sapiens
  misc_feature (450)..(450): n is a, c, g, or t
  misc_feature (557)..(557): n is a, c, g, or t
  misc_feature (559)..(559): n is a, c, g, or t
  misc_feature (583)..(583): n is a, c, g, or t
  misc_feature (616)..(616): n is a, c, g, or t
tgcggccggaccgtgtggccatgcaggatgcgacggccagatggccatgctccagttcatcagcagcggtgctgtccaatggtggctgtgccatccaccatccactgtgaccatctgattgaatgcccaggttgggggcgagaaagacctgcgcctgggccaagtgacatcgaaccatgtgaacgatttactaagtattccctgtgcaacctgcatggatgccaatatattggctgtgtgtgcttctgtgaagacctggatctgtgaatcagttcagccagagttcttcttggaagaacatatgcgtacacctgtgtgttccttcgtgatttggcacatgagctcaccaacacgccaccatatgggtggccggcacttggagggcattctgcatttggagcttgggggtgccgactgctgtggatgtcatggctgggatcccctgggagntgaagtgccccaaggtgattggcgtgaagctgacgggctctctctccggttggtcctcacccaaagatgtgatcctgaaggtggcaggcatcctcacgagagaaagngngtttcaggcgcattttgtggaatnaccacgggcctggtgtagactccatctcctgcnctgcagccaccctgagctggggccctgagctctgatccccatggcctcccctcaccggcccaggtttttacccagggcctcaagggatgagtcggcccggtgtcccacctctctctgcgtgggaggagaagcattgcagctccctggtgtgccgatgccg

SEQ ID NO: 597761 - DNA, 1345 bp, Homo sapiens
  misc_feature (942)..(942): n is a, c, g, or t
ttgtggtatttgttgatgttattgtgtgtggtggtgtgtttgtgtatgtttgtggtgtgttgttgggtttgtgtatgttgtttatagtgctttatattctttgatttgtagtgtgctaagtattgtgtttggtgatttgattagtgtatttttgaatgacttatgtgttgtgtttttgtttaagtgtttgagttttattgtgtgagagatttgtttttttatggcattatatcttttatagctttaggttttcatatagttgtttatttttatgtttctctttgctttttttgtgattgtggtgtggttgtgatggattgtattttatgtcgtttgtgtgtgagataagtagaaatacaaaaaaaaaaggaagaagctagtgattgtttatctttactagattaatgttttttgagatgtgtttttatgtagttcgtagactggctggttatgatcgtttctccttatgtccatatggctgtgcctcatgtgtttcttgttgtttacgtcggtcttgtgttgacttgtcttgtgtgggggcgcccctgtctatgccgagccctggtcacgctcccacgtggccctcaggtgttttggggccgcgtttagccgtagcccggtgaccgcctgctctctgattaacggggtgacccttcaaacttcatttacgcccctttttgggcgctatggcgaccagttggccccgccagtgtgcattatgggggtcaccctagccccaccagttgtgcggtcgaccagtttctgatataagtggggtccgtgtgaaccgtgttcccagccctttttctcccactcgctcacgtgaccccttcttggtttaacgtcccctgccccttcttgaccccttgggccctcgatatgacatgaatggctcccccacttagccgatgatcctcatccggaccgccctttcgaccttgnccgaaaggggagttccgaacctagttctccacggctttcaaccttcggattatcgccgccacggcccctttcgccctagtttcttcactagaccggattaccaccaaccattgatgtataataaacaccctctacccactatccaatcttcctagggaccaacatatgtacgccactcttcccctgaacatctaccaccaacaatattttgtccacccagaacccttacttcgataaccatccctggtttttatgtaattcggaaccagcatacccccgattccgctacgacccactcatacacctcctatggaaaaacttcctacccctcaccctagccttacttatatgataagtctccataccccttgccattctcccgcagttccccctccaaccctta

SEQ ID NO: 597762 - DNA, 312 bp, Homo sapiens
  misc_feature (114)..(114): n is a, c, g, or t
  misc_feature (291)..(291): n is a, c, g, or t
aaatgagcaatcccaaactgcaagtgccgtaagtgggcctgtgacgtcacaccgcccggcccgaggtatcgcattgtgcggggggaggtccacactacagctgtcctctcgtcnagaaggcaccacctcgctttcatgtcccgtgtgttttgggaaaagcagtatggtgtgtcatgtctaagcggcgaacacttccctccctctgtccttgaggttgtaatataaaaactgtggtttctgtacgtgtggggttgggaattctctgacgggttgctcgttcataagcacaangcttacgcttgagttgctgaa

SEQ ID NO: 597763 - DNA, 339 bp, Homo sapiens
cgtctctactgtgttcatgatctcctcctggtactttgtactcgccagccttctgctcccagaatgtcccatgtccttgttcttgcccctccctctcctggtcctctcctaggctttgtctgctattctgtgctttcttccccctgccctcctgcctgtgcgtcccctccatgaggaccaccctggaatctgactaaacctgtcccctgcggtctggcgcagtgcctcacacctgtcatcccagcactttgagaggccaaggtgggctgatcatcagatcaggagatcaagaccatcctggccaatcattgtgaaaccccaccccgtctggtggagcgc

SEQ ID NO: 597764 - DNA, 836 bp, Homo sapiens
gagtgtgtggacctcttggtggggccgggggctgcccaggcaagcattcaggaagacccctggaactgctacatgtgcgggcacaagggtaccttacgggctgatggcgggacgagaggactggcctcccggtccagatgtcttcgactaataaccacgaccaggaattgacctccaaaggttacccactgtccagacatgagaagaggaagcccatccgggtgctgtctctcttcgatggaacccgctaccagggctcctggtgctagaaagacttgaggcattcaggtggaccgtacattagcactcggaaggtgtgtgaggaactcccatcacaggtgggccatggagcggacaccaagtgagaaagatcatgtacgggtcagaggacacgtgcagaagacgtcaacacaagaagcatatccaagaggaaatgagggacccatgcgaaatctagcgtggaatatggggggagcgaggtaccacttgcaaattgaacgcttcctaccaatacaggtcaaacaccatgatacacaaaagagggccgtcctaaccgacggagcacaagacacggatacaacctaccagaagtaactaacccagaccgtccactgccattgagtgcgacgaggacccacaggaagcgcgaggaatgacatacagcccacctagcatgactgggataatacagaagcaacagcacagtgggccccaaggggaagtaagtcgaccaagacagcggacagactaacagagagaccatagaacgaaccaaacacctgagcagggatagatgccaaaggaagagcagaatggcagcagaagaccagaaacga

SEQ ID NO: 597765 - DNA, 118 bp, Homo sapiens
atcccccgtcagcactgaatacaaaacttatgtccacattcaaggccagatgaaatacgagattaggagtagtacaagtagcagatctgacaagggcatatcctgttgaatggagaaa

SEQ ID NO: 597766 - DNA, 458 bp, Homo sapiens
acactgctgtctcttttactctctactatccccacatcttaccacctttcccttacttgccttcacctgcttgacaaagaaaatggatctcttagatatggattccctccgcaccttaccttcatatcaacaaatctttctgcacccatgtacatctttatctcctttctttccatcctagtgtgagagttattttctttgagctaatgctttcacttgtgctctatatcctgttctctacttcctcagaggccttgtatttctcctccacctcagattctgtcatcagcatatatgtaaacatgttcagatgtgtcattttttaaatagcagaatatctgtcactctcactctacttgaggtttcattttctttctctttttttcttaccagttgtctgttttctctgctcctattcactcttcagtcccctagaatctgacctctgtactctttat

SEQ ID NO: 597767 - DNA, 116 bp, Homo sapiens
aaatagacatcactcagtctacaagaatatcaaaaggtattaagacattctaggtcttcagacactattaagcagatgtagcctcgtaaaggtcctgaagattttactatgatact

SEQ ID NO: 597768 - DNA, 300 bp, Homo sapiens
gaagacatgaagcacattcctgttagctaccaacagaaaaggggcggggtacacactgggaacattccaagccccccccaaaaggaacccagttctactgtgccggggaattcctgttggaattccggccgttttgccctggggctcaatcaatacccgggacctttaacccccagggtgggccaggccggttcttaaaatttttcccccacgggaaaaaacttgggaccacaggggaattttccccccacccctttaaaccccataaggggttctcatcatccctccctgtgcccctcg

SEQ ID NO: 597769 - DNA, 132 bp, Homo sapiens
cctctgactatctacaggacattgagaatgctatagaaaacctttctccctgagatgagtgaaaaatgtgaggttttacagtattctgcaatggaagctcaagattcaaaaaaggtggtagaggtgaggtga

SEQ ID NO: 597770 - DNA, 422 bp, Homo sapiens
atcgtgcgtgaggctgaactgcgcgaaacattggtgcgtttagtattggaagaacacctgatcgccgaaggggcaggcgcactggcattggccgctggccgccgcgttgcaggtaagcgcaagtgtgcagtggtctccggaggtaatattgacgctgcagtactggccaaactgttgtccgaagtaagaccacggacaccccggataccacgtaggcgtagtgcagatacgccccaacaattgcggcagtttaccgttcccttttatctgattccaccccatatccacgcctgccaatagcactgctgtagaggagtattaactggtgaacacaagcatatgcagccagccaccccgtatcctgatttttgataccaccctgcgggacggagagcaatcttccgtttggattatgtctgaac

SEQ ID NO: 597771 - DNA, 1302 bp, Homo sapiens
  misc_feature (251)..(251): n is a, c, g, or t
  misc_feature (1302)..(1302): n is a, c, g, or t
ggaacccgcggcgcatggtggcgttgagtgctctgcgcggcgctgcgtccagggagacggtgggcgccaacattcgcgcgttccggagacgcgggcgtggactcccttccagccgcagtcggacggctccggggtcggtcagggcctgggcccgagtgttgtatgcagtgactggcctgcggtgccattgcgttggccattgtgtgatggcgcagagaggttgccttgtctgcttggcctgtgctggaccntcccctgccagggcctgggcttgggtcccctggctgcacggatgcggccttgccgcggggagggcccccctggcccgtgtggcttgtgctgtagtgatgtgccgcaagggccgcaccggtggccttaagttggggttggcgacggtggaaagggggccggggcagttttggggcggcgattgaaggcctggagaagcctgtggtgttgcggggaccggcctttaccgaacaatttcccccaggtcgggcaccccctgttgcccttcgggggcgacgggaacctttcggaagggcccgggcctccagaaggcttcggaaagagaaccttcggcggccaggtaattaggaccgtgaaaaatggccccgctttcgccttgcccctttcttcgtagagggcaggcctatcaaatggccctttgatttggtttactcctttggtttgggcgccccatgaacacacgggtttttggccacgggtttcttttccccccaacgtttcctgagaaggggcccaacaccaacagagcgttccgatgcacgacgcgcgtggtttgttttcgccacacacttgggggaggaactcttccctgaaatcgacaatgggccccaagtgtgccttttggaagacggcttgtgccaccaagcaaccgtttggggtcctctggtaaacactttgcggggccttttgccccttttggcgaacgcgggaggtggggcacccggttggggggcacaatttccccaatttttccccaaagaggtgggagccccgggggggcgggcaactttacctttttccacagcacaggaaaggggcaaatttcttcgggacccgtgtgcgctttttaattcaaacacggtggcgcaggcggcctttgtggaccttcctttggacaaaggcccccgctgccaagttcgtttgggcaagagctcccatgggataacgcttgcacgagggggccccctccgttggtgtttaaacaggcgggaaaaaacaactcttgtggcgaaattgtggcgatatcgggctgtgttacaccaagaaaattgn

SEQ ID NO: 597772 - DNA, 633 bp, Homo sapiens
cttgtgtgaaaagcccagtgtgacagcgtcatgatgtagtagtgtcttactggttttctaataaatccttccgtataaaaatgtatcggctctttctatcatcagaatagtgaaaaatcgtcatggatgtcaaggtctattaaaagcataagttgggaagacaggcttgacgaaattgaggacatgattaaaattgcagtgaagtgcgacatgtttctagcagaatctaatttccgccataatgtgtcctccctgtccaaagttgggaatgacttaatgtcaattcgtctgttggcttgtctcacaagtacatacttccttatgtatgccattaagatagatatgaatattcatcccaaatgcccagtatttgcttaatatgtatagtgctgttttagacacaaatctggataaagtgtgcacaaagatacccctttgcacagcatagttaatgttttcatgcttccattaaatacaacaggacttaacctctgttcctctatacatagaaactgcggccagctccagagagacccatagacctggtgcgtggacttcatagatgaattccagctgttgagcggacgcttaccgacatatataccgccacaagaccaccaccagcccgggggc

SEQ ID NO: 597773 - DNA, 540 bp, Homo sapiens
  misc_feature (32)..(32): n is a, c, g, or t
  misc_feature (62)..(62): n is a, c, g, or t
  misc_feature (65)..(65): n is a, c, g, or t
  misc_feature (93)..(93): n is a, c, g, or t
  misc_feature (185)..(185): n is a, c, g, or t
  misc_feature (215)..(215): n is a, c, g, or t
  misc_feature (245)..(245): n is a, c, g, or t
  misc_feature (249)..(249): n is a, c, g, or t
  misc_feature (269)..(269): n is a, c, g, or t
  misc_feature (286)..(286): n is a, c, g, or t
  misc_feature (314)..(314): n is a, c, g, or t
  misc_feature (343)..(343): n is a, c, g, or t
  misc_feature (345)..(345): n is a, c, g, or t
  misc_feature (377)..(377): n is a, c, g, or t
  misc_feature (391)..(391): n is a, c, g, or t
  misc_feature (404)..(404): n is a, c, g, or t
  misc_feature (416)..(416): n is a, c, g, or t
  misc_feature (419)..(419): n is a, c, g, or t
  misc_feature (422)..(423): n is a, c, g, or t
  misc_feature (430)..(430): n is a, c, g, or t
  misc_feature (478)..(478): n is a, c, g, or t
  misc_feature (494)..(494): n is a, c, g, or t
tattcttatacattgaacaacttattaattanttgttatttggcaaaatatcaaacatgcanatngtattcctacaagaattttgcctttatnttgtggatattagcgctaagcttattcctctccaaaattcaatgagttatggttccgctctgctatatgtattagtgttagtggtaatatgnaaaactgtttttgttttcagggttaagtgngcagattgtcttcgcatttggtggccagcngtgnaccctaatttttcatctatnttctgtgagtgaagttnaatttcatttcgtgagccctgagatagngtgctgagggttgtatacttttaatctanantttattccactcaatttgaaccccacataaanaagtctttgaagtnatttacagatggntgtaacttaagnaangannaaatttnctacttgtataggtaagactgataataaggcctttaactaagagttgnatattttatatgcacntttaacttgctaggagcaactcttaaaattacatctataattctgt

SEQ ID NO: 597774 - DNA, 838 bp, Homo sapiens
gcccacattatagagcggaatctagagagtgagcgacgtattgttagtagaattgtccagtgtagtgctcaggaatggtggagtgtactggttcaggctcctcttgtttcatctgaggtatttattcctgtgtcttactagtctggtaacagacccgaattatcggtgacccatcagctacatggagatgtatgtgtcgtagttctgtgaattcttcctcacgtccaattcttcaggtgctctttgggtgctcccctgtggttggtgctctatgcaaaagtggtgaatgccatttggtttcccggatagttagctgagcgctggtcatctgaggtgatcatgggaggatagtccctcggccattccctagtgtctgccctatagttgctgacatgctcgtcgaccttttgtctgcaggctctgtttgctcgattcagggcacctgtttgtgagtctctttgcccatccatcttgtcggtcagctggttagtctcctggctatgtccctttcttctagtcactgttactgctttggatatccgtggttcaatccgagcgattgaaatgcgccaggggttggtctaaccatagagtggaattgggcttagtactgggggttggttgcgctttgggttttgctcatcgagaatttgcagtccgccatatcttatcccgtggctggccttgtgctatgccttctttcctttattccttactcaggcattgaagcgcgaccctggaaagggcttgctccgttggcccatcggggggtcctaggggggcttttccaaggaggtacctggggcccgagaggcccttgcgaatcccacggggcccc

SEQ ID NO: 597775 - DNA, 479 bp, Homo sapiens
  misc_feature (410)..(410): n is a, c, g, or t
tctagaggatcccgttcagcacatataggtgatgaggtgagcacaagggaggatctggaagctagcagtagttttttttccgtgtcctgaatagtagttttataggtatgcgcttgttataaaccatgtaacttcacatctctgatatctgaacttttctgttttatttcacatacaaaagaagatacattaaaaaagaaagctaatcaagaacagttaatatgctctaattttagaaacaacaaaatttagtgaaaagaaaatcacctgaaccttgtagcttcagttgtcctcacagtacaaatgggtacctgagataatctataattctggcccaaatcatcaagcttgctataagactaattgaatattttctagatatgggtaaaatcaaagtaaaattaaatttngagtgaaaaaaaaacatgatatcagtaagggggtaaaagttcaactaatattaccagactaaatgtgct

SEQ ID NO: 597776 - DNA, 419 bp, Homo sapiens
aattcatgctttccactaaaatgtttgtatcaaatactttcctatttagattgatttcttttaatatcatatattattatactgtatgccccagagattggaacaaactattcctgtaaataacacataaaagatgagggtgagggggaataaatacagactgtaaaatgttttgctttttagaactcaaattaccattctgttttttcagatgtatttttccttcttagttgcagtaagaattgtcattttctttctctttttatagctcttagttttaaaatgtatatgtacataatgataatatatacatatatgtatattgcattaaatgactttttttctcagagaataccaaagtctgtttcctcctggaaaagtagttatgttacatactcccagctttgtcacagaacagg

SEQ ID NO: 597777 - DNA, 325 bp, Homo sapiens
acgagccagggaaaggcaggatagaaatgactggcagaggcatgggcacggtggcttacgcctgtaatccccacactttgggaggccgaggtgggtggatcacttgaggccaggagttcaagaccaggctggccaacgtggagaaaccccatctctactaaaatacaaaaaattagcgggtcatggtggcatgcaccgtgtaatcccagctactcaggaggcctgaggcaagagaatctcttgaatcctggaggcagagcttgcagtgagctgatatcaccgacactgcactccaacctgagcgacagaccaagactctgtctca

SEQ ID NO: 597778 - DNA, 445 bp, Homo sapiens
ttgggcccagtgacttctgggctcagtgatcctcacagcactaaaagaatagaaaagttatgaaaagtactacatggggctgggacggtggctcaagcctgtaacccagcactttgggaggctgatatgggtagataactgaggtaggagtcaagactgcctggcatcatggtgaaaccactctctactaaaaaatataaaacctagctgggagtggtggcacgcgcctgtagtctcatttactcaggacgctaaggcgggagatcacttgaatccaggaagtagaggttgcagtgggccgagactgcgccactgcactccagcctgggcgacagagtgagactctgtctcaaaaaaaaaagttagtcattgggtcgggtgcaggggttccacctgtaaatcccagcactaggggaggccacgggggcaggaccccttgaggggg

SEQ ID NO: 597779 - DNA, 109 bp, Homo sapiens
ttcctgtgagtggaggtgtcggaacttcaccttgtgaccaaaacacccccaagggatctgccaccattccggggggtacaagccctttccagtgatgagccccccatgg

SEQ ID NO: 597780 - DNA, 675 bp, Homo sapiens
  misc_feature (500)..(500): n is a, c, g, or t
gagatgaacatgcacgagtcatgtcttggtgggattatggctatcagatagctggaaatggctaatagacactacgttggtggataataacacctggacataaccagccagcatagccactggtgtgtgaacaagctatgtcttgctaatgtaaacagcagtcctataaaatcatgagcgactctaagcaatgtaagaattatgctctcggttgtattttgtgggagtgggctctattgagtcctaatacctggtggaatggaatagtccagaccagaaaattctcgtctgagtatgcgcgtaggaatagcctgcaaggaggaacatcctctagatgacattgcgggcaaagatgactatgtttacaccctcggggagaaagtctccggccggtatgacacaaagcaaggcatcgaccgtatcctattgctgggagattgctggccttaggtgtaggtaaaaaattgtcgattagcatacgatgaagttatgcgatgaanactgccaggacttgtgagttataccgtatcgacccccccatgagttttctgaaacagaaaccctgttaacctgcatgaaagaatttgcgaaagttaaaggacatccaataacttcaaacaattaaggaatgatcgccttttacgactcagaaagcctggggttggggaggatagt

SEQ ID NO: 597781 - DNA, 117 bp, Homo sapiens
ggctgctccagtcacattgccatcactcttgtactgccttccaccgcggaggaccctggtgacaggccaaagagtggaagaaacaccctttcacctcagagtccactgaagcactgg

SEQ ID NO: 597782 - DNA, 1193 bp, Homo sapiens
  misc_feature (249)..(249): n is a, c, g, or t
  misc_feature (549)..(549): n is a, c, g, or t
agcgtgggctccggcgggcggaagaggctgtgcgctgggcggcagaatcggcggcggcggcggcggcgggagccgaggaggaggtcccggacgctgctttcaggtaaccgaggtacctcgacggagttgcgctcgcggccctgagccgctcaagctcctagacggcgtcttccatggctgagtagccgggacgccatcgctgcggagactcgtggacactaagcaagcaatcacgcctatggaagatcntcatgaatcgacggttctagcgtcgaggcgtgcaaatggaacgactcaatccccacgctgaaaagaggagctcgaagagatgatcatcgtacttggcgctagcgtgccttaggctttaggcatttccgttgcgaggacgccactatagccaaagcctgtgactaaaacgactagagcgcttctcgcatagctaggttgatgcatcactcgtctttggaagaatcttctcccgtcccgtcccttgagcactacttcagcgtagttggttggggtatgagctaacaggacatcgcccaggtngttcgcgtgagatagattctcttggacgagagggcgagtagacgcgtggggagaagcgcaaatgctatagctcgcggttatctccgccaggttgcaccacacgtagatgttacccaaaaggacaactttgagtccccgggtctaggcccctttcattgtaggtggaagagcagaatcgagtcgacaaaaatttggtgccatccacacgccactcgttacagaagagggcgcatggtggccacaagcgcgggggaaggcgaggagcaaggggagcggtacacgggtttggggaatccctttttcgaatgcgaagaaacccaaacttgcaaccttgtgcgcgctcccaatttcacatacccaaggcgtaacgaagtgagggtggacactcagggggggcaaaatggccgcggaacctccaagcttcattaatcgcgctagcctttaagctaaaatccccgttggggtcccccttatagaacccctccccctttttacctttcggtttggcaggccggggttggattgttgttaggcccagttgggttggcagtacacatgcgggcctttcgcctggagcggtagggtttccgggatcctaaattaaccagttcgttaaggccttccattccgttaaggttttacca

SEQ ID NO: 597783 - DNA, 1485 bp, Homo sapiens
  misc_feature (55)..(55): n is a, c, g, or t
  misc_feature (187)..(187): n is a, c, g, or t
  misc_feature (866)..(866): n is a, c, g, or t
  misc_feature (1097)..(1097): n is a, c, g, or t
ccgtcgcccactgcggaagaaggaaggtggaaacaacacctcgtctgagaagacnactccttgcgtgattgaagatcctcttgccccaagagataacccacacaaaagacgcggagggggtgggccgccacaataaattctctcgctcctcctctctccagagagaattctttccccagggagagcnccccccacgaactcctgtgtgtgggaaaagatgagaccctgtggggggaagggaaaccccgcggggcgccgttggaaaaaacgctcaccaacttggggaaaagcttgggtcgcccaaacaaaacaacaatgtttgtggggaaaagaaaaaaaaaaagagggggaaaacctgctccgggttctaccattgaacctggggggagaccgcttggccccaccaacaaatacgttggtgccgccccttgttaccgccccacaaaatgatgtggaagcccgcccccccccactcttttgttgggtgggaaaccttttgtcacatttggtgaggagacccacccctgttgaaccccttgtgaaatagggagccccacggggttgttgtaaagacccctcttctccacagagagaaactattgtgggggtggggaaacaccacacgtgggacgcccacacactttgggcggcccacaaagaattttggggggaggcgcccgcctccccgataatattctctggggccttctttgcgcccgccgagatatattctctctctctgtgtgacgacacaagagcacaccacaccccctctgggggagagacccactcgtgtgagtaaataatgtgagaaaagtctataagccctcccgggcgtcaaaatttttgccccccacatatacgcncctctgggagagtgtacacttttcccctgcgggtgcacacacacaaagcgcacagttgcgcacaggcacatatgtttctggggggtgtttccccgcgttaacctcgtttgtatacagagaagtgtgttgacaccacacagaacacagccccacactctaagagtgtttctctttagagatgttgggtgacacccactctgtccctctctcacacatattaaagagaaattntggggtgagaccccacgcgtgtgtgtggtgtctcttagagagggtgtctcttgggagtgagactccacagagaaatttatatccacgcgctatttttttccacgagattctctctataaatgccgcgctttgtctcacgtttctataatcaccacctataatcacacaaaagaaaccgcaggtatatttgttatatcttatttataaactcacttatgtttgggcacgtataactaaaggtgtggctgttcttggagattcacgaatatgaaactaaagggttcccgaactctgaaatccacgaagttctgagagtttaaatgtttcccacatggttcacgtctagctttcaccgatttttatgaataaaaggccttaaaggctggta

SEQ ID NO: 597784 - DNA, 295 bp, Homo sapiens
ttcttcacaaggcggcaggagagtgtgagtgtgtgaaggaggaactgtcaaaaacttataaaaacatcagatctcctgagaactcactcactatcatgagaacagcctggggaaaccgcccacatggtccaatcacctcccacagggtctctccgttgacatgtggggattatggggattacaattcaagatgagatctgggtggagacacagccaaaccgtatcagttggttaactttataatgctttacgcctcataaattaggaaggccaaaaacatgcacgacaacacata

SEQ ID NO: 597785 - DNA, 195 bp, Homo sapiens
tttctcttatcctttttttctcttacttgatttgttttccttagtctggtcttctgatctcgtgctttattcattcaattcaaagtgtggcttattttgataatccaatctgtctattgtaactactctttttctttatcatctctttcttaactcccattcctcatgtactatcacctctcgatttgtcttcct

SEQ ID NO: 597786 - DNA, 239 bp, Homo sapiens
tgtgacttcactttcacctgctccaggggtcaaggacttgccttgcctgataagcagccagcagtggccgtggcggcgagttgcggggggcggtgtcgtgcgagagtggagtctaccaatggaagccaggttggtggttacggttaatcttttactgtacattcccaaggctttagttttaaatgccagtgtgcctttaacaaggttgtaaatattttatgcccaccagagatgtggtc

SEQ ID NO: 597787 - DNA, 393 bp, Homo sapiens
tctagaggatctccctagacagagttgtgcccatgcggagtccataatactgtatgatcctttcagggggcactcattatctttccagtttcctataactatgcctctcttgggaggcatagacagggaaacctaggagctcacccgtttttatgggtaataagaaaaaggacggcttaatagtgccaataacacaactgcctgcccatttattaggtaaccgaatgtaggctccgtgcccacatatccagtatagtccagcgggagctgcccagtcctgatgagattctggatgagcccaggcagtttttaatttagaaaatttactaaatgggttcttttcagtgtggtttaggccccaccaagtaattgtctttgttgtgctgttgcaca

SEQ ID NO: 597788 - DNA, 136 bp, Homo sapiens
cctgggcctttcattcagctgatcaggtgagaatgtgcctttggtgtgcaacggttcctattggtatttgtggccacaaagctcagcagctctcatttctcccagcgcttagtcccaaagcaacagaccgctctta

SEQ ID NO: 597789 - DNA, 735 bp, Homo sapiens
gctgtagactaatcagcacacacatgaactaactatcgggctctggacgtttctcatactaatcaatcacaacgctaattacgtgcgggtgaatgacctaatgaagatgatgatgcggcagatgctgggatcattgatatacatcaaacggccgtagcacataatataggaaagaatactgattcaggcctgaagctatttctactaaattacgacatggacaaacaaaattctcccataaacaatgccctttgtaggaaaggttgtgccctggcagaccatcttcttcacacccaggctcaagacggagccatttccactgatgcccaatgaaaggatgaggaaggagaaagtcctttggattctttggcagaagcattatgggaaactactaaatggactgatttctttgacaataacgttttgacatttgcatagaagcatgcattattaaaggaaatgtatgggataggccttaaattgggactaaacttgaggaagaataccaacaaagaaaactggaaagatgatcccactgatgaagctcttgaagggacctttgtgcattctcaccgaaactgatcccaatatgatcctcccatattgggttctacataggaacagactttcatttcaaaccgctgtaaattctgatggttttaaaaaaatatggcatttaagatagcgtgtttcttcacttcagaacggggtataccaccttatattaaaaaaaaa

SEQ ID NO: 597790 - DNA, 486 bp, Homo sapiens
  misc_feature (7)..(7): n is a, c, g, or t
  misc_feature (129)..(129): n is a, c, g, or t
atcgtgngttgccccacggtttggtacacacaaaaggtgcggccgggccccggctttaacctggaggagctcagggtggccggcattcacaaaaaggtgggccggaccatcggcatttttttggatccnaggagggggaacaagtccccggagtcccttcaggccaacgtgcaacgggtgaaggaggaccgctccaaaattatccttttccccaggaagccctcggcccccaaaaagggaaacagttttttttaaaaaattaaactggccccccaactggccgggccggttatgcccgtccggaacgtttataaaaaggaaaaagctcgggtcctcccttaggaaaaaaaaaatttcaaaacctttgctagtttccgtatgggccgggccaacgcccgggtttttgggatacgggcaaaaaaaaccaaggaaacccccaaaccggatttttaaaaaaaaaaataaagccctcctgggggcttggga

SEQ ID NO: 597791 - DNA, 362 bp, Homo sapiens
  misc_feature (35)..(35): n is a, c, g, or t
  misc_feature (301)..(301): n is a, c, g, or t
acctggtttgcaactttaatactgaatacctcccntgccaccaaggaacaacagattttagatgtttaagataagaaactagcttggtaccattaaaatgcccactatgtcctactgatcacttcaaagttaaaggaactagagtactcacaagttacaatcagtagctagcttacatattttgtcatttgttgttaaacatcccatattttttgctatttaactattatcacccatagacagataaatgggtatgaacttgtcttggcctagtcatttcagcttctttttgaaggaggcnatgggcctagatagtaacagtaaagatatgatgtttttaggtggtaaattccccatgggct

SEQ ID NO: 597792 - DNA, 315 bp, Homo sapiens
caatgactggatacaatctaatcatccatataccgcaaaaccaaggttatgacacacagcttgtgccagcgatgaaggagacgtaattgtatttggtggatgtgccaccaacttgcttgtccatcacagagctgcacacagtaatgcactcataatcttttcagtacaaccaaaatctcttgtacggctaaagcttagaagcagtcatttgcttaaacgccatgttcgccaactcatggaactgccttccacatcacttcacttcacagtgttcctcagcaggttcggtagtaacaacacttctggatcttaagc

SEQ ID NO: 597793 - DNA, 942 bp, Homo sapiens
gcggaggtgctggtctggtgcttgagtgtgctcgaagccatctccctgatgccgacctggtggggctatcgtggctgaacagtgtactgctgggccggaaagtgatggtcgtacgcgtgtgaatgcatctacattactggcaatttctacagtaaacaatgttgaactacctggactttcctcgcgcgaagctggatgaacaccgaaacacgttccacggaggccccgtacgctagcattccggtggacgcgcagcatgctctgcaattcgttcctggcggacgctgtgcggaggtatgcatgcaccacacggaaagcataggacgaagggcagtgccgactctggacctgttctgaaggttgatttgacggagtatcctccagacgtccttacgtataatagaactgagcggaatggtgttttcctgctgcccttcgagggtcgtgcgtctggaatgcctaacagagaaagggttttgccttatcgtggggggcgccatgagttctacgaggttggggtggaaggtaccaggcaagtgacagcccacccgtggaggagaagaggaaaagacgaatagcccaagatccactaccgtgaagaatgaaacaaggctcatgaggctaccggaagagcaggccgaggaaagaaccgtggagaacgacaagttgagcaaatgtacagcacgaagagtcctcaaagaccacgggactccctggtctgaggcccaaataaaaggactgttaattccgtcacgcataaaaccccatcggatcattcctgacaggacactgaagcaagccagacaggaccctcgctttcttttatgcgtgcgggatcaagggaattaagcgaggcagttacactaggtcacaggcctcatctgatcacccggaggacgaacggcggcacccagagggggaacaaacacacaggaggccagt

SEQ ID NO: 597794 - DNA, 134 bp, Homo sapiens
  misc_feature (35)..(35): n is a, c, g, or t
ggtggaccccaacctggacctgtccatcagggagntggtgcacaggatcctcccagtggccgccacaagggggttgtgaccaggttcattgaagagaagtcttccttcgagtacgggcaggtgaaccacgcact

SEQ ID NO: 597795 - DNA, 892 bp, Homo sapiens
gtgctaggagttgccgaaggcaagtcctggaagctaccgagcgagtcctggaatgtttgccgaaagggagcagccggggaaggaggatggcgtgatatcatcgcaagactccgggaggacttgggatccaaaaacgtgtgatacagtgaaggccgaggagagctcccgtgactttcaagatgtgtgaccaaggccacgttccactaccggactgctgcacagtgactgacgagggcaccgtgcttggactgacagccgtggctcgtggcaagcccatggagctcatcattggcaaggaatgttcaatgctgcctgtgtgggagaccatctgtgtgcaccatgcgagaagtgggagattgcccagttcctctgtgacatcaagcatgtggtccttgtaccccgctggtggacaagagtctccgcaacatcgcggtgtggcaatggaccccctgtgatggggcatgctggcactgctgctggtgttgcacagatgcgtgaacaacagctccctgggcatgctgacctggacgccctgaagcagaacccacagccatcatcttccacatggagatgctgaagtgtggagagccctggacgtaccagcaaggaccattgggcatgacatggacgaagagaagtgcaaggccggtgcgcattatccaccaggagggcaaccggtttgtacccgcgaggggcatgtgaaggaggctgttgcaagtactacgatgcaatgctgctcagaactgcgtgaaggacagcctggtccctgatggttcaagtggccagaatacgcgtgtgtaatatgcactgactgatggcaagaaacacaggggtgaccatagccactcaagtaagaaagtcaggcatagggggaggccacagggtaatccaa

SEQ ID NO: 597796 - DNA, 206 bp, Homo sapiens
  misc_feature (201)..(201): n is a, c, g, or t
ggtcttggcttctttcttttgtctgggatgcccatttccaaactcttcacatcttcctcctgagatgggatttctgcggtctccctgtttaaagtagccctatgattcctagatcttcctatgccatcaacctgttcattcctttcttaactgttctattgatcaatgactgtgtaacgagtcacctgtaagacataactncgcgg

SEQ ID NO: 597797 - DNA, 1466 bp, Homo sapiens
  misc_feature (505)..(506): n is a, c, g, or t
  misc_feature (549)..(549): n is a, c, g, or t
  misc_feature (559)..(559): n is a, c, g, or t
  misc_feature (645)..(645): n is a, c, g, or t
  misc_feature (693)..(693): n is a, c, g, or t
  misc_feature (699)..(699): n is a, c, g, or t
  misc_feature (749)..(749): n is a, c, g, or t
  misc_feature (769)..(769): n is a, c, g, or t
  misc_feature (814)..(814): n is a, c, g, or t
  misc_feature (831)..(831): n is a, c, g, or t
  misc_feature (837)..(837): n is a, c, g, or t
  misc_feature (876)..(876): n is a, c, g, or t
  misc_feature (933)..(933): n is a, c, g, or t
ggttcgtcctgttgggtgctactctttgtagtgtctctgtgctattcctcttctgtagtttcgtgtcctcctcatagatcttcctttcgggtgcttcacagggcctgtgccttctccactctctgttttatgtcccttggtgcgctgcgggtgtattttctgacctgtgcagtggcctgggaatctcttcatggttgtccccctttgtgggggggcctatggttcttgtggtcctcctggagggccccttgttcttgcgttgacaaaccgggtggtaaggcttggagctgtaacccctggcacatgtctcccctggttatctatccgggccctacaatgcgggttaaacttacgtggttgtgtggctgtctcgagccctggggcaccagccatctgtttttcctaggtggcctggatgagttgaccacttgacggaaagcggctactctggcaggcaatcgggctagccaagaatgcagctcacagagggcttcgccctggtcanncagcagctgccacggagcaccaagctcaagaagcatccccgcnggggagaccngagctgggcgccacggcagtggccttctccagctttgaccctaggctgttcattctgggcacggaaggcggcttcccgctcaagtngttcccatggcagcatggagaggcagccctcacgcggatgcccagctnccgtgncccctgcgggccccagcacagtttaccttctccccccacggcggtcccantctactctgtgagctgttcnccccttccacaggaatctcttcctgagcgctgggactgacgggcnatgtccaccctgtactnccatgnctgcaggcccctcccttgacttacgctgcagactctccnctcaagtatctgtttgctgtgcgctggtccaccagtgcggcccttggtttttgcagnctgcctcatgggaaaggtgacgtgcagctgtttgatctccagaaaagctcccagaaagcccacagattttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccggaaacggcgtgaagccttcgctgtgccgagcctggtgttactgacgcaatgcactgcacgcaaagcaaaggttttcacaaaatagtcagatagaaactatgagggcgaacattgctgggagttgggagagaaaggagttatgtacaatggcattgtgcataaaggttgtcatgggacaagagattttgtagaaaggtggcaataagggtgccataattatgaggtataaatttgtaaaagcgaggtaacctgtatatgaaagttaaa

SEQ ID NO: 597798 - DNA, 145 bp, Homo sapiens
ccatccccatcgtgaaggacgtcggcaggagggtcccgagctacctcgatgtgttcggccgcaccgccgccgcatacacgctcaaggtcgagttcagcttggtgctcgtcgccgccggcagcttgatgggcacgcgcgtcgccct

SEQ ID NO: 597799 - DNA, 280 bp, Homo sapiens
gtacaaagaagatagaggaggagtcatcagcaaaagctatatttctatcacaatactagaagaatagagagggtcgatggaggagtgaaaactagtttaagcagaacagtgaaagctacactctaatatgggcatagtggtcagtacagaaagaggcccatttccttacaaaaccctatgagtggtctcgggccttgtgagaatgacagacgatcactagcaagaaaatgctcgatgagtgggccccagagatcccggcaagggtgacgggacgaggtga

SEQ ID NO: 597800 - DNA, 420 bp, Homo sapiens
ccgaggggcttcataccacttgaagacctacatgccgctggcagccgcggatctaaccgccgctaagggggggtagaacttcacccatatgggcagaatttttcttgaccatatcgccggaacccgcctgttatcttgtccaaactcgaatccgaacctaaccaaccgctcacaactcatttccactcgtttcacaggcgccactgccagaccatttctttttaacaaggtcgctaacctgcagtacagccaagttcactatcggttcatgctcactggccgccacatggttccagatgtgacctgcaagcgatataaggaagcgccgtgtgatcctggaacgtgttctagttctacagagtcaggcctttgaggaccatgtcccatctcacaactcttgtatccacagagtcctctttc

SEQ ID NO: 597801 - DNA, 1045 bp, Homo sapiens
  misc_feature (128)..(128): n is a, c, g, or t
  misc_feature (138)..(138): n is a, c, g, or t
  misc_feature (224)..(224): n is a, c, g, or t
  misc_feature (272)..(272): n is a, c, g, or t
  misc_feature (278)..(278): n is a, c, g, or t
  misc_feature (328)..(328): n is a, c, g, or t
  misc_feature (348)..(348): n is a, c, g, or t
  misc_feature (393)..(393): n is a, c, g, or t
  misc_feature (410)..(410): n is a, c, g, or t
  misc_feature (416)..(416): n is a, c, g, or t
  misc_feature (455)..(455): n is a, c, g, or t
  misc_feature (512)..(512): n is a, c, g, or t
tgtagcgagactgggtgcgcaatagtcagggttgcgagcggccggggcggggcgacaggacgctgcaggacgagaccctgggtgtggcgtcgtgccctcgcagtggagggccgtccagggcatccgcnggggagaccngagctgggcgccacggcagtggccttctccagctttgaccctaggctgttcattctgggcacggaaggcggcttcccgctcaagtngttcccatggcagcatggagaggcagccctcacgcggatgcccagctnccgtgncccctgcgggccccagcacagtttaccttctccccccacggcggtcccantctactctgtgagctgttcnccccttccacaggaatctcttcctgagcgctgggactgacgggcnatgtccaccctgtactnccatgnctgcaggcccctcccttgacttacgctgcagactctccnctcaagtatctgtttgctgtgcgctggtccaccagtgcggcccttggtttttgcagnctgcctcatgggaaaggtgacgtgcagctgtttgatctccagaaaagctcccagaaagcccacagattttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccggaaacggcgtgaagccttcgctgtgccgagcctggtgttactgacgcaatgcactgcacgcaaagcaaaggttttcacaaaatagtcagatagaaactatgagggcgaacattgctgggagttgggagagaaaggagttatgtacaatggcattgtgcataaaggttgtcatgggacaagagattttgtagaaaggtggcaataagggtgccataattatgaggtataaatttgtaaaagcgaggtaacctgtatatgaaagttaaa

SEQ ID NO: 597802 - DNA, 326 bp, Homo sapiens
gccatggagtctgttgctttttaggctttcttgtgaagtctggcgtttcctatgtagtttggggactagtccacacctctgcctcatgctcgtcaccactgctacaccttgtctgcccactttctctccttcccgcccctggaggtgagaccctcacctctctcgtgagcatgctgcctcatgtcttccgtgccgtcgatctgtggctgggtgactgtccctcaggccgccaaccctagttggctctcacagcaacttccagtgctcctggacgaggacttcctaagcagcatgggggccacacggaccggtcacgcacactggcc

SEQ ID NO: 597803 - DNA, 426 bp, Homo sapiens
ggatacgaatcgagctggtaccctagtgtctcgatcggtgagttgctagtattataaacgagttaataaaccttttcagaaaatagagtattcccgcaatctccgcacttggggaggctgaggtgggaagatttcctgagcccaagagttcaagaccggcctgggcaatatggcaagaccccatctcttcacacatttaaaaaattagccgaagagggctgggcacagtggctcacgcctgtaattcaagcactttgggaggccgaggcacgcggatcacaaggtcaagagttcaagaccaacctggccaacatggtgaaaccccatttctacaaaaatacaaaaattagctgggcatgatggcaggtacctgtaatcccagctactctggaggctgaggcaggagaatcacttgaacttgggagg

SEQ ID NO: 597804 - DNA, 147 bp, Homo sapiens
ctggggtgactctaccggatccttcccgtacgccaatgaacggattatctattccaaaattaaaattagccggaccattgtggtgtgcacctgtggtcctagctacttgagaggctgaggtgggaggatcgctttgaactggggaag

SEQ ID NO: 597805 - DNA, 785 bp, Homo sapiens
  misc_feature (215)..(215): n is a, c, g, or t
acagctgtgtccgcagatgagtaacgaagagaagctactatcgatgagagcctaaactcaggttaacgtgcaaatcaagaggctgggatacttttcaggcatatactcagtgtaatcgttgtactgcataaacgccaatcgtagtccagatttctaagatcatgttccaaggctaactgaatcccagttcaactacaccactccatgaacctccntgatagggagacagataacgaggcccaaggcctgtgcgatatagatgtgcgacagcttgcgtaagactctagaaaaaatacgtacatcttcataaattgggtgggagctattgttggtgaccaacttctactttgtgctgtggcttgaggtgaacggaaatggaatattcgatgatgagtgtcagttgtatctccatggtaccatttgagtggaagtcgctttgaatatatccgaggcatcgatggctcgagtggacgactcattgtggtaatagttttgccagaattcttcctgtaatcagtccgctgcatcatcatttagaatatctattattattccacatggactttgccaaagatgaggtccctgggtgtttgcatggcaacttggatcagtcaaggatttcacctctgttttgttaagctagaaatgccagtgctagctatatgttagacagtgagcattctttttctctccttcctgatcagtgaaagtgtgggaagagacgcttaattgagaacgtaatttctctgttaaggaagaggaaggatcaaaaagttgttcccaaa

SEQ ID NO: 597806 - DNA, 117 bp, Homo sapiens
gggcagcaaggtgctcacgtgtcgacggaactgggacaggaaggcatgcaccgaaatggtgagtacacgtacgaccaggctccagcttaacgactcttgggaggtcagacacggtgc

SEQ ID NO: 597807 - DNA, 391 bp, Homo sapiens
cgttctcggtgctggggaattgaaaatgagcaaaaccaacaggagcatgtctgccctctggacactcacaggccactgggggagacagatgttagttaaataattacacaaacatgcctgcaatcccagcacgttaggaggcagagacaggcggatcacttgaggtcaggagtttgagaccagtctggccaatatggtgaaaccctgtctctactaaaaatacaaacattagccgggcgcggtggcgggcatctgtagtcccagctactcaggaggctgaggcaggagaatagcttgaacccgggaggtggaggttgcagcaagctgagatcgcagcaagctgagatcgcaccgctgcactccagcctgggcgacagagcgggactctgtc

SEQ ID NO: 597808 - DNA, 217 bp, Homo sapiens
gtaagtccaagtgaacctaaagcacccaaggctcctcgaccgccataacaacccaactgttcaggatttccagttctttcctccacggttattagatattactggaaaaagaaatgctgttttacagaaaaactattgggtacaaggtacctcgaaatcctgagctgcctaacgcagcacaggcgcaaaaagaagaacagcttaaaattgatgaagc

SEQ ID NO: 597809 - DNA, 973 bp, Homo sapiens
  misc_feature (4)..(4): n is a, c, g, or t
  misc_feature (351)..(351): n is a, c, g, or t
gtantaatcaacgagataagtagaacaaagaaacaggagcttggcgagtccgcacaccctccaggggtagttcttgtcactcctcttcttggcgtctcatattcggggtttactccataaggcgacacctttttcggggacacttacaagtgctgaccccgaacgctgttgttggatccgtgacacgtacctgtgttcctgccgcccgaaggttcttagcggtctctcttaagaatgttgtcgtacatggagccgaacccggtgttgaaggtcgcccgggggacaaccgggtggtacaggcattctcaatgcgccacgcttttgcaggcaatttcccttggtccgggcttnccaaagctgtgggccaaccgcgaagcgcccacaaaatcagtggggccccccgggccctgcgacaatcggaatttttgtgtcctacgccgagggctatctcctccctcaagagcaaggcgacttctcctgccgggagtcttcctccttcgtgggtcgcgctcacgggggagcggccactcacctccttataatgcggcacgcggttaacaagacaccccccccaacagggtaacatttttgcacaaagcacacagcttgcggaagaaatttttctccgccccgaattcacacggcaatgcgcttgtctattcgaatgatatacatttctatctccaaacctttaccacccgatcttcgatcgccacccaggtcttgttgctcagaagtcacacgtctcccccatttttcccataaaccccccgcaacaatagaccgaccccctgtgcagaaaaatacaaaattgattctcccccacacaccctttttatacgggggtcttaacttctccatagataaatttgggtaaactaaatcactaattaatagctgtcgctcgagggtgttcatattatcgtcgcgctgccccgtcaaaaaaaggaaaatcaaaacttcccacataaca

SEQ ID NO: 597810 - DNA, 225 bp, Homo sapiens
tgcatccaaccagcaacttgtgaaactctgggcatctacacaggccagctttccccactcccatgcattgcacaattccggccgctccagtcagcaggcatccctcagctgccgctcaatgcacacggtaccgttcgtgttcaccagcagcacatgggcgtccatccttcgtcaagccatcatcaccacacacacagccagcccttgtggcatccttcatccagg

SEQ ID NO: 597811 - DNA, 280 bp, Homo sapiens
  misc_feature (260)..(260): n is a, c, g, or t
aaaatatttccaaaccacatgtaggataaagtgctcatatctaaaatgtataaagaacattaaaagccaataataaggggatatctaaaccaaagtaaaataagcaatggagtttaatggaattactaagtctcaaaataaagatatatgatggctcatatatatatttattacatactctcaaagatatgtaaatgactaataaacagaaaaataattatatgctctgacaattctactcttaggcatttacccgcggnaatgaaaatgtatatatata

SEQ ID NO: 597812 - DNA, 1248 bp, Homo sapiens
gagcggggtgttagtgctgacacagtgtgagggtcctcagtctaaagccaaaagcagatcaaagtggtgggactcgcgtcgcggcctgtggagacgtgaagctctcgaggctctcccgctgcgggatcggcgctcgcccatcggatcgtccatcgacccatccgacaccggacccggttttttgacccgatgccacagacagtgggagaaagactgaagcatgaatagaagaatgtgaaaaagatgaaaaagacacagatgaagaagacagcataaagacagatcaatggaacagacatgcaataaaaggttacgagagaaacgaagtaagtgaaatgtagttatcattgttccatacgaggagaagtgtatagcatgggtcatcgattggtaacaaaaaagtaacagaagagataggagtgaaagaccatatataaagaatgaaagagggatcaatagacgtagcaaaatagtagaaaaaaaaacatgaaaagaatcaggaacgacggaccaaagacggaacgaaaaaaccggacgaaaccaaagacaaaagaagaagagaagaacccgaagacaagaaagaacaccacagggaacaaaagagaagccaagaaaaaccagaaggcaccaaagagaataaaaaaagagaaaaaagcacagcacaacccagagacaaccaaaggaaaagacagcaacgacacgacacaaaacaggacaaaaaaaagaacagaaacacacagaaaagaaagagaaaagaagaaaaagcaaaaagcaaaaaaacacaaaaacaaaaaaaaaaaacaaagcaaccacacaaaacagaaccaagaaaaaaaaagacaaaaaaaaaaaacaaaaaagacaaaaacaaaacaaaaacaaaaaggcaacaaagagaaagaaacagataacgagaaggggaaggcgaaagaaaaacaaaaacaaaacaaggacgaaaagaaaagagcaaacaaaaaggaaaagaaaaaaaaaagaaaaaacaaaaaggagcaaggaaaggaaagcgaaggaaacaaagagaagaaagaagacaaaagaagaagggagaaccgcaagaggacagaaaaagaaaaaaagcaggaagacaaacaaagcaaagaaaggcagaagaaaagaaagagggcgcaaacaggaacgaagaagaaaggagcgaaaaaaagagaaacaagagagagaagaagaaaagagacaaaaaggaagagagaaaggcacaaacagataaaggac

SEQ ID NO: 597813 - DNA, 270 bp, Homo sapiens
aaaaaaaaaaattcccccccccctttttttgggcggcccttagattttaacccccaaaaaggggtgaaggcggggttgggtgggggccacgagtccccccccttttgggggtggggtttttggtcccccccccttttttttaagaaaccccgtttttaaattttgggttcccgggggccgggggggaaacccatttggtttcccccccgggggccccccgttttttcaaaaaaaaaaaaaattttttggggggggttttttttttcccca

SEQ ID NO: 597814 - DNA, 225 bp, Homo sapiens
tccacccacatggacaggaatgtatagagacacccaccgccagtcgtgtgtcctgatgggatcacagggctctgatttgccttcgtgtcccacttcctgccatgcacaaaggcatgatatgcggtggcggtgaacagtgggagctggcggaaactgtcctgcggcagggtgcgggataccaagggcggggtaccggagcctcgaacttcgctaactcactggctc

SEQ ID NO: 597815 - DNA, 316 bp, Homo sapiens
gtttttttccccccccctttggggattttgcccccccggcccaaaattttggcccgggggcccctttccccccccccctggcccaaaaggttgaccccccccccccccccccccccaaaaaaaaaggggggtttttttttgtggcccccccccgggcctttgggcccttggggggggttttaaaagggggggaggggaaaaaaaaaattggggtttttttttgggaccccccccggccccttgggccccgggggggggtttttaattgggggggaggggtccccccatttttttttttttccccctggtcttttta

SEQ ID NO: 597816 - DNA, 338 bp, Homo sapiens
ggatacaaaatcaatgtacacaaattagtagcactgctatacaccaacagtgaccaagctgataattaaatcaagaactcaactccttttacaacagttgtaaaaaataacaaaataaaaatacttaagaatatacctaaccaaggaggtggtagatctctacaaggaaaactacaaaacactgctgaaataaatccgtaacacaaacaaatggaaacacatcccatgctcatggataggtagaatcaatattgtgaaaatgaccatactaccaaaagcaatctataaattcaatgcaattcccatgaaaataccatcatcattcttcacagaattaa

SEQ ID NO: 597817 - DNA, 125 bp, Homo sapiens
gtcacgcctggacgcagggttccagcgcatcggacttttcatctgatgggctcccgaatgccacgttgatcaccgccacctccaccagcgattgccccacttgacgccgccatcctgcgcggccg

SEQ ID NO: 597818 - DNA, 745 bp, Homo sapiens
  misc_feature (524)..(524): n is a, c, g, or t
aggtgttggcgccctgtgcggcttcgagggccgctccttcctggcttccccactctccgcgcctaccacacgctgcgcctggcactggaattcctgggctgctggagcctcaggggctgctgctgtacaatggcaacgccctggtggcaatggacttccatgtgcatttggcgctgctagatgtgcctgctgtgcatgctcagtgtttgacgacaggttctggtggcctggctggtgactgaccagttgcctgtgccaggatagatgcctgtggccatgtggcaacctgccctgtgatgcttgttccctggcaaccttgtgctggccctgtgtgggacgaaccacatacatacagtaggatggggcaactttgggggatatgggaatagaaacacacaccacagattggataaacacttgggggtggacctggacagcaatgagtaccacacaatgatttgtggaaaacactgaaaaatggagaacttaccaaaaaccttgtgaaccaaacatgtaacctactntattgtagtgcgctgtggctgtacccctggatggtacccatgtgacttgtccctgttgtgatgctttgtggagccgggacccttcgtttgtgtgctgcctgggacctgaagtggtggtgcatcacgtatttggcttgggactgtcaaacgaaccaagactgccgtggacgctatggcaatttgtggcccgtgggtggactgacaaaccccgagagctctgg

SEQ ID NO: 597819 - DNA, 515 bp, Homo sapiens
gtagttcatcttgatgtgaagcctcagaatattctgttgacaagtgagatctccatgtggcgtgacattaacgatctgtggatttgtggcctcttcaacgtaatattggacagaacacgtgagagagctccgatgcaagattactggcgtactccctggaagtagtgtggctgccgtgaatatctcttacgttactgactcctgataacgctatggcaaacaggatactgttggagcaattgggacgtggttaaccgatatggtcaggtgcttacaggtaatatcaccgtttcttaggcatatgatagacaccatgaaacattcttaagacatctcaccagactgagctttaagtctattctgaggaagacttcgactgtgtggtctgagtcggctgtggattctcatcaggacactttaagttaagaaaacctgaagatcgagccactggtgaagaatggtctaaagcacccctggttgacacagagcagtcttcaagagcctttctttcagga

SEQ ID NO: 597820 - DNA, 354 bp, Homo sapiens
  misc_feature (38)..(38): n is a, c, g, or t
  misc_feature (65)..(65): n is a, c, g, or t
  misc_feature (128)..(129): n is a, c, g, or t
  misc_feature (175)..(175): n is a, c, g, or t
  misc_feature (264)..(264): n is a, c, g, or t
  misc_feature (338)..(338): n is a, c, g, or t
tcttcttccaccatgtggctgtgctggagtttctctgngcctactctggttgaggaggctgcttnattcacaaagtgttctttgctcaattaaactgtgttaaattaaaacaacacaaaacaaaacannaaagccgggcatggtggcttatgcctgtagtcctagcactttgggnggctaaggcaggtggatcatttgaggccaagagtttgagaccagcctggccaacatggcaaaaccccatctctactaaaaatacagaantaagctaggtgtcatggcaggcacctgtaatcccaggtactcatgaggctgaggtaggagatgacttgaacccntgaggcatggtgcagt

SEQ ID NO: 597821 - DNA, 346 bp, Homo sapiens
taagctttcccctatttagctgaaaaagttattaaagctcaaattattaagggtgggaagtgggagtggaagggaggagatcaatacaacttatattttggcagtttcatactggaagaaaaaagttttcaatacctagaccaacttgttgaatttttaaaacttattgcactattaaatgtgcaactttctctacgtgcttctcctcagggcctttaggaagctttcaaatttttttgggtacgtggtggttgtgtatttaaatttgtgcaatatttgattgttaaaattacattgacagtggctagttacatgtgtttttacacaaaacaaaaacacaaagagg

SEQ ID NO: 597822 - DNA, 487 bp, Homo sapiens
  misc_feature (4)..(4): n is a, c, g, or t
agtntgattcatctcccctggtataggcccaccaaaaggacacggctaacgttcatgctcctacaacgtgccaggcacagagccacactcttttctaggtttttacttaagactcccagcgtgattatgagaactggccttattttcacacaggttgaaaatgaagcagtgggctcatgcccatctgcacaaggccccccaggcagagctggcagagctgggatccagctccaggtccgtgcacctccatgacatggatgcagtttagacaaggatgcctccctccagtggagaacacaaatgcctcacacatcagccagcctgcacatgcaggctaacaagggcactgactctggaaacacaggctctcctgcgacagtccacacggggcagctgagtggggccacccagcctgactgtccttgggaggatttcctaagtctttttcttcttaaagtaaatatatatgctgtccatcctaaaaaaa

SEQ ID NO: 597823 - DNA, 361 bp, Homo sapiens
  misc_feature (58)..(58): n is a, c, g, or t
  misc_feature (62)..(62): n is a, c, g, or t
  misc_feature (236)..(236): n is a, c, g, or t
  misc_feature (267)..(267): n is a, c, g, or t
  misc_feature (323)..(323): n is a, c, g, or t
gcttgccggagcgcttgccgtcgatgttgaggctcttcaagtcattcttgtgcctcancctncccagtagctgggatttacaggcgagtgccaccacacccggctaatttttgtatttttagtggagacaggtcttcgtttgacaggctggtctcgaactcctggcctcaagtgatctgcctgccttggcttcccaaagtgctggtattacaggtgtgagccactgcatccagccnctctaatctacttgcttactcttgaatttgnctgttataagcactagatataaatggagtcatataatatttgcccttttgtgtctngcttatttcacttgtcttcataatgtcttcagggttca

SEQ ID NO: 597824 - DNA, 588 bp, Homo sapiens
  misc_feature (65)..(65): n is a, c, g, or t
  misc_feature (75)..(75): n is a, c, g, or t
  misc_feature (81)..(81): n is a, c, g, or t
  misc_feature (89)..(89): n is a, c, g, or t
  misc_feature (128)..(128): n is a, c, g, or t
  misc_feature (165)..(165): n is a, c, g, or t
  misc_feature (173)..(173): n is a, c, g, or t
  misc_feature (186)..(186): n is a, c, g, or t
  misc_feature (202)..(202): n is a, c, g, or t
  misc_feature (240)..(240): n is a, c, g, or t
aacatatacgaatgagccggacctagctcgatgcgtgccgtgaggtgttcgccaagtggctcganttctccagtnaatagngcggtcanggaatgcgctctgacggccccggttgagcctcggtcttnatcgtaggagccaccaacaaacgcttccagatgcgcnctatctanatttgacaaaaangcttaacgttaatgtnggagtccatacgaacccacgagcggccacatctcatgnatgcaagaaatcctgcacgtatctcgatttgcatagtaggtaattcagcacagacggctctcaatttcatggtggtgggcgctgatccgcgacctgtgttccagaggggcccgagtgcaagtgttggcgcctcgttggacgacggctgcccgggcgcagctcgaacgatggggggcggagggagtggagtaccccttgtctccgggtcgggctgactcccctcgccgatttgcgctccttatgggcgctttaccttcatcttcggcgcgagaggccgcgggtggtgcttacttatattgcgaaacccaaacctactggggcatactcgccgcgacgctggcttggtgt

SEQ ID NO: 597825 - DNA, 680 bp, Homo sapiens
tgtgtttacccagggtgtgggcccttcccgatgcctcacaagttgcccccgcaataagccctcacccgcccgtcctgccgagtgcggccgcgccaatggcgcgtcaatacgcgaacacatatggactcgtttctgtactgatacgctcgtactcactttccactcgggagacaccccacacaagtcgcccaaacctcggctcaattgattctgcctacagcctgttcattctacataacaagactggacagctatcagcgctatctcgtcaatccgcacacgcctgcaacatttctatgaacaagcttctttcacgagaacagaatctattttagaactgtcagatcctgacccagtcaagcccccctcccagccccccttcacaagtgactccgtgccttgagtgtgtcattgcgtgttcacaccacgtgccatctgtctggccgccccaagtgcgaggaggcacccctgccttgccctcagcagaattgggttaccaagggctgttccagatcaacgtgcacaacgtcatctgagggacaatgctcccagcggccatggccccaggctctattaacactaaaatgtagctccatagcgctaacactaggaaccgccgcatgccatgtatggggggcaacgcccctagtgcccttgtcccaggccagggcttcagcgta

SEQ ID NO: 597826 - DNA, 665 bp, Homo sapiens
  misc_feature (496)..(496): n is a, c, g, or t
  misc_feature (534)..(534): n is a, c, g, or t
  misc_feature (616)..(616): n is a, c, g, or t
tactttccaacctgactctggcataacattatgaaacaaggaagaaaatcaaaataccccaaaaacatgtttctttgccatattttgaaatggtccctgcatagctgttctttgtgggggaaaatttgcatctgtaaagaatctcagttaacatagccagatctttttcttccagaccctcccaatcctgaagagattaattaagatctgaataggaaatattggtcacctattgtctctaagggcagccactataagacttcaaaagaactttggtttccacaatctttattttttatttatttatttttttgagacggagtctctcgctttgtcacccaggctggagtgcaatggcacgatctgatcttggctcactgcaacctccgcctctccagttcaagcaattctccttcctcagcctcccgagtagctaggactatgggtgcacaccgccacacctggctaatttcttttgtattttagtagagacggngtttcaccatgttgcccaggctggtcccgaactcctgngctcaggcaatccacctgccttggcctcccaaagtgctaggattacaggtgtgagctagttgaaatgcttagcctagcattntcaacttatcacataattcttttccaaaatggccacccttgttttgaaa

SEQ ID NO: 597827 - DNA, 232 bp, Homo sapiens
cctcctcaggcccccggatagggaacagcacgactggcacagtgagggcaccgcagcagcacggcaggccacacagaggatgagcggtccttctggctgacatgtgcagcatctcgcttacactgctgagaaggtaggatccaaaggttgctgtgagcccatacatcgaacaggcccaatggacacgtgccacggctgcatctgcgctggaggccgcagagctcgatagatg

SEQ ID NO: 597828 - DNA, 786 bp, Homo sapiens
  misc_feature (42)..(42): n is a, c, g, or t
  misc_feature (61)..(61): n is a, c, g, or t
  misc_feature (76)..(76): n is a, c, g, or t
  misc_feature (78)..(78): n is a, c, g, or t
  misc_feature (90)..(90): n is a, c, g, or t
  misc_feature (99)..(99): n is a, c, g, or t
  misc_feature (103)..(103): n is a, c, g, or t
  misc_feature (105)..(105): n is a, c, g, or t
  misc_feature (111)..(111): n is a, c, g, or t
  misc_feature (115)..(115): n is a, c, g, or t
  misc_feature (125)..(125): n is a, c, g, or t
  misc_feature (128)..(128): n is a, c, g, or t
  misc_feature (133)..(133): n is a, c, g, or t
  misc_feature (141)..(141): n is a, c, g, or t
  misc_feature (143)..(143): n is a, c, g, or t
  misc_feature (150)..(150): n is a, c, g, or t
  misc_feature (156)..(156): n is a, c, g, or t
  misc_feature (168)..(168): n is a, c, g, or t
  misc_feature (181)..(181): n is a, c, g, or t
  misc_feature (188)..(188): n is a, c, g, or t
  misc_feature (213)..(213): n is a, c, g, or t
  misc_feature (217)..(217): n is a, c, g, or t
  misc_feature (223)..(223): n is a, c, g, or t
  misc_feature (234)..(234): n is a, c, g, or t
  misc_feature (247)..(247): n is a, c, g, or t
  misc_feature (267)..(267): n is a, c, g, or t
  misc_feature (280)..(280): n is a, c, g, or t
  misc_feature (292)..(292): n is a, c, g, or t
  misc_feature (295)..(295): n is a, c, g, or t
  misc_feature (320)..(320): n is a, c, g, or t
  misc_feature (326)..(326): n is a, c, g, or t
  misc_feature (340)..(340): n is a, c, g, or t
  misc_feature (347)..(347): n is a, c, g, or t
  misc_feature (374)..(374): n is a, c, g, or t
  misc_feature (384)..(384): n is a, c, g, or t
  misc_feature (388)..(388): n is a, c, g, or t
  misc_feature (393)..(393): n is a, c, g, or t
  misc_feature (403)..(403): n is a, c, g, or t
  misc_feature (411)..(411): n is a, c, g, or t
  misc_feature (413)..(413): n is a, c, g, or t
  misc_feature (417)..(417): n is a, c, g, or t
  misc_feature (435)..(435): n is a, c, g, or t
  misc_feature (437)..(437): n is a, c, g, or t
  misc_feature (442)..(442): n is a, c, g, or t
  misc_feature (447)..(447): n is a, c, g, or t
  misc_feature (450)..(450): n is a, c, g, or t
  misc_feature (455)..(455): n is a, c, g, or t
  misc_feature (468)..(468): n is a, c, g, or t
  misc_feature (481)..(481): n is a, c, g, or t
  misc_feature (484)..(484): n is a, c, g, or t
  misc_feature (486)..(486): n is a, c, g, or t
  misc_feature (488)..(488): n is a, c, g, or t
  misc_feature (524)..(524): n is a, c, g, or t
  misc_feature (528)..(528): n is a, c, g, or t
  misc_feature (535)..(535): n is a, c, g, or t
  misc_feature (538)..(538): n is a, c, g, or t
  misc_feature (560)..(560): n is a, c, g, or t
  misc_feature (575)..(575): n is a, c, g, or t
  misc_feature (660)..(660): n is a, c, g, or t
  misc_feature (678)..(678): n is a, c, g, or t
  misc_feature (773)..(773): n is a, c, g, or t
gatccaggtccatggatgaaaactaaaggcccgagttaatcncattgtagtttttaaattnctacagcctagagcncnctagtcacaggncttttaggncctncnggatgncccncagggtatcngcnctttncttgagcngngcaaccncatcancctttagcttcnggttgataacgcnggttaanccccgggcattgaggatacatgganggcncaggangacttcattcncaatgccatacancccctttaccattgtggacncgggatgaatccnggatagattttncancatggattcaataagatcagccacncttaanccaatagcccagtnggtatanccttttagcttgatgacttcataggcnctttcaaccnccancttangcccttcctnccaatttncnctancattgtcagtccccattncnggatncaatnccnggggngaaacccctgccncattcaccccccnccncncngccacccttgggtggccatgtccccccaaaatccanccanggcagcngcngggatgaatgccaagtttttcngccatagggtggcgnaatctagcggaatccggattacatccacttccaatcacgcggtgtttgggtaatccacttagtttccaggtaacatacgttagantgtccactgggttggaancacaattatgatgcaatcaggactgtacttgacgatctgaggaataatgaatttgaagacattaacatttctctgcaccagattgagccgactcncccttcttgctga

SEQ ID NO: 597829 - DNA, 188 bp, Homo sapiens
ccctcatagcctcactccccgatgaggcgctaggtgtacgccgtgagccccgggtcgctggaggagctcgttggtggaacggggtccatccccacctgctatattctaacggcaaaccctgattttggatattatttgcattataaacacgtttcagtgttttggcagcattccgtgattttagcatt

SEQ ID NO: 597830 - DNA, 189 bp, Homo sapiens
cctgccgttatgtatgtgtgtgtgtgtgtgcgtgtgtgttcggtgtcttataactcttcccctatttcttacaattcgcaacgatgactaggctttactatttgcacacgggtgtgtgtatcatctcatatctcatttaacgcagttagaaggcatacttttgcatagatataaaaaaaatactgatcg

SEQ ID NO: 597831 - DNA, 1176 bp, Homo sapiens
agcaagatccgtgaggagtacccagacaggatcatgaagcatcggtttagtgtgagtgcgattcgcccgataagtgtctagacgactaggtggtgcgagcctctacaacgccaatcgccttcgtcaggtcctagccacgtcgtcgttacgtaaacacacagatcgatgacctatcgtgcattcgataagcgacagtcgtcttcttacgacgaattgtgctttcagaaatccgcgttgagatgcttgactcactggctccactcggttatggtgacctggaagccatcgctgtgtgctctgcataccgagtgatgtgtggcgtcaccttcgtgtcctggcgtcttcctcaggaccaggctcgattgctgtatcgctgcggatagctgcgctgtggactcttggtcgccgtttctcccgggctggcacttcgttcgatgtcccggtcgtttgcccccttgctgtactcgagcccggggatcgattcgagcgaggtgaccgggtcggctggagctcgtagcgccgagcttcgaaccccagccagatggtttggatggccggagtaacattggatgcgctgtgcttgtcgtacctcggcgcccattggcacgcctaacctgaagcggtccggggcgatcgtcgtctcaagggggcgcgttaatggctccatgggaatgcgaaggttggtcattgacgcagatattggctttgaatcgttccaaggaccaagaatcggatccagacatttctggttgaaagtggcattgcccccaaactgagtgttgtaaaaaaccgcgtcgttagatcttggttgaacagttccccatgcctacgggggggctaaaaagagttgtccccgcacaacgttacccatttggggtcaatctaagcgaacgggtcccattccccaggaaaagcctgaccccaaaggccggccacatcttcccggaaagcagaggttcccacgagggaccgatggatacccgagcaggcataagggggccgtggtccctggtccaacttgggtgaagcccaggggtgcacagggtcatgggtcaccgagaaagtcgtaggctcaacacggaacgagcccaggatggcgcccacttgtgaaaaggtgacccgtggggggtgcccgaagagaaccactgcgagtctcccaaggaatgcgtcacaagc

SEQ ID NO: 597832 - DNA, 579 bp, Homo sapiens
  misc_feature (369)..(369): n is a, c, g, or t
  misc_feature (372)..(372): n is a, c, g, or t
  misc_feature (382)..(382): n is a, c, g, or t
  misc_feature (391)..(391): n is a, c, g, or t
  misc_feature (411)..(411): n is a, c, g, or t
  misc_feature (416)..(416): n is a, c, g, or t
  misc_feature (459)..(459): n is a, c, g, or t
  misc_feature (467)..(467): n is a, c, g, or t
  misc_feature (470)..(470): n is a, c, g, or t
  misc_feature (525)..(525): n is a, c, g, or t
  misc_feature (539)..(539): n is a, c, g, or t
ttgcccccccactatgggtgtccacactcgttctttgggggcccccactttcgtagccacactcttggaaaggggttcccacgccgaggggcgcacctattgctctctttgtggcccgcgcgggtgaaggagcctctccacgttcttatttggagagaaagacccaaggggacgcgctggacccgcggtcacgcgtcggaaagagggaggcgagggctaacgtgcccaccctcctacctccgagtcaccgctccattgaaccctcgcccgagaccgcggaagaggggggactcttcgcgcttctcgctctttgtggccaccgcgggaggcccccggagcctatgcacctttatttctgagccccgtggnttnggctgagacntgtgtaacntgctgccccctccacccccnacccngtcctacctgtcacaccggacggacccgctgtgccttctaccntcgttccnccnttgatgtacatactcatgttttacatcttttctttctgccgctcggctccggccnttttgttttatacnaaaatgggaaaaaaaaaaaagaaattatataaagttccta

SEQ ID NO: 597833 - DNA, 488 bp, Homo sapiens
  misc_feature (9)..(9): n is a, c, g, or t
  misc_feature (108)..(108): n is a, c, g, or t
  misc_feature (278)..(278): n is a, c, g, or t
  misc_feature (281)..(281): n is a, c, g, or t
  misc_feature (291)..(291): n is a, c, g, or t
  misc_feature (300)..(300): n is a, c, g, or t
  misc_feature (320)..(320): n is a, c, g, or t
  misc_feature (325)..(325): n is a, c, g, or t
  misc_feature (368)..(368): n is a, c, g, or t
  misc_feature (376)..(376): n is a, c, g, or t
  misc_feature (379)..(379): n is a, c, g, or t
  misc_feature (434)..(434): n is a, c, g, or t
  misc_feature (448)..(448): n is a, c, g, or t
ataggttantgggtggttatatataaatttgaagggtttagtgagggtattatttttatggtgaggggtgaagatttagtttttatggaagaagataaaggggatggntggatttgggttaggtggaaagagggaggtgagggatatgtgtttattttttatttttgagttatgtttaattgaattttgttagagatgggaagaggggggttgttggttgttggttttgggttatggggagtttaaggattaatgtattttatttttgactttgtggnttnggctgagacntgtgtaacntgctgccccctccacccccnacccngtcctacctgtcacaccggacggacccgctgtgccttctaccntcgttccnccnttgatgtacatactcatgttttacatcttttctttctgccgctcggctccggccnttttgttttatacnaaaatgggaaaaaaaaaaaagaaattatataaagttccta

SEQ ID NO: 597834 - DNA, 353 bp, Homo sapiens
ggacatggttgccattagtaagcagagatcaaagtttctcatttcaagcacatatggccatcaggacacaagagaggcgttacatgcattctaatacacacgggggagcagtgattgcgaactagatctagcagataccagggaggagaataagcgggacaaagtaatctcacatcatgtgtcttattaaatacccacgtgctcattatatattatagcatggttctatcttctcacgttacccacaatatcactaaataacaactgctaacaaccgtcctccttcccagtactggtctgacgcagaaggcccatggcaaagccttccatatcccagtacaacctgccggtgg

SEQ ID NO: 597835 - DNA, 359 bp, Homo sapiens
caataaaaaaggggttcccagttttagggacatatatgattccctaggggttcagaaattaggctccctttaaaaaaacccagccggggccgggggttcagcctggtaatcccagtattttggggggccaagggggggggttcccaaggtcgggggtccaagccccgcctgacagggggaaccccggtttttactaaaaaaccaaaaattagcgggggggggggacccccgccggtattcccggctattcggggggcagggcgggagaatggtttgacccggggggggggggggtgcggggggcccagttggggttttggccccccggcgggggcaaggggggggggcccctttcccca

SEQ ID NO: 597836 - DNA, 407 bp, Homo sapiens
  misc_feature (98)..(98): n is a, c, g, or t
  misc_feature (323)..(323): n is a, c, g, or t
  misc_feature (325)..(325): n is a, c, g, or t
agccaggccatgaccacttgtttgttctgaagatgctgccagtgctgaccttgaggtcatgtaggaaggaaatggaaggccttcctgtaggtgagggncaaccaggaagagctagcatctgtttggaggatagggtgtagttgtgcagataggagaaaacttggaaaaaagaagtatgtaatattatgttagtaaatgttctggagtcagtttataccagtttctttgacagtgaaattagctgtaactaaaccagtgccattgcagtgaactcttaaaggatgtctctgatgtgatctttttttgttttttttttttttgananggagtctcgcgctgtcgcccaggctggagtgtagtggcgtgatctcggctccagcctgggtgagagagcaaaactccgtctc

SEQ ID NO: 597837 - DNA, 151 bp, Homo sapiens
  misc_feature (133)..(133): n is a, c, g, or t
  misc_feature (140)..(140): n is a, c, g, or t
gtatagcttaaacatcttgggaccttttcttagtatggtaaacaagaatagaaagggcttgctagctctgtaggtattctcatacttcttgaattcctaattacgaaaccaaaccaaacaaataaattgttgntgtgacnagtgtcacact

SEQ ID NO: 597838 - DNA, 461 bp, Homo sapiens
tgcatcatgccagccaggtacaggtgcggaggaggacacgggacacctttccatgcattcagaatggttccttaaaatcatcagttaactttttttttttggagatggagtctcacggtgtcgcccaggcgggagtgcaggggcacaatccgggctcacggcaagctcggcctcccgagttcaagcgattctcatgcctcagcctcccaagtagctgggacatacgggcgcccaccaccacgccgggctaattttttctgttttaagtagagacgagggtttcacgggtgtaagccaggagggtctggatctccgtgacctcaggtgatctggccgcctcggcctcccaaagggctggggataagaggcgtgagccatggcacccggcccactttaaattttttaagcttttaaatgtttggtagagacgggggtctcactggtgtggcagggtgctccgg

SEQ ID NO: 597839 - DNA, 1074 bp, Homo sapiens
gtagagtgctggtgcggaacttgcctgccccagcagctgccggcgggctaagcccatgggcctgggcagacaaaagatggtcggccgcggtaggaaggcacggcctggcggatggctggacgcgcatgcgactggcctgggctgacgggggcatgcgctgcatgcatggctcatgatgctggtggcacttggcatgccctgtcagggtgtgctctctgaggctgccagaagggccccaggatgccctggtggctgccgcgcaggctggtgccatgcagtgctagccgcctgagctggacttgcaagcagatgcatggaccggcgctcgtcccttctgacgtaccgacctgcatacctccgtaagctgcgctgaaggctgctctgtagtccagtgttggcttgcagttgcacacgcacagtcagtcaggcatttcacacaggctgtgggctgccagcattcggacgaggcccggagcaagctaccgtgggtcgatcagcaggcttgtctatgagcacacctctgttctgtcccatgtaagccttgtgtgtcgccgtagaactttacgcatacactcggggaattatgcactggggaactgagtgctgcttgggagcgacgacacttgctcattataccttgggccccagatcacctcatgcgaccgaactaccacgcaagggggaaccgagacgcatctgtccacccttactccacgagtacccggcattcacattcatgccttcccatgaacccagaatggctttgcgaacggcagggtctcagcctgtatgaactcaagggatggtttgcgcgttcacagccatggcccggggcattagttggtcccggaagtttcaaaccgtgaatggctccgtccgtcattaacacaggttgtccaccaccactttttccgagtgttgcaaccgtggtctcaaccaaggcgtcgcgtcacaacaggagacactaggacgatagtaacccttcggcgtcgcacacctggtgctgtgcgacaataaagaacagtggatgcaagcgccaaccctgcgaagtccacggtcgcacccatcaggcgt

SEQ ID NO: 597840 - DNA, 141 bp, Homo sapiens
cgttccaacatctcactcgcgcttccaacatctcatgacgcctccaacatctccatcactccttcccaacatctcatggctccgtcccaacatctcatgcctgccgttccaacatctccatggctccgttccagacatctc

SEQ ID NO: 597841 - DNA, 296 bp, Homo sapiens
  misc_feature (55)..(55): n is a, c, g, or t
  misc_feature (69)..(69): n is a, c, g, or t
  misc_feature (71)..(71): n is a, c, g, or t
  misc_feature (82)..(82): n is a, c, g, or t
  misc_feature (85)..(85): n is a, c, g, or t
  misc_feature (90)..(90): n is a, c, g, or t
  misc_feature (95)..(95): n is a, c, g, or t
  misc_feature (136)..(136): n is a, c, g, or t
  misc_feature (217)..(217): n is a, c, g, or t
  misc_feature (247)..(247): n is a, c, g, or t
  misc_feature (263)..(263): n is a, c, g, or t
cttgtagcttctaccctagtttcccatcctctctctgtggaggccaaaccaactntttgccagcagccncnacatgcattgncancggcncagtnagatataactgatgggctttgaacctggttggccggggaanctgtaggggtggataaagctggctttccttttgggctgtttccatttgaccctaccccttccatgtcccaccccactcccnccaaaaagtacaaaatcaggatgtttttcnctgtccattgctttgngttttaataaacaatttgcagtgaaaaaaaaaa

SEQ ID NO: 597842 - DNA, 436 bp, Homo sapiens
  misc_feature (276)..(276): n is a, c, g, or t
  misc_feature (357)..(357): n is a, c, g, or t
  misc_feature (387)..(387): n is a, c, g, or t
  misc_feature (403)..(403): n is a, c, g, or t
tttttcacaaagttcccccggatagaaaggctgtccagtctaagctcagggcagcctcttcaaccactgttggcccagcctggcttgtgaggaaaccagccctgtccctcagtattgaacttggctgcttgtgggatccagtcctggaggacaggcatcaagttcttagcctctgtagctcttagctttcccatctttccctgcaaggccacaccgtgcatttacagcagtgtggcaaggtgtaggagggaccttgaacctggttggccggggaanctgtaggggtggataaagctggctttccttttgggctgtttccatttgaccctaccccttccatgtcccaccccactcccnccaaaaagtacaaaatcaggatgtttttcnctgtccattgctttgngttttaataaacaatttgcagtgaaaaaaaaaa

SEQ ID NO: 597843 - DNA, 887 bp, Homo sapiens
  misc_feature (98)..(98): n is a, c, g, or t
  misc_feature (308)..(308): n is a, c, g, or t
agcgggagctgggctggcggagcgagaggtgcacgaagcgaacgtgagtccacagttgtctggtcggcttcagcgtggacccagtaagacgtccccanactcgaggcagattcagcgaatcactcacatcgctggtacagaagtgatagttcctacacgggcactgccatctgtctctgagattatagattgtccagccgtcccagagggggctcacatggcggtgacctgtgatgcacctcagtccatactcgcgccttcgacaggcgacgtgctgtctccattcccactggcgcttgtgactttcnctcggatgagctgccggcccggctgctggtgcaatgagtgatctgggtactatcaagtagccgccataccccaagagactagctcccgccggatggatcttcagagtgcgcggcgaccgcaaggtcagtccaccgagagcttcccagagagccgcaagacacgccgtcctggcgggcgtacctgggtcctgccgagaacttggcactcctcctggtctcgagcgaactgtctagcccacgaggctggggcgagagagagtactatctctccgatgcgggaacctgcggctggctatcaacctaggtgacacctgtactcagagtcaacagcgtccatggagaatcagtctagagaagcctcatatatctgtggtgcccccgagaggtggtcggctacggcaccggagggtggaacgtccagctgcgatggtgccgggacaagtgggccagagcttgctgccctgagctggagcttggctgggccacgaggggctggagggaagcccgtctgtgctgggccggctgcgggaggacgagggcacctggggtgcaggtgtcactggtgcactttcgtgccca

SEQ ID NO: 597844 - DNA, 222 bp, Homo sapiens
cccaatcttatttgctttacaagtcctgcttcaggggtaccttccctgcggctttactaaaaatacacaaaaaaattatccccgtgtggtggtgggtgcctgtagtcccacctacttgggaggctgaggcaggagaatctctaacccacgaggcggagggtacagtcagctgagaccgcaccattgcactctaacctgggtgacacagcaagatttcgtctc

SEQ ID NO: 597845 - DNA, 111 bp, Homo sapiens
  misc_feature (32)..(32): n is a, c, g, or t
tggttgggggggggcccccaaagttttagttnctgatttccttttccaaaaaaggggggttggtccatgggtttccccaaaaaaaaaaaaaaggctttttgtcccgggcca

SEQ ID NO: 597846 - DNA, 289 bp, Homo sapiens
atgcaggcgcttgcaatcccagctactcagaaggaagattttggcgaatcgttttaacctgggaggcagaggttgcagtgaaccgagatagtgccactgcactccagactaggtgactcccatatatatatatgggagtttattaagtattaactcacaggatcacaaggtcccacaataggctgtctgcaggctgaggagcgaggagagccagtctgagttccaaaactgaagaacttgaagtctgatgttcgagggcaggaagcatcccgcatgggagaaagaggta

SEQ ID NO: 597847 - DNA, 1149 bp, Homo sapiens
gtagagacagcatccatagctggaacgtatgcgacgcagagatagaatgattgtgtaacatgtggagttcattgtcgtcaatcatcattgttgttttgttcgatcatatcaatagtagtgaacacacctcttatatttgtggggaccacagtcatccagacataaggtgggcagagtattcgacatagctcatcagtggagcgcaacaacgcaacattttgatgtcgcaacaatctcgttcgtgtgtaatattatattagtgagtgtcaaccacataatgagcgccattgtggtcggtgagcaaggttgctactaccgtggggacaatacctccacattagtttgcttacccggctgttattaccacacagatagggggtgagctgatcctctcatgaggagtgcagagcggtccatacgccatattataatgtgtgctgtttcgtcacagctcgcacaaagagttgtgtgcggaacacataattattattgtcacacgcggaattaaacagcaacacactggacgccacccacgattataagataagggggagagatatagttgggctctactagatgtggggtgggctaattggagtagtgataggggggagacatctcacattggggtcttgtttggtaaagatggttaatgacgcatgacataattccggcgttgaagataacgacgttaacaaacaacgctatgatgggtagtccagtgcatacactacgcctagacagtgggcgcgcctcacatcagccaactgagatgtcgcgtatatagttgtgggtcttaccactatagcactttgtgggacacactatgggcaacaacaaatgttgtgcgcaccaaagccacatgggtgcaacaccacattggcgggggcagaaatgctgcatgtctaaactactattcacgttacgcaatcgatgtactcgatagtgcctaaaatcatgggtatagccacatatttgggggaggaggagagatttttagccatgctaacacgcagctcggcccacaaggtccaacagggactacacagcgtcactgttaacatatacttacagtgtttgtggcccaatggggttggggggggttttttcaaagaaaatttttgtttaaattttcttgtgtgaccaaca

SEQ ID NO: 597848 - DNA, 503 bp, Homo sapiens
gctcggaccacaacgctgactcttccgcaccacctgcagaaggtgggagaatggcttccaggcagagagaagggtggagcagaagcactcagcgttggagggagtggtgtggtcctggaacacggtgctgcctgggagctctggctaaagtgtgggcttcctggatgtggggagatgcaaagtgctctagaacttgttctgtaggaaataggggagccatcaaaagttttgagaggggaagtaataaggaagacgcttctgttggccatggggagaatgagtggaaaaggggtagtggctgagtgactagacctgttctgagagttttatgggagagacattaagacctggactctcgcaatggaggtgcagaggaagattgagagcttctgtacttttctgaaatgtgagagctcagttttaaagtttagattggactgagtttattaaagaaaaagaaaatgtttttgacacatgtcaatctttgttgacacccgttggta

SEQ ID NO: 597849 - DNA, 325 bp, Homo sapiens
agactttgcctatgtctagaataaggagaggagacctggaagaactgcaagtttaaactcaagagttactgagaatacagaaaatacctgcagagctgggaagccaatgggaatacagaaaagcttgcagaattgaagaatcctgaaaaccccaagtgctttcaatccagacccaggctcccagggggacactgtgatggcactcactccaacagttccctagcaaaggtctccaagctggtctcctggagaatgttcccttcttggaaagctgcagctaatgaaactaaaataaatgataaaaggatatttgattctcagaaaa

SEQ ID NO: 597850 - DNA, 863 bp, Homo sapiens
agctgagtggttgtgtggtcgcgtctcggaaaacggtagcgctgtgctagctatggttagatcaatgattgaaggagcaccattgcagaattccaatgaagcttggtcactatttgacagagatggtgatggaattataacaacagaggaatagggaacttgtaatgagatctcttgggcagaatcttcacaggaaacagagttacaggacatgattaatgaagtagatgctgatggtcatgggacaattgagttcccgtgaattgctgacaatgatggcaagaaaaatgaaagacaagacagtgacgaagacattagagaagcgatccgtgtgttgataaggagtggcctgggtatagttaagggctgtaagaacttcgccagtgtgatgaccaaagcctgggtggagaagtgaaacagagtgacagtaagtgatgagaatgatcagggaagcagatatgatggtgatggtcaagtagactatgaagagtttgtgacaaatgatgagtgtatcgtgaagaccttgtgcagcatggtgttaaatttcttgttcaacagtgtattgccttgctttggttgtaactgatctgtagagttgctcctatgttagaaaagttgctgtgttgtattgaggatgcattcgtcagttgactccttatttacgatgggctaaactttttagaaatggcagtaactgtgatgggtaacggtaattaagcttgggaattaattaatgggtgtaggggaccagggctgctgaaaaataaaaggatgggagagggatgggtgatgggacagatcagtagagaggagacaaatgagggaagacatgggagaaagtcaggacgtgagaaagtgtagag

SEQ ID NO: 597851 - DNA, 286 bp, Homo sapiens
aggaggttgaggcaggaggatcacttgaggccaggggttcaagaccagcctgggcaacatagcaagatcccatctctaaaaaatgtttaaaaaaacttagccagatgtggtggttcacacctgtattcccagccactcaggaagctgaggctcagaatatcaggctgcagtgagccatgatcgtgccactgcatgaaccccagcctggctgacagagtgagaccctgtttcaaaaaaaaagaaaatgccatccgcagtgctgggacctgcgttcttacctcacctg

SEQ ID NO: 597852 - DNA, 915 bp, Homo sapiens
gggtcagtgtgacctccaggatatagacggccccccttcagccacagccctagtgaggtctcctacacgcgcagcatgccattcggtaacatccacaacaagttcaagctgaattacaagccggaggaggagtagcaacccgacctaagaaaagataacatatcgactaggtgggcaaggatacggagcacctttgaacttctacgagaggctgcgggacaaggagactccttctggcttcactgtgagaagatgtcatccagacaggagagggaaaccaggtcacccccttcattcttgaccgtgggctgctgtggcatggtgatgaggagtccctacggcgtgttcagggacacgctatgaaccccaatcagttctcggatcgacacgggggccgtacaaacgccagttgacaagcaacaagactgagctcaaccatgagaacctcaggggtggagacgaccgtgaacccaactgaggtgcgcagcagaccgggttcgctactggccgcggccgatcaggggtgacacgtgacgcccacaaatgggccccgtggggagcgcgggcggtggatacgcgcaactgagagaggctcatcacaagctgacgggcacgagaaccaacggagaaggaaataggcatcgtatacgacggcaatgacactggaaggagaggacagacggaacaacgagggaccatgcctgtacagaagagaccggtcaccgaagggggtgcctggtgatgggccgaaccggaccagaggcccgtggaatggaaaagaaacaagagacctggtgaggggagaagaacagtcggcaccaaagaacgggaaatagcggaacccagcagcaaagtaaaaagccacacacaaaggcggcagtaaagggaagacaaaagaagaacgaaaagagaaac

SEQ ID NO: 597853 - DNA, 151 bp, Homo sapiens
aaaatacgcctgcaccccagtatgcgctgtctggagtaagaggactgagatgccagctgtggggcccgtcaaggagtcacgtctcaatgagaggggtgacccatgattttttgcaaacgttggtggaagagacctctaattccatgaccta

SEQ ID NO: 597854 - DNA, 178 bp, Homo sapiens
tagaggatccctgcttgctgcgggcactgcgtgtggcggttgcggggttcgctgcggaactcgctttgcggcttcgcgcgcgctcagacaaccgcagcgagtcagatcacgaagcagtcctgtccttcggcaggactgcaaccccgcaaccaccacgccgcaggcgctgacatacggg

SEQ ID NO: 597855 - DNA, 326 bp, Homo sapiens
gtcgactgcagtgacggagaatgtcaccacaatactcctagtggtgtctcaaacaggagaaattacgggagaatacttacagaagtttagagcctgggctgaacagttttaaggaagatctgcaagatgaggaactggttgggactgggcatagcttagggcttaacagctttttggattggtcggcatagcatggtcgcctgaagtgaacctaataagcaagttgtaagccttgaccaaaaacgcaaacaaaattaaggaactcagacaggtgtggtggctcattcctgtattacgagcacttgggaggctgaggcaggaggatt

SEQ ID NO: 597856 - DNA, 433 bp, Homo sapiens
ggtctgcatatcacatagaggcttcctttacatatttgagccatcctaaatctataattttctgtttacttgtagccaataagtgcctccattaaaaaagtagaaagatatcacataaactacctaatgctgcacctcagggaactagaaaagttaagaacaaactaacatccgtcgaaaaatttaaggtaaggaaacagaaaagaaaataataaaaggccaggagcaggaaataagaataggaaacgtgacaaaaatacgaaagaaatccaacaagaagtggaacaaagtttttattaaaaagagcacaaaaaatttgcatacaacgtgcgtaagcggaagggccaaaacccaaagcaaacacacacaggaggaacaaaggaacccccgaaaagttacacactttaaggacaacattgggcaaacagcaaag

SEQ ID NO: 597857 - DNA, 145 bp, Homo sapiens
cagaatactgtgacatcaaatgtacgaatatagtgtggatatgtggagttcgggttgtatgctggcaagtatgatctttcggaaggagccattcttccatggacatgacaattatgatcagttggtgaggatagccaaggttctg

SEQ ID NO: 597858 - DNA, 332 bp, Homo sapiens
gtttcttcccttgtttcgtgtggaatgtggtgacctagtcacctggaaccagctcctgacagaccccggcaacttctagatgaacccaagtgaactttcctcattaccatcctgaagtcactaccccagggggagctatagcttcatgaccgtaaaatgtgacctgtgtgctggcaggacgactcactgcggctgcgccactgggacccctcccctacatgcaccaatgcactctctcccctctccatcaccccataaaaccctcctgtcactttccttcagagacaccgctttggagagtattcccagcgctctccttgcttgtgacaagt

SEQ ID NO: 597859 - DNA, 933 bp, Homo sapiens
ggtgaccgcgttgtctatatacatctctgttgtggcgttggtcaagatggaaggatgtgttatcgagttgtgacaggcgcgtgtgtgtgcaatgacctcttgtggttcggcgcccctccgagatttgtgggacaccgggtgggcccccctttgggggtgtcccaagattgaacgccgccgtgaggtttttggaaaacgccaattggttgaaagaggaaccgcctgacgctttcgcgggctccccaggagatcgcgtctggggaattgggaagccatgggcccaccgccccgcacgcatggggcgtgtttgtcacccgccccagttgggcggccccccgtgtgcccctggtaaccttttctccgcccggtgggtattagtgcccgcctgctcgcccccctaaaagcgtggggaaaagccgagccgaattctgagtgcagtacctggactccccgcgtctttcaaacagggtgaccctttcttctcctcgcttcctcggcagatgtgaccttcggagtcacctacgtcccccccgcgtccctctcttgtaaggtgtatcagctccctaggctccccccattctaggggggttcagtcctccttgggtccccttttactcccctaagacccggtctcactcaataaaaagaatttaccggcgccggaatttatgaacgcacatctttgtcatcacccaaatcctgccccgcaggcatgaggaactcggaaccccgcctctgtaaaatccagcatctcctttgtcctcccccggtcccaaccttaaaccaatactcttctctcaaagatcccccccttatcagaagcccccctcaatcttctcactcagtgaaaacaagacaacaataataagtttcctactctaaaaaacagcactctggggatttaaaaaaaatctttttttacaaccacataac

SEQ ID NO: 597860 - DNA, 214 bp, Homo sapiens
  misc_feature (17)..(17): n is a, c, g, or t
ggtattcatatggcggngtaggagtaaaaaagggaataatccttatagaggagaatcggcaatagcggacaaaactaaaaatctatatacccttggacccacagttctacttcggggaatttaaagtatacacatactggcacatgtacaaaaaagttacggtagcatggttttaaaaaacaagggacaggcggggcgcaggggctcacgccgg

SEQ ID NO: 597861 - DNA, 327 bp, Homo sapiens
acatatgtggttttaaataccttgccccctcttaccctccccactttgagtctctagtgtccattatgtcactctgtatacctttttgtacccataagttagctctcacttataagtgagaacacacagtatttggttttccattcctgagttgcttcacttagaataatatcctccagtctccatccaaaattggctgcaaaaaaaaaaaaacaccccaaaactttattttggttcctttttaatggccaacgtcatattcccaggggtgtagagtatccccctttttatttatcccaccccacgggtaggaggggtgggatcccc

SEQ ID NO: 597862 - DNA, 400 bp, Homo sapiens
  misc_feature (284)..(284): n is a, c, g, or t
  misc_feature (291)..(291): n is a, c, g, or t
  misc_feature (309)..(309): n is a, c, g, or t
  misc_feature (395)..(395): n is a, c, g, or t
  misc_feature (398)..(398): n is a, c, g, or t
gaattcctgctgtgccagctgaggggagctcagtaccctggactgagtcataagcacctgtctgtgagggccctgaggacccaaagctccagagtgctgctgctgctgctgctgctgctgctgctgctgctgctgctgctgctgctgctgctgctgctgttgcagcactgccacctgggaagaacctagcatgccctgggacccctgtgattgttggggggacaactgttgaaccaggagaccctggtggttgctgggaggcagaaggccctgaggcttagganccagagnctggttcttgtcctacangaccctgttggttgttggacttgccacctgccctaagagctgctgctgcttgctgcttgctgcttgcttgcttgctggttgcttgntgntt

SEQ ID NO: 597863 - DNA, 478 bp, Homo sapiens
gctgggcgctctaaggatcccattgatagcggatagggcctgtatgaatggctcacgaggttcagctgtctcttacttttaacagtgaaattgacctgccgtgaagaggcggcatgacacagcaagacgagaagacctatggagcttaaattataaatgcaaacagtacctaaacacaccacaggtcctaaactaccaaacctgcattaaaaatttcggttggggcgacctcggagcagaacccaacctccgagcagtacatgctaagacttcaccagtcaaagcgaactactatactcaattgacccaataacttgaccaacggaacaagttaccctagggataacagcgcaatcctattctagagtccatatcaacgatagggtttacgacctcgatgttggatcaggacatcccgatggtgcagccggtattaaaggttcgtttggtcaacgattaaagtcctacgtgatctgag

SEQ ID NO: 597864 - DNA, 83 bp, Homo sapiens
  misc_feature (43)..(43): n is a, c, g, or t
aaatggttaaatatcatcactgtcgggatgtacccctgcacgncctctatgacaatgtggagaaactctttccaggttttgag

SEQ ID NO: 597865 - DNA, 1358 bp, Homo sapiens
tggggagagagagagagatatattttcttaaggggggagagagaggcgcgcgcggggagagagagagagggggggggggcgctctctctctatttatccccccccggggggggggggggtggtctctctctctctctattacgagagagagatatttcgcgcgctcgcgcgcgagacggggagaggtgtgttctctcacaaagacgagagagaaaatttttattacatatagcgcgcgggcgggcgaaagaagaagagaggagagggcgcctcccggcggaagagagagagagagcggtgtgtcgcgcgcggagggtggtgcgagcggcgagggagagaggacagcgcgcgagagcagagcgcgcggcggcggctctcgcggagagagcgcgcgcggcgcacacaagagaggggcagggagagaaagacagacggaaaaccaatcgcgcgcggacgcgagagagccatatagtgtaagacggaggagacgcgacgagagtgtgacggcgagcggaaggaaagaagggcgggcgaacggcgagagagaggacgacgaggaggagaaagaaagagagcgcgaggagacagagcagagacggagacgcagacaaacacaccctcccggagaggaaagcgcagcgagggacaagaaagacccagccctacacagcgagcgcgagagccagcaaacaaaagtgagggagcgagagcgaagagagacaaacgaaaccgcggccaagagacagaaggaccagcacgcaccccacgagagaggaaaacaagagaagagacagaggaacagaggagaagaaatcacaacagacgacggatcggataggcgcggccacctccagcagagtgcgaagaacaagacgacacgcagcacacgtaatacgtaggggaggccacacacacgagccgccccgcgcgccccacctctacctccctccgagcagcttagcgcaccaccgcggacgaggcagtggcgaagagccaaaagaaagccaccaaaaacgtggacagccgaggccccgtcgcacgcacacagaacaccgaaaagaaggggacagcccgcgcgtgcgaacagacatacaccacgggccgtcgagcgccgaacccactccccaccccccccgcgcgcgcacacaccacacggcgccgccggccccaccccgaccccccgcacgcccgacccgccggcaagagaactccacacccaccgcgcaccacacccgccgaacagatacccacagcacgagggcaaatatacaccgcacgcacgagaacagtcacacacgagggtaagtaggacacccccagacacatagtgtagacagagaaaacaacccacgcgcaca

SEQ ID NO: 597866 - DNA, 1595 bp, Homo sapiens
  misc_feature (156)..(156): n is a, c, g, or t
tttttttttttaaatttgaccaaaaaaaattttttgtacaattacccaccactggatttgactcagaagaaggacccccagaaggggtgtcttccatttttccctattttattttcagccctttgagggcttcatgtgtaagatcaaacgccaagngcccccaggaagaggtgacattatctccgtgtgaagtttcaccttccgtggtgtcctttgtgttccggctccacagttctttccattcaggcctttgtgcaattttcaggcattccgtggcagttttcgaagccaatgtgggtgaggctcctttcgtgggatcaggctcctttcaggctcctttcttgtgcgctcagggggtgtgtgtgcttgtgtgtctaccctctctcctgtgccgggagttacttgtgtgtggaaagatgtggcgcaccgagggagggcgcaatgtggcctgtgtattccacggggggacattgtccatgtggacgtgtaggggctctgtgggctcttgtgagagcgcgcggttaaggggagagcgcgggcccaatatgtgcgaagccgcgagagaacacggggtttaactatattaagagcccagtgtgtgttcaaaccccccacgcgggtgttttctttgcgaacctatttgggccggtcgaaacggggggagagaccccttttgtgtgcgcgcggcgttttctacccttttgtgagagcgcgtgttttgtgtgcaagaaaccacagtggttcccccccaaaagacaccgagcgccaggcaaaaaatttttcttccgagtggcgcttacgtgagagcgccacgtgtggcgaagacagagaacagagggggatttgcgggggtttcacatcaaacgggggtattacccctttgtcgtttttttccacccaagaaaatttttattttccccaaagcggggtattaatatagtttgctcacacagggggggtggggggttggaaccttttcacacaaccgggccccaaataaaattgtggcaccctggggtttgggccaaaaggttccccacttcttcatgggggggggcagaacaacactttttgcggtcgcatctttgaagaaacaactcttgtctattctctcttaaaaaaggcattaacacaggggcgtcccttcgcggcggatttctttgtggtgccaccctgtggcggcaaaatttggttctgggggagtccaccccaacatacaatattggttggtcccccccaagggtcttatactcttctgagccgtgctgcccatcaatacttggtcgtgctggggttgtcggctcgatgtcacacgccaacttgctgcgtgtcgtgtcttgctgtgcaccaagtactcgaacaaggggacgtgcaacactctcagtttgtgcaggaccaaactgagacgagagcactgttggtctctcgaatagtgacgtaatcatacctaccagaaaaccaccacacctcgtcgcggtggggcacacccaaacaaactagtggtcggttgtgttctattactcacccacaacactaccctttgttagtctgatgagaaagccaacaccccatctggtgagagatcaagtaatgcg

SEQ ID NO: 597867 - DNA, 1059 bp, Homo sapiens
  misc_feature (51)..(51): n is a, c, g, or t
  misc_feature (67)..(67): n is a, c, g, or t
  misc_feature (95)..(95): n is a, c, g, or t
  misc_feature (101)..(101): n is a, c, g, or t
  misc_feature (118)..(118): n is a, c, g, or t
  misc_feature (123)..(123): n is a, c, g, or t
  misc_feature (165)..(165): n is a, c, g, or t
  misc_feature (194)..(194): n is a, c, g, or t
  misc_feature (199)..(199): n is a, c, g, or t
  misc_feature (249)..(249): n is a, c, g, or t
  misc_feature (343)..(343): n is a, c, g, or t
  misc_feature (352)..(352): n is a, c, g, or t
  misc_feature (388)..(388): n is a, c, g, or t
  misc_feature (420)..(420): n is a, c, g, or t
  misc_feature (458)..(458): n is a, c, g, or t
  misc_feature (488)..(488): n is a, c, g, or t
  misc_feature (525)..(525): n is a, c, g, or t
  misc_feature (533)..(533): n is a, c, g, or t
  misc_feature (535)..(535): n is a, c, g, or t
  misc_feature (538)..(538): n is a, c, g, or t
  misc_feature (918)..(918): n is a, c, g, or t
  misc_feature (935)..(935): n is a, c, g, or t
  misc_feature (957)..(957): n is a, c, g, or t
  misc_feature (963)..(963): n is a, c, g, or t
  misc_feature (965)..(965): n is a, c, g, or t
  misc_feature (995)..(995): n is a, c, g, or t
  misc_feature (1002)..(1002): n is a, c, g, or t
  misc_feature (1016)..(1016): n is a, c, g, or t
  misc_feature (1025)..(1025): n is a, c, g, or t
  misc_feature (1029)..(1029): n is a, c, g, or t
  misc_feature (1038)..(1038): n is a, c, g, or t
  misc_feature (1049)..(1049): n is a, c, g, or t
ttgccggcttgccgggcagggggggaggccaggccaaagtgaacaagacancccgaggaggctgttnccatgcccctggggggctgattgcccanagtgtngagtcggcccccagatncagcncaggcccggccctgctccccaggcagcccctaaaggattctnctcagggaggcacaggccaggctggatgnagacnttcccaaaacctgacaagatgtgcaggccgaggccggggcctgggggctncctttgctcccagcccaggcaatggatgtgccagaaaggaatattgcaggcacttaaacgggctcccagggatttttaaacaaaaagcaaaganctgttgctncaaatctattgcagaccaagcaagcaggtttttatnaattttttttattagctgattgttgttatttnttatatgcaggcctgagtctgcctgtgcgccacatgcncaggcttcagccgctgtaatggttcgcatngcctgatgggtggagagctaagcgcgctgtcgagagnacttgcgngngcntcacccagctaatctgtagggctggacctatgtcctaaggacacactaatcgaactatgaactacaaagcgtctatcccaggaggtggctatggccacccgttttgctggcctggatctccccactctaggggtcaggctccattaggatttgccccttcccatctcttcctacccaaccactcaaattaatctttttttacctgagaccagttgggagccctggagtgcagggaggaaaggggaagggccagtttgggctgccgggttttagtttcctttgcactgagggcccccctattaccatgaaaaaagggcctgtgggagcctgcaaactccctgctcaaaaaaacatggagactcctgccctgttgtgtatanatgcaagatatttatanatatttttggttgtcaatattnaatacngnccctaagttatagtatatttgggcaagccnacttgtnaataccccccctcnctcctgttncttncctaaacanatataaatggntggtttttta

SEQ ID NO: 597868 - DNA, 114 bp, Homo sapiens
catacaccgagatacggaggtcagcacggtgctcacgttgatcgacggaacttgtacagagcaggcatgcaccgctactggtgaatacacgtcgaccatggctccagtcttaac

SEQ ID NO: 597869 - DNA, 122 bp, Homo sapiens
ctgtcactgagtgtctgttattgcattcgtgctgccgcatttgttttgtgtactctatgctgttagtgacaatctagatgacgcatgcaggggatccgtctaccagtcgaccttgtcgcgtc

SEQ ID NO: 597870 - DNA, 182 bp, Homo sapiens
  misc_feature (135)..(135): n is a, c, g, or t
  misc_feature (137)..(137): n is a, c, g, or t
aacctgcttaccggggcgtataacatctcccatcttcattggggcgtcttgaacctccacctgcaccgagagcctcatcacaaccctgccatctcaacagtgggagccctgagccctgggtcccaggcatccccngnccccacacctccgcagccagctccttagcttcatcctccgtgtag

SEQ ID NO: 597871 - DNA, 141 bp, Homo sapiens
tagctgggattacaggcgctgcagcacattgcctgcctaagtatatggtatataagaagagacggggttcacaatgttggccggggtggctagaattcctgacctcggatgcttgtgccacctcggtctcctaaagtgctg

SEQ ID NO: 597872 - DNA, 800 bp, Homo sapiens
ggacgctgtgtcgttggtgagaatcgcacgtcgaaatagcgatgccgatactggtttgcctggggctgaggcccacttcgtgtgtaacctagacgctgatcttgtgcggatgcgaggcccgagcaaataatcaccgccaggggctggtctgtgcgtgcgttggctcgaggagtcgccgtctgggcgcgtgagtcggttgtgatctaagtatcctctggacatgaccgctgcggcctcaacaggcatccgcactgacgcgcgctgggtgtgcttgtgagaggctgccaatgtgaataaacgtcttcgttctccggactagcgtggccttgcctaggatgcatcatatcggcctgacgatggatcgcatatactccatgttccgagaacgtaatgtcaacctgccttgctcattcgaacatccctcttcggtgattgacctcttagtccgtccgaatgaacgatctatccaagatgtctctctgagcaccacagaagagtgtccatcgcccaccaggtccgcgctaaggctaataagcttgaggcggtacaggaggctgcgtatgcgtgagtaacgcgtgcgccagtcagtgggggatctggctcgcgcggaggtgggcttgggtcccaggcctctggcgtctcatcaagatccgttcgtgtcgtgtgtggtggcaaggccgggtcccagggacatccgtatgagcggcccgttctattgactcgtctgtgtgcctcagtaacaagccgctggtaaaagcccgattggttgggcaggatgagtttgcctggaatcgggagca

SEQ ID NO: 597873 - DNA, 131 bp, Homo sapiens
ggctgggcatggcagctggtccttcattgccgcccgcccactgtcccagtacctaggcctgcaggtcccaatgtagccccctcccctcctccagaggcccctccaaaccgccccgctcattttgtgaattt

SEQ ID NO: 597874 - DNA, 239 bp, Homo sapiens
ccatgcgcggaagaggtggtttagacagaatgcctcctggtcggggtgggcgtcccagtgcctccatcaagaagagattatagatgatatgagccctcgtcgagggaccacctcacccctcctcccggacggaggcggccggggtgagtagcagagactcggaatcttcctcgttcctccagcaaccaccagcctagtagtgggcagacctcactggcctagtgacacgaagacgggac

SEQ ID NO: 597875 - DNA, 196 bp, Homo sapiens
cggaactccaccgtgacttgcaccagggcattgaggcagccagtgacgaagaggatctgcgctggtggaccaccccaccgggccaggcatcgattgaaactggccacagttcgaggagtggtccttggaaccacagaggacaatcagccggatagagaagggtggccggagccctgatgaggttaccctgaccagc

SEQ ID NO: 597876 - DNA, 255 bp, Homo sapiens
  misc_feature (156)..(156): n is a, c, g, or t
aggctgcgtaccgtagcggcatatttcttccctgcttcatcgccatcgaccagtacatgccattcaatccccattcggcgggcaaatttaaccagtgctttagccggactgggcaaactcaatgaccttgatccttcggcatcaaaatgatgtccnactgacgcgccagttcattgataacccaggtttccgtttccccttccaccagcaaccagcagcgtgcaaacagcgatgacggacggttaaaacgaatgt

SEQ ID NO: 597877 - DNA, 449 bp, Homo sapiens
  misc_feature (39)..(40): n is a, c, g, or t
atcagctgtgccagggtcccctggcagagaaccactgtnntatgtcttaagaaaataaacttcccagttttgctggggtgggggaggggatctgggattctgactgcttcctaaatttatttcagccagtcctccttattttagcacatcagcccctcctcccttttacccttgcttaaaatattattaatgcaaattgatttgtaaaattgaggaaaacttactttgtgaaagtttttattttttttcttgtttatttctgtgctttgagctgcctcgtgcttcctgttttttttctgtttttgtgatcttagaacaggatggcctgggacatgtgtcttattaagcaggagaccatacattctggtttgcttggcacattcccagtttatgcctaatattaattgcactctagcctgggcaacaggagcaaaactccgtctcaaaaa

SEQ ID NO: 597878 - DNA, 282 bp, Homo sapiens
gctgtatgcgtaggagaaagaaaaaagtaaaaatacaaacatcagtacttctatagaggtgatagataggtaccaatagggatgtagaggagtacagttatatgtaagagatttaaaggtagtgaatgtagagctatgaacgcattcatcaattgatggctgcaataaaggcctactatgggtgttaaattttttactctctctacaaggttatatcctagtgtccaaagagctgttcctcttaggactaacagttaaatttaccaggggatttagagggtt

SEQ ID NO: 597879 - DNA, 530 bp, Homo sapiens
  misc_feature (378)..(378): n is a, c, g, or t
  misc_feature (383)..(383): n is a, c, g, or t
ccagtagtgtatttagttatttaaggagggctcaatcaacaggtttaaatggtgtgctattcataattattgcaaaaataggccgggcctgtgattccagcgctttgggaggccggggcaggtgaatcacttgaggccaggagtttgagatcagcctggccagcgtggtgaaactccatctctactagagataccaagagtagcgggcgtggtgacaggtgcctctaatcccagctgctcgggaggctgaggcgggagaatcgcttgaacccgggagtcggaggttgcagtgggccgagatcgcgccattgcactccagtgtgggtgacgagcgaaaatccgtctcaaccaagaaaagagaaaaaaggaaaaagaaancttanctggcctttggggcacatgcctgtggtcccagcttcttgggaggctgaggcatgagaaaaaaaataaacctgggaggtggaggttgcagtgagttgagattgtgccactgcactccagcttgggcaataaaacaagactgtctcaaa

SEQ ID NO: 597880 - DNA, 86 bp, Homo sapiens
cctccccccccgggtggggttcctccccgcatcgttggggttttgttatgtgaaaatatcctggaaataaaaacatgtttttgcca

SEQ ID NO: 597881 - DNA, 1188 bp, Homo sapiens
  misc_feature (1188)..(1188): n is a, c, g, or t
cttccttcagccagcgcaggcggtgcgtccctgcaggcccgctggcaacggagctcaaacttgcgggaattcttgcagacagtcattgtattcaaagaacgaataagcaagcaaacgcaacaacgaagcgaacggaagagaggtacgacagcatacaagcatgcaaactcctgctcaacaacaactgcgcaaggaacaaccacgaacacactgcacgagtgaacccaaacgcatgagcgaacacgccaaacgcccgtgcaggcacaaagcccaccgacagcacggcagcgagcaagtctagcaggacggacggcccacaaggccaacaaggcacacctctcttagcacgaaacggctgcactctccacatctcctcccaggcagccttctcacaacgcaaggactactaccaccaacgacggccatttctacacccacactgcacacgactatgctctctagcaggacacgctgcgcctcgacaactacgccactgcagactaaacggcagcagcttccagaaaacacaaacctttattacgctgatgcccgctcgggaacggcttcactcgaaacaccaatccatttacccccttattctaactgctaggttctacccttgcactcgtcatcttgaatatttcaccaataccattataacttgccttactcgatttaggcattcccctgcaatatttccctttgcccccatacttctctagctccaactacccctgttggcctactcacctggcttcccccaattgttatcctcttggtcccatctgccatcccattggctcactggcattcttgcacccccattcacaagctcctccggcttcttaccactgaacttttcgccctcgtcccccccaggctctggccccgctcttcccccgcccagcccccgtactactctcctctccatatctcaacctcaaaccccctccctttaccattttccctcaccctccgatcccaaataacccccccggcgcgacacaccccccccgacgccacggtctcctccgcccccctgtttcacccccctttctcccgacacaccgggccgcacgcacccccgcccccgaacacccacccaacgcaaccgagtaaacacaccgccacaggacaccacccagcaccagcggaccgtcctcccccccccctacccgccccctgacn

SEQ ID NO: 597882 - DNA, 133 bp, Homo sapiens
  misc_feature (48)..(48): n is a, c, g, or t
acccgactatgcctgcaccaggttttcagctttgtttcggttgctgcnttcaacattccatgtcttctcatcatgatgggggaaatcttcatcatcttccaccagtgactattggtcttcagtgttttcattg

SEQ ID NO: 597883 - DNA, 229 bp, Homo sapiens
ccgagcagtattatctgcaaatcagattgtgtagagattctcaagaaatgtggagaccagaataaattccctgaagaacacacagctgaaagtatctgtgagtttctgtcccctgcagatgacctggagagctgtatccctctggacacgtacctcaggccaagtgctttaggaaacatcatagaagaagtgactcacccctgtaacccaaacccctgcccagccaacg

SEQ ID NO: 597884 - DNA, 872 bp, Homo sapiens
tgtcttgaaagttgagtgtgagttcttcagctaagtgggggaggatgggattttcaggtagtggtggcaacacataaaagtgttatggttggcggagtgcggtggctcgtgcctgtaatcccagcactttgggaggctgaggagggcggatcacgaggtcaggagatcgagaccatcctggctaacaaggtgaaaccccgtctctactaagtagctgggattacaggcacctgccactgcgcccggtaattttgtattttctagtagacacagagtttcaccatcttggccgggctggtcttgaactcctgacctcatgatccggcactctgcctctcaaggtgctgggattacaggcgtgagccactgtgcccggccttttttttttttttctttttttggggaccgggttctcgctctggctccccgggcggggtacacagggggggacacccgggtccctggggcctccggcttccggggttacagaggcaatttttttttggctagagtccccaagtaggtggggcttaacgggtgctggcccatggcgggttatttgggatttttgggagaaagaacatgtttccccaggctggggccactctcgttgtggtggtgagacctcttagacttagggggatgttggcccagctttcccccccaaaggtggtggggttcagacgtgttggcagcaacgtcccaagtagcgcatgttgttttttaaacaaaagtttaacttcttaaagtgaacgtcaaaatggtgagaagattttttcttccgagattcaggtatttcccttgtttactacatccgggggggtcggcattatggacaggggctcgcaaagagaatcgtggcataaggaatg

SEQ ID NO: 597885 - DNA, 154 bp, Homo sapiens
cacccgtcattatgggggctaggtgtatgaacctgtagggtgttttctcgtgctgaatgagggttatatgttgttcatgtggtgggtgagtgagccccattgtgttgtggtacatatgtagagggcatctcgggctgtgcccattatgcgggtg

SEQ ID NO: 597886 - DNA, 161 bp, Homo sapiens
cggagcgatatgaagtagatgtttttctactataggtctggattacttaaaaaaaataaagaatataagtaaggatcaaaactctaaaatttggcatgaaaattacatccaaatggtgaaaatcagatctatttgggttgggccgttagggccgatctgga

SEQ ID NO: 597887 - DNA, 141 bp, Homo sapiens
gtaatgattactagtagtttgatgctactgccctgattccagttaaggggccagctgcctttcccctccctggtttttcctcctccatggaaatggccaccccgtggaaaaagccaattaataattttgttttttcttgga

SEQ ID NO: 597888 - DNA, 570 bp, Homo sapiens
  misc_feature (22)..(22): n is a, c, g, or t
  misc_feature (60)..(60): n is a, c, g, or t
  misc_feature (150)..(150): n is a, c, g, or t
gagggggggggggagctattanccatgggcaaccccacgcggtgcttcgacattgccggnagcgggaggccttgggccgcgtgtcctttgagcgtggtgcggacaagggcccaaagacaggagaaaattttcgtgctctgagcactgganagaagggggggggttataaggggtcctggtttcacagaagtattccaggggttatgtgtcagggggggggcttcacacgccataaggggacgggtgggaaggccatctatggggggaaatttgaagatgagaacttcatcctaaaggatacgggtcctggcatcttggccatgggaaatggtggacccaacacaaaggggtcccaggttttcatctggactggcatgaatattggggaggccatggagcggtttgggtccaggaatgggagaccagcaggaagatcaccattggtgactggggacaactcggataaggttgacttgggtgttatcttaaccaccagatcatttcctctggacgctaggagagcacccctccaccccatgtgctccgaggtcctagaatctttgggctctg

SEQ ID NO: 597889 - DNA, 175 bp, Homo sapiens
agtcaatgagtgtgggggtgttagaggacatagacgattctagtactgagctgccgatctactaccatgagcctagctgaagagtggaactcttacacttctactaagtagatgacaaacgatccatgtccttccaagaatgtgtggcatcacaggaggagggacacacagcatg

SEQ ID NO: 597890 - DNA, 256 bp, Homo sapiens
tggccgggtaataggcctgggtccccctcccccatgccggcagctgtccccatgtgatttatttttggatacctgggagggggccaatgggggccccagggggaggcccccctctggaaatgtggttcccagggatgggcctgtacataaaagcccccggatggcccttcccccccggatgggccgtttttttgttgataaggaaccccgtaattttcccaggaaaataaagaaccggctaactagggtctttcca

SEQ ID NO: 597891 - DNA, 159 bp, Homo sapiens
acgaggatggtgtgcagctgttacagtctctgctcactggggcaccacctcccgggttcgggcattctccctgcctcggcctcccaagtagctgggattacgggtgcgcgccaccacacctggctgatttttgtatttttttagtagagatggggtttc

SEQ ID NO: 597892 - DNA, 770 bp, Homo sapiens
cctgcctgctggcttgtaaaggaatctgtcagcaaattattgagttctctctgaagccacagttcctcagttgtaaattgggcacaataatgccaactggtaagaattagagagaatgtacatagtaggtgccttatgatagagcggccaaagtgggtcgtaagaggaggaatgaacagtcaagggcataatagcagtaactacatgtgtcggctgttaattttgctatgtataggttatgattatttcgctgtggtgtggctgtaatttgtgtctacaatctggttgctcccttccagcattctgttcttaggcgtacttccgaattatgactgtgtggactggtggaataagcaaagatagatctagaaggatgttaagtacttccatgagagatatagatctcatgtgctgagattagtgtgcaagtttgtggcggtatgggtcttgggtttggtacaagtttgcatcttaaactggttaaagtgattaggtacgttttgagactttgtctattgtgacctgttacaatagagatgtagtgtgataattcatcactatataggtaatgcttcttggtgattttctgtatttgaatattatcgttgtctgcatggtactgttataaaaataggcaggtataaagaatacaaatatgttttattatgtcaaaatatgaatcatagaagcagaatagagaacctaaaaatacggcaaattcttacagcaactgaacttcaaaaaaggaaacaaagcataaaggggggaat

SEQ ID NO: 597893 - DNA, 379 bp, Homo sapiens
aattagaggtcagacagtaagcaggctctgggtctagacagggacctaaatggggtaagagatatcaatctacagtgtagataggcgaagccatatagaagtttataaccgagagagtgacacataatttatagtagtaaacagaccatctggctgctgtgtggagagtagattgcaggggatattaaagtaggaacagaaaatccagctgagaaactaccacagaaggggaggtaagtgcatggccgtggcttggaaatatcaaggcatccagatgtggcagcaacgattgcagattcgccaaaatgttcccacaggctagcaactaagcagcagtttgctgcatgcgcattgcatggggcatcctctagcagtcgac

SEQ ID NO: 597894 - DNA, 277 bp, Homo sapiens
cgtggtggcgtgtgcccagctactcaggagggtagacaggagaatcatatgaacctgggaagtggaggttgcagtgagctgaaattgtactactgcactccagcctggatgacagagtgaaactccgtctcaaaaaaaaaaaagaaaaaaaccactgactttatgctttgtcatgggacactgcgccacctccacacctagctaaagaaatgctaaatatccagggtaaaccacttacacttaaactaatatggtatcccctccatctgcaaccctt

SEQ ID NO: 597895 - DNA, 1395 bp, Homo sapiens
gccaccttcctcaagggactgtgaccctttggggattctgtccctgaccctgcttccccaagctctcctgggtcttggagggactgtgggaatgaacttggccattgcacggaacagaccaggtaaacgtgacttgctgcaactgacgaacggacgctgtgccggaaaaggaactaacaacgttggacacacggctgacacaaacaaaacaaaaacaaacaaaaacaacaacacaaaaaacaaaaaaacaaaaaaacaaaaacaacaaagggagcggggcgagcgacagaactatcaccgagagagggaggcgcccaagaacgacgcgaccacgcaccgaagaagttcgtggcgaagccaggagaggagcctcacataggcagtccgaggcggagctagaaaatatgaagaggcacgactacggcgcaggggcgggcagtggcccacaaccccacgcctgggcgcgagtgtgagagggagaacacagacgcagacccctcggaggcgccactaaggtcgagaaaaagagaggaagaaccagaacaagagaggggggagagcagaaaaaataaaagtaagggggggaagcaacaaacccccaagcaggaggacacaagaagaaagagcacgctgagagccggcgagaaaacacactcaaagcgacagagcagagggcgaccctccgagggcggggagcagacaggacgagaggcgataatgagaaaagaggaggacacagccggacaactcgcgtcggagaacgacccgaggcgatcagtcatagatgccgaacgacagatgagacgcaagaggggagcagaaggaggggaaaacaggagacaactgaacaaaggcgcaagaaagaagagggcagacacggaagaagcggaagacggcacgcgcagagacgcatagcgggaagaggggcggggggggtaaagtagaagagtggcaaggagggacggaggaaggggtggcatggaccggacggacgggaggagaggaggaggacgcaagcaagggggggcaagaggaggagcaggggcgaagaggcaaaaggagggagaagcgggaggcggaggggaggaggaacgaaaggaggcgggggagcggaggaaagcaaagatagaggagaagagaacgcgcgaagcggcaggacgagtggcggagagcgagaagaagcagacaaagaggaggtgggggggggagacgacggagagagacaggcgaaggggagagggcgaggacggagggcgagcaaatgagcagaagaagaagagtagcggggcgggggataacgggtaggagcgagggtgggggggcctaggaggagaggagggggaggagaaggggtgggaggagagagagcaagaagagagagaggatagaaaagaa

SEQ ID NO: 597896 - DNA, 790 bp, Homo sapiens
agcgggggcccgtggcacgcgccctgccaagatggcagtgcgccgggacccagctgtcagtcgccgccgccgcggccttccccgcagctagcggacccgatgcgccatccgacaaccatgaaccaccgcaaggcacaccggcgagagagacacagctcatggacgcggcaaacagaccagacagacaaagaagagcagagaaacacagagagaagtagagaagccgaaaaagaaaccagaagaccacagacaaagcgagaaacaaagagaatatagcacaagagaccgcgaaacaaaacagagaaaggaccaacggaaagaacagacgagcacacagaaagagggaaaccaagagacaaaaaccaagaaaacagagacaagaggaagagaaagcccggggaatcaagacagagaacaagcagaagaagacaccagacacacacagaccaccacagcgaaacaaaacagacagaacgggacagacagcagcgatgaccaagagtagactcccgcacacacggaggcacgccacgcgcggcgcaacggaacaagcaaaacgaaacaagccaccaagacaaaacacgcggaacccacgacacccaacagaccaaccgagcaaagaaaccgaagcacggaccgcaagcgaacaccccatacaacggaagcaacagctagtagacaagaacaagaacaaacgaacaccaggacatacaagcggcgacacaacacccgcagagccacaaaagacacagagacacgacacaccgagcgacaggagagaaaaacgaca

SEQ ID NO: 597897 - DNA, 784 bp, Homo sapiens
tagttctagatcgcgagcggcgtcctttttttattgtataaagaaaaatcaacatacactgttcagtgctgagaggggatgtagggcccagtgggccaccctgggcctccaggagctcgctgtgtggggagagccggacaacgcccttgagcctttatgagctgtagtatagatagagttgccataacaaggctggtgggggtggtggatagctcaaactcagctgcattgtgtgttaacatatagtaaagaatccaagtcgagaacactatgaaacacatcagaagggagaacgcggcgcctagcatagattagcaagttacggcctggatgccatgtcgccagcccagctgttcccctcggcgccacatgaggataggtgggtgggcggcgaggcgagcactgcagatcaagttactagcatggtcgagcagtgagagatccgcacgacaatctcgctatgtcccttgggtcaggcgcgtgcattccattagccatgtgcttgtcgccgtgtgctcccaggggttcccaggtgccaggcgtgggagcccaggagccaccccatatgccagtagggcgggccatacccaccttacagtgcaggctatgggacgcagggccccatctgtccctcgggtcgccgtgtggccagagtgaactccagtcgtcccccaaactcgatgactcgctcagaacactatggcaggatgtctgggggcctgagccagcaagagagcgtgaaagccgggacaggggggccagctagaaccataaaaccctggga

SEQ ID NO: 597898 - DNA, 366 bp, Homo sapiens
actacatacttccgtcccacctgggatgtgaaccctccttttgtccagcatacagagtctacactacctgtccattagccacttagtagctggctgggttatcagatcaattgtcatagtattgtagacttgtgttcaagtaacccttattttacttcacgggggctccaaagcacaagagaggcgatgctgacaattcgaatatgccaaagagaagttgcaacatgcttcctttaagtgaaaaggaagttcccaacttaataagaaaacagacaactgctgctgaagttggtaagatctacaataagaacaaatcttctacctgtgagattacgaagaaaaaaaaaattgtgctaattttgctgc

SEQ ID NO: 597899 - DNA, 996 bp, Homo sapiens
ggcttcgtctgcttctcatctcctgaagaagcaaccaaagcagatcagctgcgatgaatggcacgcattgtgggctccaatgccactatatgttgccctgggccagaggaaggaagagagaaaggctcacctgaccaatcagtatatgcaaggagatggatggaatgagagcactatcctggccagagtgcccattcttttaaagtcagtttgccgagtcgcatgcagtcgggggtggcatagctcttgtgccagagagtcccacaggctcaggtacaggcctccatattcatagcacctaaaccagttagcacagatgatggacctaagtccgacgcctggggaagcaaggtcttccaaggatatggccgaagtgctatacgccggtctgggcctcgtacaactcttcgccatctgtgtccaaactgggtagtgctccggcctctcgctggcctgcccttagctatccacttcggagagtcgggtctgagtgcccggtaccgcttgtgctatggcactttggtggggctggtgccgaccatcaatgggctgattgatagctgccagtctggaggcgttcccacagtctgtggagaagcttagcgcgacgcgcttggtgttgctgctggtgctccccggggctgttggcccctacagatatcggctccagtgtccgtagcctcatgctgcttacggctcgggcatgtagcccaagccgcggtccatgtgtatgggcaggagccactggacggctccatgctggtgttgtgaccccccctggaacagaagccaatgtggggaaggctgtccggattccaacaagggttacctggcggtagatccgaagtggcggcaagcacactactgtgcatttaatccccgtttcgcagggtgacgttcgttagccctccaaaagcaagggggttgatcacaaaagagctcctatccgtcgatcctgcacaccgactgtgataacactgcagtctcaaaaaaaag

SEQ ID NO: 597900 - DNA, 92 bp, Homo sapiens
gccagcaccaaccagacatctatgtacctctgtgccagccgaactcccggactcaatgagcagttcttcgggccagggacacggctcaccgt

SEQ ID NO: 597901 - DNA, 313 bp, Homo sapiens
aagtcagctcggtaccgattacgctctagacggtgatcacgcctcataatcatgtttccttatctggttccgagtcctgtatgcccttttcctaacactcacaacgaaaactaattattacgacgcatctgcagacgctcgggaaatggaaaccgtgtgaactatcctgcccggcatcatcctagtcctcatcgcccgcccatccctgagcgcagtccttgacatacacgagacgacggtctctgttctctcccttaccgtcaaatcagggggtcagcagctggtagtgaagcgacgagtacatcgtctacgg

SEQ ID NO: 597902 - DNA, 120 bp, Homo sapiens
  misc_feature (6)..(6): n is a, c, g, or t
  misc_feature (25)..(25): n is a, c, g, or t
  misc_feature (64)..(64): n is a, c, g, or t
  misc_feature (83)..(83): n is a, c, g, or t
tcaagncttctaacgaatgtacggnggacatgcccctaaagtattccttttctccgtgcatttngatgcaggcccaacaaagncttttgttttgaaataaatttgactaccctgtccaca

SEQ ID NO: 597903 - DNA, 209 bp, Homo sapiens
ggacatcaaatccaagcttgagaaggtaggcaaccttatcatcagaccctacagctccaaaaactttgcagcccatgagcttagcaaactgacccacgactgagcccacagctccagctgctgcattaaccatcagtgttactccacccttcacaccacagatttcaagataagccaaagtaggcagtcaggcctggcatgcccactgt

SEQ ID NO: 597904 - DNA, 908 bp, Homo sapiens
  misc_feature (57)..(57): n is a, c, g, or t
  misc_feature (64)..(64): n is a, c, g, or t
  misc_feature (88)..(88): n is a, c, g, or t
  misc_feature (92)..(92): n is a, c, g, or t
  misc_feature (374)..(374): n is a, c, g, or t
  misc_feature (378)..(378): n is a, c, g, or t
  misc_feature (428)..(428): n is a, c, g, or t
  misc_feature (433)..(433): n is a, c, g, or t
  misc_feature (441)..(441): n is a, c, g, or t
  misc_feature (486)..(486): n is a, c, g, or t
  misc_feature (506)..(506): n is a, c, g, or t
  misc_feature (545)..(545): n is a, c, g, or t
  misc_feature (572)..(572): n is a, c, g, or t
  misc_feature (575)..(575): n is a, c, g, or t
  misc_feature (584)..(584): n is a, c, g, or t
  misc_feature (587)..(587): n is a, c, g, or t
  misc_feature (591)..(591): n is a, c, g, or t
  misc_feature (598)..(598): n is a, c, g, or t
  misc_feature (604)..(604): n is a, c, g, or t
  misc_feature (611)..(611): n is a, c, g, or t
  misc_feature (622)..(622): n is a, c, g, or t
  misc_feature (637)..(637): n is a, c, g, or t
  misc_feature (734)..(734): n is a, c, g, or t
  misc_feature (736)..(736): n is a, c, g, or t
  misc_feature (746)..(746): n is a, c, g, or t
  misc_feature (749)..(749): n is a, c, g, or t
  misc_feature (756)..(756): n is a, c, g, or t
  misc_feature (766)..(767): n is a, c, g, or t
  misc_feature (796)..(796): n is a, c, g, or t
  misc_feature (807)..(807): n is a, c, g, or t
  misc_feature (809)..(810): n is a, c, g, or t
  misc_feature (817)..(817): n is a, c, g, or t
  misc_feature (825)..(826): n is a, c, g, or t
  misc_feature (830)..(830): n is a, c, g, or t
  misc_feature (834)..(834): n is a, c, g, or t
ggagagagacagagagagagagagagagagagagagagagagagagagagaggagangtggctntccctgcagagccggtgtctccgnctgngtccctgctgcacaagcggagctggagtcggatcccgaacgcccctcgccatggactcggccctcagcgatccgtataacgggtgccgaggcgggcggccccacaaagcatacgcggcgcttccacgcgcgagggtatcgcgctggctaggagctcctgctcatggcgctgctgcccatcttcttcggcgccctgcgctccgtacgctgcgcccgcggaagaatgcttcagatgtgcctgaaacaatcaccagccgggatgccgcccgttccccatcatcgncagntgcactctcttggggctctacctctttttcaatatttctcccaggagtanatcancctcctgntgtccatgttttcttcgtgctgggaatcctggccctgtcccacancatcagccccttcatgaatnagtttttcccagccagctttccatatcgacagtaccagntgctcttcacacagggttctggggaanacnaggaagagntcntcanttatganttgacnccaaggncctgtgtgtgnctgggcctgagcagntcgttggtgtctggtacctgctgaagacgctgtggtttgccaaacaacctttggggctggcttcccccttaatggagtagagctcctgcccctcaanantgtcgcctgntgnatctggnggggactctnntctacgatgtcttctgtgttttgcccctntgtggtgacgngnnccatctngggcccannaatnggtntccccggtctgtggggaaggcctgagaaccattgcctgtggatggaagttgcaccggacctagggctgggggca

SEQ ID NO: 597905 - DNA, 464 bp, Homo sapiens
cagtcgttcgactgagcggggtggatcacgaggtcaggagctcaagaccagcctggccaacgtggtgaaatcccgtctctactaaaaatacaaaacttagctgggcacagtggtgggcacctgtaatcccagccactagggaggctgaggcaggagaaccacccgaacccgggaggcagaggttgcagtgagccgagatcgtgccactgcactccagcctgggtgacagagtaagacctagtctcaaaaaaataaataaataaaagggagagataacagaattaaacagcacacttctgtattaatccattttcacactgctgatgaagacatacccaagactgggaaaaaaaagtttaaaaagagttccacatgcctggggaggcctcacaatcacggtgggaggcaaagaggaacaagtcaggtcttacatggatggtggcaggcaaaaagagagagcttgc

SEQ ID NO: 597906 - DNA, 153 bp, Homo sapiens
aggactctagagatccccataagcgcaggagggctttgctgtctgggccgggatacttcacggtgacagcttggctggcacagtgggcatctcttcaggttgatggtggagagcgtgttgaaggtgcagctggccagccatgcgcgcggtgag

SEQ ID NO: 597907 - DNA, 130 bp, Homo sapiens
tcgacacgtgcgactcctccgactcttccttggcttcaaccttagctggggctgcagcagcagcaggagcagctgtggtgcagcagccacaggggcagcagccacaaaggcagaatgatcagccaagaag

SEQ ID NO: 597908 - DNA, 268 bp, Homo sapiens
agactcagagaggaaccccacgcagggtgtctccatcttccctatatactttatcagccctttgtagggcttcattgtacgattaaagccaaggcccccaggaacggtgacttactcctggaatttcacatcctggtccttgtaccggctccaagtcttccatccaccctatgtattttcacgtcactcctgcagccttcgagccaaattcgtagctccattctgcatcagctccttcagctcttattagccataggcaggacgttgc

SEQ ID NO: 597909 - DNA, 315 bp, Homo sapiens
  misc_feature (63)..(63): n is a, c, g, or t
  misc_feature (145)..(145): n is a, c, g, or t
  misc_feature (181)..(181): n is a, c, g, or t
taaattagagactgtatgttagttctggatggatttggtggcttgatatgataccttgctagntgtgaggggactctgtttttaagatgtatggccaagctctttgtaaatggaaatgcttacactgggtgttggggatgtttgntacttcttgctatttttgtggttttggttttcccantatggtaggacccttggccagcattgtggcttgtcatgtcagccccattgattaccttttcatgttttgaggtactactgcctttgcagcacaaatttttatttctgtcaataaaaggagatgaaaataaaaaa

SEQ ID NO: 597910 - DNA, 235 bp, Homo sapiens
  misc_feature (225)..(225): n is a, c, g, or t
atctctctctccgatataagtaagatacatgggagagctggcatgatttatacagagcagacggtaactgattggtctactgatagaggggaaatagagctctagtaagatggcgaaagaccgatgagcagagaaggatgccctttgacttgatgagtggcatttaggctttgcatgttgagggagtgagagaaaatgtagctctagatagtggcgcttgcaganataggaggag

SEQ ID NO: 597911 - DNA, 388 bp, Homo sapiens
taacaggcatatcgctcttagcgctacaagcctatagtgcgtgtgactgtaccatatactaatagacagttgtgatacaatggtaagtattgtgtctaaacatagaaaagatacagtaaaaatacagtataaaagattaaaaatggtataccttatagggcacttaaccatgaatagatgctgcacggactggagtcgctctcgggtaattcagtaagtgagtggtgacgtgaatgtgagggccttgcgaccattactgtacacaataagatctaagggtagacactgtatacttcgcctacactaaatttattttaaaatttcttctcctttttcagagacagagtcaccactccagcctgggtgccacacagtgagactccgtctc

SEQ ID NO: 597912 - DNA, 210 bp, Homo sapiens
  misc_feature (127)..(127): n is a, c, g, or t
atgcagcagctgtgacagggctgtgacagggcgagaatgaccctgactgaagcgcagggcattcgaggaggtgctctggcgcgggaatcacgctcctcccacaagtaaactccggaagccgccagcnggatttttcaggccctcaacatttatagggcttctggacaccactctacgacccggccacttcctaagggggatctgaaggac

SEQ ID NO: 597913 - DNA, 155 bp, Homo sapiens
gactgtaagtactataatgatgccagcagataagactgggaaagataagataaataggactgctgtaataaggacggatcaaacaaagagggacgtctggtattgggttctggcagggagttatatattgataattgttgtgactaaattgatgt

SEQ ID NO: 597914 - DNA, 492 bp, Homo sapiens
  misc_feature (294)..(294): n is a, c, g, or t
  misc_feature (390)..(390): n is a, c, g, or t
  misc_feature (463)..(463): n is a, c, g, or t
  misc_feature (469)..(469): n is a, c, g, or t
catgattccgcatttaacaaccattaggctaccgggcatgtctcaatcctatccataaggggagtggcaaaaaaaaatcaaaaaatagaatttcagtcttttcctatccacgaaacaaggttatcggcctttcggggatatccagggataacaaacatagaaaaataattctttagataagatcaaaataaggggaggtttccaggggggtaagcggccgggctcagagcaggcggtttcagaggcagggccacagttactggcaaagacggaggtagcacagagatgaggtgntgatggtgtggaggccagaaccagaccatacacatgctgttctgaatggatttaataatctaggtttaatcaaagcaattggcattgggatttggnaatgaccattccttgctaaggaagctatgtacttcatgctgtggaaactggcaaatacagaatgtagatggtnggtttncttagccttgaagatgaccaggt

SEQ ID NO: 597915 - DNA, 279 bp, Homo sapiens
ggtcaatttctacacctcgggaggctgaagcaggagaatggtgtgaacccgggcgggggagcttgccgtcagccaagatcgtgccaatgcatccagcctgggtgacagagtgagactctgtctcaaaaaaaaaaaaaaaaaaaaggccttacttttttaaccacttttagcagaaaaacagagctctcttccaatgggaaaataggggttccctggaaattaattactaccctgtgagagcccagacaacttaaaccttttttggtgtgtaaaatttga

SEQ ID NO: 597916 - DNA, 225 bp, Homo sapiens
ggattgatagcattgatcgctctttctcgattccgtcgagtggtgtgtgcatggtctgttcttagttggtggtgcgaatagtctggttagttccggagtaaccgaacgagactctggccactgctgctttgttactcggaccccagagcggtcggcgtcccccaacttcttagcagggactaagtggtcgttccagccacccgaaaattgagcacatacacaggt

SEQ ID NO: 597917 - DNA, 177 bp, Homo sapiens
  misc_feature (28)..(28): n is a, c, g, or t
ccggggattacaggcacatgcacctcgnctggctagtttttgtttttagtacagacggggtttcactatgttggtcaggctggtcttgaactcctggcctcaagtgatcctcccgcctcagcctcccaaatggtaacattttgcaaaacttatatatgttatcacaaccagtaaatt

SEQ ID NO: 597918 - DNA, 212 bp, Homo sapiens
tattatctcattgaatcctcacagcacccaatgagaatcccattttcagccaggcacaatgtggctcacgcctgtaatcccagcatcttcggtgaggccgaggcgggcggatcatgaggtcaggagatcgagaccacggtgaaaccccgtctctactaaaactacaaaaaaattagccgggcatagtggtggacgcctgcctttagtcccag

SEQ ID NO: 597919 - DNA, 172 bp, Homo sapiens
ccggtcgacgggggcttacagacgcgcttcaccacggtcggctatttttataaaaaaaatttatttgggaacgaggtctcactgtgtttcccaggctggtctccaactcctgcgctcaagacgatcttcccacctcggcctcccagaagtgctgaggattattaggcgtgag

SEQ ID NO: 597920 - DNA, 699 bp, Homo sapiens
agcgggggttcatcctgggaggcacacagaaaatgtccaataaacagtggccaccactggcttcctgtgcattcatcgtcatcatgctagggtcacgggggtcccttcagacccacacctccattctcaggagctgcctgcaggctcagccatcacctgggctggttactgggcagcctctcccacctgccccaactatgctcagtgacctccttcctgtcccctctcctgccatccctatcaccatggcatgagtaatgcacacgtgtattagtccattttcacactgctgataaagacatacccaagactgggcaatttacaaaagaaagaggtttgattggactcacagttcaacatggctgaggaagccccacaatcatggtggaaggcaaggaggagcaagtcacgtcttacatggatggcagcaggcaaagagagaggacgtatgcagggaaactcctgtttttaaaaccatcagatctgcgaggtgtggtggctcacacctgtaatcccagcactttgggaggctgaggcagggggatcacctgaggtcaggagttcaaaaccagcctgaccaacatgccagaaccccatctctagtaaaaatacaaaattagccaggcatagtggtgcattcctataatctcagctactcgggagactgaggcaggaggattgcttgaacccgggaggtgg

SEQ ID NO: 597921 - DNA, 871 bp, Homo sapiens
tgcgagcggggaggggagcagagaactgctgcagtggccaaaggacagccccccccagcactgatctcgacaggaagccctgtgagaactggggagtgcagagaccccgtgctggcctggaggcatgtggagtgtggggggcctggtgctgcagtggacgaggcccatgctggaagccgaagccaccagtgccccccagctgtccacgacggagcgatgaacattgcaggattggcgctgtgccctgcggattcccctgtgccccccgcgtgcctggcctggataggattgtccttggccccactgtggggcaattgctcttcgctctggctctttctccaccgaccccgtgtgtgtgccgtgtggatggttggggtggcctgtgtactgtcttgccgcctgtgagtgggtgtgctcccctgcctgtggcactccgtggcccccgttgggcttgcgtccttgcgagcaaaccagtgccagcctgggtggttgatcttgcgacactggggatgaagacctttggggcgagggtccccaggcccagctatcccggtcaacaccgcggtaccgttgaacccttgcagaaggacgaacgggcgatccagggtgatccaggacgggacactgttcagaggcacctgacgggaaccttggagatttcttggacgcattgagcaaagaaccttggttgcgcaagattcgaggttggtgcggcctttcaacgggtgcttgcccagcctcaaccacgctggaggcttttttgacaaccggattaaccagggttgcccatcgccaggccttcgaagtacctgtacaagactgcggggatcctctggctgcgggaacaaagcccattcgagaggcgttccct

SEQ ID NO: 597922 - DNA, 1948 bp, Homo sapiens
  misc_feature (983)..(983): n is a, c, g, or t
  misc_feature (987)..(988): n is a, c, g, or t
  misc_feature (993)..(993): n is a, c, g, or t
ggcgcggttctgtgggccggaaccttaaagatagccgcaagtgggtgaaaatggtgtcaactgacaccagatggctgccctggaggccaaaatactgtcatcaaatggacgtatacattttgggcgacttcaatttgccacgggcacacgttctctacacgggaacagatacacactggatgaaggctggagaacctttggagataatgatccaaattcaccaggttgaacccggtctaacaacagactttaatgtacatggtggaagcatggagcaaatccaaggcagaactcatggaaatcagttgaagataacacacctacaaatcacgacggtctccaaagacaaaacccctaccctgaaaggtgactgaagtgcagtatacacaccatgactgtacacacaaaccagactctagtcactactaaacaggcttacccaactagattgcaactctggatagaccatacacaagacatggttcggacagactacacggtcacacgtactaaccaatattccgatgagaaacgaacatttgacctaagacgcaatttaccgcggcattcacactccgggtagctgttcggatcggccatagacatctggtatagaaaactcggttcgaggaccccgtgggccagacatgtaccaacgacaaccagaccctggctacataactttacaccggcggactaacttggccacaagaaactgcagcacagcacacacacataacaggtgaccgcaacataagacgccaaccggaggcagacgacaactcacgcttcacgaacacgtcgctaaggtaacttcttcgcaacaacgctggcgtgtgacgaaattcgcggtacatcaacaagcacgtgaggaaaaccaacactgtgcaaccgggcacaaggaaccagcggccacgaggtactaagaaccgacgatgcacgcagatgctacacatctgctgctctcttgcacacaacgatanttcnnttctntctatatactcatacgacgactaacgcactagagaacagtagacgaagacgagaagaacacaagatccgacgcaacgacacaaaaagaaacaacgacagacgagaccgatctcagacagacgacaggcacagcaaagcagaaagcgccagcggaagcagacaggagagcagcgcgagagcgcaggagatactcagagagaagaagagagggagacagcaggagcaagacagaagcagaggcgaacgaagagcagtcagcgagagagcagacggcgagagagatggagagcaggagggcaggagcgcgaggaagagcagacgcgacgacagagacggcagcagagcggacgagcagagagcactagggggcacaagaacgtcaggggaagaggaagagaagcaagagagaacgagcgagacaccgagcgactagcgagacgaagggaaacacgaagagcgagagaagaaacagcaaacggagaagagaagacgacaaacgaaaaagaagagaacgacgagcggagagaccgaagacagcgcacaggaaaacgaacacagaacacaaccacgagcgaacgcgaagcaggagagacaaggaagacaacgagccacgaagaaagagcagagagaaggagggaggaagaaacacagaagagaccgacaacgagcaacaacacggagacaacagaaggaagaagaagaaaaaacggaaaagcagaagaacaagacaagagaagagaaggaagaacaaagagaacaagaaagaaagaagaagagcaagacgaaaagaaagaaagcaagaaaaggcacagagagacacgagaagcaagagagagaaaagagaggagaaaagaaagaaggaagaaaaaagaaagaagaagacaagagaggagacaacacagcagaaagacaaagacgcagaaagacaaaacacagaaaagacgcgaaagaaaag

SEQ ID NO: 597923 - DNA, 1367 bp, Homo sapiens
agcgctctctacttgtttttgggtgtgtggggtgtgtgcgccccgactcggtgatgtttgggggttgctggttttgtgggatgggagggttggtgttggtgcccgccctcccagggcgtgcgttgtgttggtgtgttgttcagtgcttcctctctcttgtgttggggttgtgggggtgtggatagggtggagggtggtggtatgtgtttgttgtttgctcgcttcctcatccacgtctggtgggggtggtggggggtgtgggtaccgcactgtacgcgcctgattgttgttttcttcctgcgcctcgagttcaggagcacgctggtggttttttttgttactcactccctgacgctgtgggtggtttttcgtccgcccacgcttgtgtttttgtgtttgttgtggggcggcgcgcgtcttcttctttgttttttttgtgtctctcacacacgctgagcgtgttttgtgtggggagtgtgagagagtgagtgggtggttggtcgctccctcttttgtgttgtttcgctctctctcgttgtgtttgctcgcgcatctttagtgtgagagtgctttctcctcttctctctcgtcttctttgttttatcagaatagagagagagagagagagagagagatatgatgtatctctctctcgtcgggactggagagagtagatatataggacacatcacacagcacgcacacacacacacacgcgtcgcggctgcgcgcctccacactctatatatatatcacacagacatcacaccacgcctctctctcttctctcttctctctctctctctctaataagaatatatagatatacacaccactcccttctctctctctctctgtcgtcacacacacacacacccctctctactaaagaagagagatagagtagcagacacctctgtgctgcgcgcgccctcacacctcccatctctctatatatatgtgtgtgtgtgtgtgtgtgctctctccccgtctcgtgtgtgtgtctctcgctccaccacaccgcgcgcgcgcgcgtcgtgtgttgtttcttataatacacacaccgcgcgcgcccgccaccacacacacaacaagtacaagagagagagagcgcgcgcgctcctactactatatatttaatatatctctcctccccacacacacacaagagagagagagaggcgagagagagagagagagagcgccccccgccgcgcccctctctctctgagaaaaaaacccccttttttctctctctctctctcccgtttttttttttttttttttcccccccccccaccatattattttttttttgtgtgacacacacacacacaaaaaaacacacacactccctctctcccaca

SEQ ID NO: 597924 - DNA, 178 bp, Homo sapiens
aaaagacaagaaaatggaacatcccttactgactcctgccagcactttgatttgagcccggtcagaggtgttttggacttctgaccacaaccgtagagtaatacatttatgttgttttatgtcactaaatttgtggcgatttgttatagcagccatgggagactcatacaggtagata

SEQ ID NO: 597925 - DNA, 101 bp, Homo sapiens
aaagggaaaatggacaggagattcttctgtccctcataaggagcagtgggaagttgattttattagacaaactgttgacaagacttcgagaaaggggggcc

SEQ ID NO: 597926 - DNA, 860 bp, Homo sapiens
aagcagtggtatcaacgcagagtggccattacggccggggagtgatcccaaggtcccaatctcccacggaaccactcagggttcctgtgtggacatggcttcaccttagtgtgaccaattggctctctaggctccgcggagcgtcacactgtctaccaggccttgttgccctgactgctgctctgctccactgagacttgcaatagaggctggatgccggtccataatgccggttccagttagtcgagggcgtatttgtgacgcgacggcatagtggcatcacaaatgctcacatcggcgcggcacgcagtacgtgggcccatgtgcaccaagcattaacgcaagtgagttttgacagaatatccttatatgcccaaaagggaacacagggttctgaagaatccatctctcttggtcagccatttgtgatagctaggttagacgctgcctactaggtagggaagaggggcgaggcttgttggggcatatacataaagggtagcccacagaaggttagctattcacgtagtaggatcacacacattcccaccacagaggttagaacctccttcacgttgggcaccccattttggaaacacggggtttggcccaacgttcctccaaggtgtttggcccgcgaaccgcaacggcaccattgtgggttcaccattaaaagcttaaagacaatttaacaggttaggtgaagtttcgagttgtttgacacagacgatagagacccacgagagcaagacagagcagctgcaaggactcgacgagacgaaaaagagagaaaggtcatgcgagatatcgacggacaaagagaagcacacatctacacacaacactcacagcacaacaga

SEQ ID NO: 597927 - DNA, 248 bp, Homo sapiens
caggatctctggtccgctcggacatccgtcttgggaaaggcgtcaccatggcttgctgtgggccacgtctctcctggtgggacctctcactctggaagctcctgcgggtgaaccctggtctcctgtctggaggcagaaggacgctgtctatgtgctgggaggccagctggggttgaggaggacagtgtgggcgcctcagtagtcaattggtcctgaacggaccgggtaccgactctcgagattccgta

SEQ ID NO: 597928 - DNA, 544 bp, Homo sapiens
atctagaggatctgccttccaccagcaaagacaagatggggctgggtgcagtggctcccacctataatcccagcactttgggaggccaaggcaggcggatcacctgaggtcaggagttcgagaccagcctggtcaacatggtgaaaccccgtctctactaaaaatacaaaaattagccaggcatggtggtacacacctgtaatcccagctactcgggaggctgaggcagaacaatcgcccgaacccaggaggcaaaggttgaagtgaggcgagattgcaccattgcactccagcctgggtgacagagcaagactctgtctcaaataaataaataaagctggaagtagaaggggaggatgagattggtgggttctgagggctgggatggccaaacacagttctgctgtggtcaggattatgcagagatcaggggcagaacaaccaggagttatggaccagaggactgcaggaatgtggacgctgagggccaaagcaagaaaatgagtgactgacagattaacactcaggtgtaagcaggacagaa

SEQ ID NO: 597929 - DNA, 1184 bp, Homo sapiens
  misc_feature (665)..(665): n is a, c, g, or t
  misc_feature (1184)..(1184): n is a, c, g, or t
taaagtaacaggctctttaatgggggggcattctgtgagcaaattcccattgtgccaccttcacagtgtgttaaaaccagttaaacattaaaaaatacctccagcctgtggtgcccccacccagccactgtgcccgggccccttcagtgggaaagtgaccacatattccgtggaaggacacagaaccacacaccacagcccagcgtgtggcaccagcaccacaccccacattccatgtgggccaggggaccactgggggaatgggccacaccagcctcgcggggtggggctcccagtgacgggacatctccgtggaggaaagacccaaaatttctcacgagtctccccttagaaaacacccatctctttgaaagagtctcagtgcttaccgagaactcttctgtggcaccacacctcgaaaactcccagagcgaggggaggccatcgtggtgggagagggcaactcgggtggtctcccgagaactgtggcgtgcgtgtcacacacaacacagagacagggggcgcccacgtgagagcggggcactggtgctcgcacccacaaagacgcccactctccccaaggagcagagaagagacgagacttcatacacaggcggccaatggcccctacggggcccccattgcgtagggcgaaaaacccccanaggggcccagggccctctcggaggaggctctgagggcacaaaccgggagcgagggcgcactcaatgggttctgcgccattgtgcgcctgagttgctccacccaaggggccccacagcgcggggtgggctaagagcctcccgtcgccaggagggcaaaaatccgcaagaaacccctgtgaaaaacgtggggccccaacaagagcggacggagcgtccaccaacacagggtaaagcgagcccaagaaggcatcaccaacacggcggcaccggggtcgccaatacggggcagaagaaagagcccacactcccaacagggtgtccccccagacaactcaacggggccaacaaaccacgagagaggagccaactcctatatccccaacggctatggagaggtggcgcggaaggcaaaaaaacgcagggggccggagacaacaggatcatcgacatggcgcccatggctccacacggtggtccctgagacccgggttttctcgcgacaccgcgagacaacatccn

SEQ ID NO: 597930 - DNA, 204 bp, Homo sapiens
caggctggtcttgaaactcttgagctcaggtaatccaccttcctctgcctcccaaggtgctgggattacagatgtgaaccaccgcacccagccaagatgtctttcaatgaaccaacattcttaattgtcaatatagtcagcattaagcacaccttttcatggtcactgcttttttttttttaatgtgtgtcatgtttcccttta

SEQ ID NO: 597931 - DNA, 222 bp, Homo sapiens
  misc_feature (12)..(12): n is a, c, g, or t
  misc_feature (26)..(27): n is a, c, g, or t
  misc_feature (86)..(86): n is a, c, g, or t
  misc_feature (144)..(144): n is a, c, g, or t
  misc_feature (189)..(189): n is a, c, g, or t
  misc_feature (191)..(191): n is a, c, g, or t
tgtaaggagttncgctgccccactgnntgtccttcatgaggaagatgctcgcggccgtctccctcgtgctgtctggcgcttctaanaagccggcaagcagagtgctggtagcatcccgtaattttccaaataatgctacatttnaaattaagaaatgtgaccttcaccggctggaagaaggccctcctntnacaacagtgctcaccagggaggatgggctca

SEQ ID NO: 597932 - DNA, 870 bp, Homo sapiens
  misc_feature (32)..(32): n is a, c, g, or t
  misc_feature (75)..(75): n is a, c, g, or t
  misc_feature (91)..(91): n is a, c, g, or t
  misc_feature (93)..(93): n is a, c, g, or t
  misc_feature (106)..(106): n is a, c, g, or t
  misc_feature (109)..(109): n is a, c, g, or t
  misc_feature (139)..(139): n is a, c, g, or t
  misc_feature (141)..(141): n is a, c, g, or t
  misc_feature (144)..(144): n is a, c, g, or t
  misc_feature (148)..(148): n is a, c, g, or t
  misc_feature (153)..(154): n is a, c, g, or t
  misc_feature (173)..(173): n is a, c, g, or t
  misc_feature (177)..(177): n is a, c, g, or t
  misc_feature (181)..(183): n is a, c, g, or t
  misc_feature (195)..(195): n is a, c, g, or t
  misc_feature (230)..(230): n is a, c, g, or t
  misc_feature (232)..(232): n is a, c, g, or t
  misc_feature (242)..(242): n is a, c, g, or t
  misc_feature (248)..(249): n is a, c, g, or t
  misc_feature (268)..(268): n is a, c, g, or t
  misc_feature (278)..(278): n is a, c, g, or t
  misc_feature (284)..(284): n is a, c, g, or t
  misc_feature (319)..(320): n is a, c, g, or t
  misc_feature (324)..(325): n is a, c, g, or t
  misc_feature (327)..(327): n is a, c, g, or t
  misc_feature (332)..(333): n is a, c, g, or t
  misc_feature (335)..(335): n is a, c, g, or t
  misc_feature (339)..(339): n is a, c, g, or t
  misc_feature (360)..(360): n is a, c, g, or t
  misc_feature (362)..(362): n is a, c, g, or t
  misc_feature (399)..(399): n is a, c, g, or t
  misc_feature (469)..(469): n is a, c, g, or t
  misc_feature (473)..(473): n is a, c, g, or t
  misc_feature (484)..(484): n is a, c, g, or t
  misc_feature (494)..(494): n is a, c, g, or t
  misc_feature (562)..(562): n is a, c, g, or t
  misc_feature (570)..(570): n is a, c, g, or t
  misc_feature (635)..(635): n is a, c, g, or t
  misc_feature (750)..(750): n is a, c, g, or t
  misc_feature (764)..(764): n is a, c, g, or t
  misc_feature (789)..(789): n is a, c, g, or t
  misc_feature (797)..(797): n is a, c, g, or t
  misc_feature (864)..(864): n is a, c, g, or t
tgggtctaaaatggtttacatcaaagtttaanacatatactgtctgtgttacagaggctacaataccaatttggntttcgcacattatctnanacttttttttcanagngtgcgaagtttggtcaaacaacatcaagananttntgtnctaannttttttcgtctttttaganagtnttannncctccttttttnccactggcttcgaaactttgggttttttttcagantntcaatttgtnattttnncttttccattcatgggagnttttctgggntttttnggtgggtcttttctggttgtggctgtttttttttnngttnngnggttnntnttgngtggttctttgtgtgcgggtngngggttgtgctctgtgaaattcattaaaaagttaaaanccacagaaatgtcattagaaacaacatatttcaatatgtaactgctttccatcaatgaagaatatttttnaatnacttaattganaagtattganctccccaccaatttcagctgcaacagtattcctcctgaatgttttctaattagtgctctgtctctggnctttaggnccaatactctgtgtgtcctcttcctgactaggacgtttcccaccactgagaccagtgcccatggngcttcttccttgcttcaacaggtgagtttgctgactgtcgccatgagcatagtgtaaaataccactcccttgagagcaacttccactgctgctacaacctgggatattttctgcngaatatcccatgangcctccattcccattaggattaganggtactgntgccagacgaccttgtcctctatatcgtgaaagctgctggtagatctgtttcatcctttcgatattnaaacgg

SEQ ID NO: 597933 - DNA, 313 bp, Homo sapiens
gctactttctctgatagactgtgttagatacggcattggggaaaatggcgtactcatctcaggggataatgacactgtgagcgccatattatttctgtggtgaagaacaattttaagcctgtgctaatagattaagcgactagagtgattattttgaacaaagagagtggttgagagttctacagccagcctgagactaatcaggaggagtaaagagtgataatttaatcatatcaacccataacatgggatcctgatagtggctgtcacactacaccagctgaaggaggtctctgaaccacccagacctgag

SEQ ID NO: 597934 - DNA, 775 bp, Homo sapiens
gaccgaatgaccttgggcaaggcactgcctctctgtgccttggtttccccatctgtagaatggggagggtggacactggaaactagatgacttctttcacctccaaaattcccttagtttctatgaaaatattgggggtaggggggtggattaggagattgaagggttgagaagagaagagaaattgtcctagaagagtcctcaggaaccgtgcctggagcaaatgcgcatgggggtgggcctggtaagtcccaggaaccacaggaagtgagctaaggctcacctcagagctagtctgggtctccgaggctgcctgggcttattagtgcctcgatgaagcaactctggatggccagctgtctgtccctcatgagtgcgcacctggaggcatggaaagattatcttatttattttattgttggtcttctggctatatctagagtggcaaaaaaatagagcagagggttctctagctagtcggtccagactgtctaccaccagagaaggcgacagatgcctcctgggttggaatcggggatgcacgtgtggtatctggccgatccattctggtaggtctccgagcagagcaggagtctaggtcccagcgtgcatccatcccagtgccccgatgatcatctggtcatgtccgtcccaaactacccttccaggggggccttaccagggaagcgactattcggctaggaatttggaattcacagggcttgattaacccctggcaaaatttcgcgtttgatgtcagatcacattgaagctg

SEQ ID NO: 597935 - DNA, 740 bp, Homo sapiens
gtactctcgatttgtgtgccccgctcctccctgatctgcctcccctcccctttcactcaagttctgcactcaatctcttactctacatctggtgtcgctccttgttctcgtatactgttgccgccttgatgagcagccacatggcgcttactgaaatccagagcctaaccgttcaatcccagcgcgggcggctgcgcgtcagtcgccggtgaattgtgcgccatgaagaactaaaggctagtcttagatatctgggtgcccaggcctattcggggaaacctcagataattgctactcgggcaaggaagaacgaggagaaaacggaaggtcacaaccaatagttggtctggaacacgtgtcacaatgtacagaggaatgtaggggtcgcttcaagttcgagcctttgacttgtaaaaaacaagtaagaaggcatctatgattagggtcgatatttcagcagacacgcaaaataaaatcagcttatataaagtagatgagagattaactcttacctgtggacaaagatgaaccacggaatagtgaatctttaaattacagaagagtttgctaaactggacttgcgtaaggttgaggatggtaagtccataaatgcagggggaagtactagtccgtcaaatgtgagggaaggttcctttaacattgagtgaacggggttcatgggaggaattctccggtggtaggttgcataagcatgggtcaagaggaaattccaaaggtgg

SEQ ID NO: 597936 - DNA, 102 bp, Homo sapiens
tttggggaccccccccccccccccccctccttcctctttttttttccccccttgttttggtaaaaataggcttggggatttaaatggtggttgggggttgga

SEQ ID NO: 597937 - DNA, 111 bp, Homo sapiens
cgatgctgcaggttgtttcacctgctgctgctgaggctgagggggtggggtgcaaggctgctatctgctgctgacgaattcatgcttcaaatgtgtttttttctggtatac

SEQ ID NO: 597938 - DNA, 897 bp, Homo sapiens
ccaggcatatgctgagggcccagtttacggtgctgtatgaaggggcccccccgcgtggttaagggagggcaaaaccagggtgtgacgcgcttcgcgggataaacggtccttgttcggcggctcccacgtggctatttggcttcaatagggggtttgcttcgtcaattataggcacactgaggggtttcttgggggacaaacccccgccctgataagttccgggcggcccaccccccaaagagcaaggctgtacggcacgtgagtcgtgttgcactgccgatcgtccccacgaagccaccaatgtcatcttgttttgtcacaattctcttaccttatttaccaggtaactaaaactcgtggattctcgtctattcttttaaagacttcccgctaataatctcttcactccacgagaaatatttctctgctgactcaatcacaatacttagtactagttggttaaaaagaccccctatcagttcgtgtggaataatactaaaacgtcagcccgcgtcgtttgtttactcggtaccaccccctgcgaagtaacacccctggtaatctttttcttcggtctccgcaagaatgagcgacacaccacgtctctgaaaccatgtggtgaggctcattctttaggatgcaaaaaatacaggggaaagactatcaaattttgtgcggtttgcttataacatgacctgtaggctatagtttcttcccgcctactggcgcttgcgtgggctgatagaggagggagccaccagccccatagaccacgcccccaccctttatggtggagcaataactagttttaccccacgaaacacctcggcccccaggtcgggaacccgccggtttgccccaaaaaagaactcccaacaaaacccgccaaacaaaaca

SEQ ID NO: 597939 - DNA, 128 bp, Homo sapiens
tcatacgggtcatctgacaattcaatgtccttcgacccgtcttcatcctccaaaactcgaacccttgtgtatccttgtattgaagagagacagcctttacagctacatggtcacattggcatcagaac

SEQ ID NO: 597940 - DNA, 265 bp, Homo sapiens
  misc_feature (151)..(151): n is a, c, g, or t
  misc_feature (184)..(184): n is a, c, g, or t
  misc_feature (246)..(246): n is a, c, g, or t
  misc_feature (262)..(262): n is a, c, g, or t
gccctcttcatgcaaataacatcaggcagaacagagatttattatgtgcaaatgacagtaacctttataaaatctagaaaataatttttccccaatttcccctcgaatccaaacattcttctgcagtctgagtggggttgataggctgccnagatgttgaagggcctcagtgggaagggacttngctaacagttcccagtgccagtgttctctatagcgtgtcttgttgagcactggtgccctggnttgcttgcccacaagnccg

SEQ ID NO: 597941 - DNA, 198 bp, Homo sapiens
atgtctagttgatagattctgtaactctcactctcagcgagaccattgcatcattggtcgcacgctggtggtccctgaaaacgtcagatgatgttggggccaagtgctcgtacaatgaagagaagtacaaagccatggacacgctggaagtctgtatggttcgtgagagtagattggggatccgcctcaataaacatt

SEQ ID NO: 597942 - DNA, 407 bp, Homo sapiens
atagtatgatccccctggctgtgtcagagtctcatcatactacactgaaactctatacccattaaacaattcccatccccaccagtaattgtctttctgggttttttttgttttttttgttttttgagacgcagcctcattctgtcgcccgggctggagtacaatctcggctcctgggttcatgcaattctcatgcctcagcctcttgaatacctgagattacaggcatgcaccaccaaacccagctaatttttgtatttttagtagagacggggttttgccatgttggccaggctggtcttgaactcccgacctcaggtgatctgccagcctcggcctcccaaagtgctaggattacaggcgtgagccaccgtgcccagtgtgggtcattttttttttgagggcca

SEQ ID NO: 597943 - DNA, 299 bp, Homo sapiens
  misc_feature (221)..(221): n is a, c, g, or t
  misc_feature (270)..(270): n is a, c, g, or t
agcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccggtgtcttgctttgntgccagctggagtgcagtgacacaatctcagctcactgcaacctctgcnttccaagttcagatgattctcgtgcctca

SEQ ID NO: 597944 - DNA, 2905 bp, Homo sapiens
  misc_feature (1436)..(1436): n is a, c, g, or t
gagcagttaatcatggaaactgggctattcctgtttatgcacttctagcaatcttctgttgtaaatattaaaaggtaacgacaaaaggatgaaaacctttttaaaaaggcgcaaatcagttaatccatcagatcatgtgattgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 597945 - DNA, 390 bp, Homo sapiens
tgtgaaaatcgagttggaattgcctgtatgaacaatgcgcgagttagccgttgattcgccatttcgctcttacagactgaacaatgtctccgaacatcatagaatgcttggccgaggaatgatctgtatgggcattaagtactctggttcatgtatctgactacttcacagatctgtagcccagagaccgtctgtgtaagcagcaaccatagtaggcaatttgctatctcttcatccggtagcagtccagacatactccaaaaccacaacgaggacacccccagtgcaggttgaagatggtggtgtcgcacacatcatacatttctcgaacagctttgacagctcgattccaagcgagctgtctgtcgactgcttggattacaaggaggc

SEQ ID NO: 597946 - DNA, 2947 bp, Homo sapiens
  misc_feature (1436)..(1436): n is a, c, g, or t
gagcagttaatcatggaaactgggctattcctgtttatgcacttctagcaatcttctgttgtaaatattaaaaggtaacgacaaaaggatgaaaacctttttaaaaaggcgcaaatcagttaatccatcagatcatgtgattgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 597947 - DNA, 951 bp, Homo sapiens
  misc_feature (912)..(912): n is a, c, g, or t
tctcagcccctcgttcttggtcctgtccctggaaccttgtacgcttgctcaaaaaaaaaaaaaaaaaaaaaaaaaaaaaaaaaaaaaaaaaaagggggggaccttggaaccaaaagggcaatttttgggggagagattaattttttccaataataacgccaaattagtgggaaaccaaatctcaagggtaagttgaaagggggttgggctggggtgctacgattggttgaagaatttgtcgagaactccgacattcttattaataaatgtggagcccttaaaatagtgaacaaagcctttcttaaagaggcataattttccaaaaggcgcccccaccaaattctgtggtctccagactattacaatgaaagtgttgggcccaaaaaaattcgctgtctggtgaagacattaaccagggggcatttgtgggttagggagccgcgaaagaaaaacccgcgagagcacagtgtggaaaactttgtggggacaaagtagcatacatttttgcgtttcttctctgggaaacaaagaagagaagcgggatataagactatatgcgtgggcgagcatttgaggagggaagggggttgccacaaggacacataagtgtgtgagctttccatcaccatgagtggtgatgaagatgtctctcgagagagttgcggttacacgcggccatagaaaagaagggccgtctcctccccgatgaattgttgaacagcgccggctggcgccacatgttgtagagacctcttcccccaaaggtggtgatgtttatagcgcaaggccagttggtgtgtttctcccgcgggaggatatataaacctatgtggtggcgtaccgtggtcgaaaacgtggagggaacgatgagacggcaggtataacgcaagggcacgcaacagagcgtctacngtgaggggagaacactcaaggcgcttatgtgggagcgaa

SEQ ID NO: 597948 - DNA, 858 bp, Homo sapiens
aagtggtgctggtggcccagtgctgctccatctgctgggtgccacagtcctcatggagggtcttcaagcctgctcagctgtgcctgtgtgacagcagtggcccctgtgtccctcccaatgcctcatgtgagggcaacacatgtccctggcgatgtggccctggctagtgccagtgtgatggatggcaatggatgcccacatcttgcatgctggctccctggtggcagacacctgggtcctcacttgctgcccactgctttgaaaaggcagcagcaacagaactgaattcctggtcagtggtcctgggattctctgcagcgtgagggactcagccctgtgggccgaagaggtggtgggtggctgccctgcagttgcccagggcctataaccactacagccagggctcagacctggccctgctgcaggcttcgaccagccacacgtagcccaagagcaaccgcgtactgaccatggagccgaagccctggacccaatacgacgtatccgcacgtttgggatgccatgccttgcatggtaggcccaacctgggtcatgcgtgattccagcgtacccccccgggatgacttgcatcgcagttggagatcccgtagcggccaacttcgtgccgcccctgacggtcatcaatacgagatccggacagcgcgacaattgttatcaaaggtgggcagcatcgtcacaggagcagcaacgcgcattgccgcgatcgcacacgctggtagcaagaacctgttgttaccccgagaccgcgcgttaggggcgcatggggacacccctgtagtgaacttgcccatagattgaataggagggggggtcccctatccaatgatcgccttgcag

SEQ ID NO: 597949 - DNA, 2929 bp, Homo sapiens
  misc_feature (1436)..(1436): n is a, c, g, or t
gagcagttaatcatggaaactgggctattcctgtttatgcacttctagcaatcttctgttgtaaatattaaaaggtaacgacaaaaggatgaaaacctttttaaaaaggcgcaaatcagttaatccatcagatcatgtgattgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 597950 - DNA, 3026 bp, Homo sapiens
  misc_feature (1557)..(1557): n is a, c, g, or t
agcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 597951 - DNA, 2731 bp, Homo sapiens
  misc_feature (1436)..(1436): n is a, c, g, or t
  misc_feature (2617)..(2617): n is a, c, g, or t
  misc_feature (2660)..(2660): n is a, c, g, or t
  misc_feature (2707)..(2707): n is a, c, g, or t
gagcagttaatcatggaaactgggctattcctgtttatgcacttctagcaatcttctgttgtaaatattaaaaggtaacgacaaaaggatgaaaacctttttaaaaaggcgcaaatcagttaatccatcagatcatgtgattgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaaggtgagatgcgttgtcttaaaatgattttactatcaggttagcgctttttgattttactttgtttctanaacactttagagatactggtgtagaaacagacttgtcctgaantcatatggttgcttcaaagtgtttttccaaagcttcagtcttttagnaccatctatactttcattactacg

SEQ ID NO: 597952 - DNA, 2501 bp, Homo sapiens
  misc_feature (1032)..(1032): n is a, c, g, or t
agggcagggaagagaaagaaaaatgccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 597953 - DNA, 497 bp, Homo sapiens
  misc_feature (47)..(47): n is a, c, g, or t
tggcccttttgcctgctaatggaaaaaaaaaattgggagcgcatttncaggaggagtggtcacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagcta

SEQ ID NO: 597954 - DNA, 139 bp, Homo sapiens
acggatctactccacttggtgccaggctgagatatagtggcgtgatcatgggtctctacagactcacctcccaggctcaagcagtctacctacatctgcctcccagtagctggactacaggcgtgaaccaccacgatca

SEQ ID NO: 597955 - DNA, 2026 bp, Homo sapiens
  misc_feature (1436)..(1436): n is a, c, g, or t
gagcagttaatcatggaaactgggctattcctgtttatgcacttctagcaatcttctgttgtaaatattaaaaggtaacgacaaaaggatgaaaacctttttaaaaaggcgcaaatcagttaatccatcagatcatgtgattgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcgtatgtattgcttatcagccctcctatatttgtcactatgttaggataagtgtgttgcttttgtattactgtattagacgattgaccagtggataaagacaaagctaa

SEQ ID NO: 597956 - DNA, 1474 bp, Homo sapiens
  misc_feature (134)..(134): n is a, c, g, or t
gacttagaagcatcctaaccagagtcactctccgcctgctgtctcgtttggtggcagtggaaatagctaagtaatactgtaaatatctggacagccatagacggtgtatatagtatataatatgcactaagtcnatcattttctttgtcccttctaacaagcctgtgaggcatttaaggcagagttactgtctccatactgcacgagtaggctccaagaggtgacttgcccaaggcctcacagctgctgtgactggtggagcaggtctttgggcctgcagctggccccactgttgctcaggggcaggtgccaggtgctctttccaagtgcagcacaagctctagacctgaaactcttggattttccttcctgggtgggttttgttttttttttttttttaacaccacgtcctctcgtttccttacatgcaggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagcta

SEQ ID NO: 597957 - DNA, 750 bp, Homo sapiens
  misc_feature (681)..(681): n is a, c, g, or t
  misc_feature (684)..(685): n is a, c, g, or t
  misc_feature (692)..(692): n is a, c, g, or t
  misc_feature (694)..(695): n is a, c, g, or t
agcggggggcatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggttcaaaatggaaagtatttattgaccaaattaacaggtctttggagaattacgaaccatgttcaagtcaaaactgcagctgctaccatggtgtcatagaagaggatctaactcctttccgaggaggcatctccaggaagatgatggcagaggtagtcagacggaagctagggacccactatcagatcactaagaacagactgtaccgggaaaatgactgcatgttcccctcaaggtgtagtggtgttgagcactttattttggaagtgatcgggcgtctccctgacatggagatggtgatcaatgtacgagattatcctcaggttcctaaatggatggagcctgccatcccagtcttctccttcagtaagacatcagagtaccatgatatcatgtatcctgcttggacattttgggaagggggacctgctgtttggccaatttatcctacaggtcttggacggtgggacctcttcagagaagatctggtaaggtcagcagcacagtggccatggaaaaanaannattttcngnntatttccgagggtcaaggaccagtcccaaaacgagaatcttctcttccttttgtc

SEQ ID NO: 597958 - DNA, 2162 bp, Homo sapiens
  misc_feature (1436)..(1436): n is a, c, g, or t
gagcagttaatcatggaaactgggctattcctgtttatgcacttctagcaatcttctgttgtaaatattaaaaggtaacgacaaaaggatgaaaacctttttaaaaaggcgcaaatcagttaatccatcagatcatgtgattgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttanaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcatagggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaacatgaaa

SEQ ID NO: 597959 - DNA, 1172 bp, Homo sapiens
ttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagcta

SEQ ID NO: 597960 - DNA, 362 bp, Homo sapiens
gcatagatacgcggattaatgggtatgtagggtccatccatgcacatggtggttctttcgcttggccctacgttgtgggttggctcggtactccatgttgcccagcacaggccgtcaagaaagcctttataacaaaagacttcctgaagggaagctgctcacagccaagggtctacgccttaaccaacagaagaacctggtagagctgtctttcctccccggagacactgggaagccagacgtgctttctgcttccttggaagggcaacttacaaagcaagaggagaggaaaacagaggcagaggagagagaccaacaaggggaaaagaaaaatcagacacggaacgagaagaagaaccagg

SEQ ID NO: 597961 - DNA, 328 bp, Homo sapiens
  misc_feature (297)..(297): n is a, c, g, or t
  misc_feature (313)..(313): n is a, c, g, or t
ggttgcgcttcatagacgccgcgtgtacccggttgtcctcaagcgctgtcagatctgatggtttttctacttgaaggacacaatgttttaccacactagcacatttcacaggtttgctgtacttagtcgcggagttcatcttcagtggcttctgctacatctgttgcaactaaacagtccaagtcgctccaacctctgatgacattttgaaagggatataatatgtgcacacactacgatccttactgtagcctcagagaggcaagcgttactatggatgtagcagcgttatttgantcctgagtttttacangctgtcaacggggtt

SEQ ID NO: 597962 - DNA, 1414 bp, Homo sapiens
ctcaactttccacaaaattcagtagtattttattggtttttatcagaggagtgttaaattgtcttcttactaaaagcattttttatactttgcagtcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 597963 - DNA, 2382 bp, Homo sapiens
  misc_feature (134)..(134): n is a, c, g, or t
  misc_feature (2035)..(2035): n is a, c, g, or t
gacttagaagcatcctaaccagagtcactctccgcctgctgtctcgtttggtggcagtggaaatagctaagtaatactgtaaatatctggacagccatagacggtgtatatagtatataatatgcactaagtcnatcattttctttgtcccttctaacaagcctgtgaggcatttaaggcagagttactgtctccatactgcacgagtaggctccaagaggtgacttgcccaaggcctcacagctgctgtgactggtggagcaggtctttgggcctgcagctggccccactgttgctcaggggcaggtgccaggtgctctttccaagtgcagcacaagctctagacctgaaactcttggattttccttcctgggtgggttttgttttttttttttttttaacaccacgtcctctcgtttccttacatgcaggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagctacttttgcttttgtggtaagcttttcagtttctttagtacacaagaaatactggtttagccaagcaacactggtgagggggaaaggtgaagatgaggaggaggctggaaggcagaaacaggacaccgagttcagtgctttggactaatggggcttcctgtaatttcaatctctggactcagtccagctcttctcacccaacacccttatctgtgactcttccaaccaccttccttgtgggacctgtgaatagatcctgtatattcctttgatctcttttatacaagggaaaagcagctgatgggggactgggagcaaatctgagaaaaatgacaaaacatttcttatctcacagaacatttctcattttccatataccaatagttgagctgagggcctgcctgcacttttaggctgtcatgctcataggagggccttgctggtggccaacttgcctacctggtgtgggagctttctgcacaacataggacagtctgtctcctttgcgacattaagcaatggtttcccttctttcaccacttacacttaaccacaccttcctngaaaggaggaatgtgcctggcgctggctttgtcacagcctcgtgagaggtgtgcacatgtagagtcaccaaacccattggggaaccttcttttaggtacatttgaggctgctggtcaatacctctccgctcattattttctttgaaagggcaggttacagaaactaaagccaacatatatatttataaataaaaggcccattcctttttagattaaaaacaaaacttgggtaaataatcttctaagtaggtagtccaatctagaggtaccagagcttgggatattgccaggattttaaaaaaatgttgtatatacattgttgtatatacagtgttgtatatactgct

SEQ ID NO: 597964 - DNA, 294 bp, Homo sapiens
ggatataataaggccaatgtgggccacttgaaaaacccgttggtattccatgaagaaaacccctatagagatattcccattccacagactcacaattggagaagcacagcaccaccacctgggggttaaaggccatctgaacagagagatataatactccatattgcacaatgcacttgcaaagcttcacttctttttaagagcaaaagcccccatgttgaaacctccaccacagttttatgctgaagaaattatatccacacgcttctcaataaaccctttgtttcctcaccc

SEQ ID NO: 597965 - DNA, 159 bp, Homo sapiens
ggtagagctaaccgtgacagtatcctcccatggtgagttcactctcctcggccccctacacgcaccagctggtgtacgcccgtccctgtccttgtactgcacggctgacggactcgaagcggccctgggggacggtccagtgcgcggctcagcgagtca

SEQ ID NO: 597966 - DNA, 1065 bp, Homo sapiens
gcaaaacaccaaatggcggatgacgccggtgcagcggggtgggcccggggtgccctggtggccctgggatggggaacctgcggtggcttcctgcggaggtttcggcagtggcatcctgtgtggcctggggtcgcggccgtggactggtggccgggtggccgaggccgctggagctcgccggagtgcaaggcctgacggataacggagtggattgccctgtcaccaagttgggccgcattggtcaaggacatgaagatcaatgtccctggaggagatctatctcttctccctggaccattaaggaatcagagatcattgattatcttcctgggaggcctcttctcaaggatgaggtttgaagattatgccagtgcagaaggcagaaccggtgacaggccagtgcaccagtgttcacaggccattaagtatgctactcgggggcactacacatgggacaaacgtacgagtcttgggttgtttaatgttgcttccaaatggagtgttggcctcaaccctgccatcctgttggggccatcattccttgtggccaaaggtttcttcccaatcgttcccgctgtgacgacagcatggcatacatggggggggaacccaaggatcgggccaagacctcacaacaacttgtccccctatgcaatggcgtgaacaggggcccggattgacgggactcatagtgcgtagggtacaggcccttctattctccctttggcacgccccaggggggggccaacatcgtgagccaattcaggtcatcaccgggcaacacttgttagccctttacagagacagagcattggcatccaatagcataggagccatgggtaaatcggaacttgaaactttggcttaacaaacacttcaaagaccctgggaggggcattgccacattgaaccacatccactatgggggcaaacttatctggacctaatggggtccaacacttttatcgaataggcacatatattcttaaagaaccttaacagagttaccgcttggaacgcgcagaggagaccaatcgttggcaaaggggaggacctaggtaatac

SEQ ID NO: 597967 - DNA, 204 bp, Homo sapiens
ggtggctctcgacggactccccctccagctggccccccagcagtccgcagggctcagtggccagccttgcctggctggccccatgggcccgggggcccaggctgccaggcatgccttgctggccatgggtcctgtgcacccatcttgccatcagctgggcggcacttgcggcccttgggggccagctggcggggtcaccgcgct

SEQ ID NO: 597968 - DNA, 390 bp, Homo sapiens
tggcagggctctctacctggggtcatacttattaaaatggagaccattaaacaccagtatacactaaataaaaaaaaatttaaagtcaaaaattaatactaaaacattggtttttctggtcagatctagcccaaaggtcctcggtctctcttcgggcttcaaggctttctatctttccctacatgtatactagctggcaggggcttcccacttcatacactaatctacacctaaacagaccggtaagaggtatggaaagatgggtccactaaggagtatcaaagttatacacctattgtatgtcattccaacaacattatcctaagtcattggcattcggcttagatttctaagacaaaaggatagacggtacaaagctagactcagagc

SEQ ID NO: 597969 - DNA, 953 bp, Homo sapiens
tcagctgtgctgttgtggcctcgtaataggcgtctgttgagacgcggggcttcgttctctgggcgctccccactgtggtgtgccttctcgttgccagaggtcaccaacgtgtgagttaaggtactctccgctaaggcgtcgttggggtcttatttccgccgttgttgcagagcccatcatgtggtgcgaagtgtttcttgggaaaaacgatttgcttgctgcaggaggtccgcgaggggcccgccccaatgtctgcctgttaatacggcgcagcctttatttgggaaacttgggtgcctccccccgcgtggtagtacacgcctcccccgaccccccgggagaattgtccgcccgctccgcgtgaggcaggagaaagagcgaggggtcgtcgcccccgccgccatcaatggaagaccatcagttcctcccaccgcgaggtcgaagcaccgacggggtgtacactccccgcccgaaagcccggttggaaccaagacgcccgtgcccccccgcgagtgccctataaacgatgcgcgggagtctacaacgtccacggatcaaggcaggtcccgcccaaaggaaagcacgagcccccacacgggtagcacgagcttcgcatcacgggacggacgattgatcatagaggcgcgctagcccaaactttgaagaagaataatccatgaacacttataatagagattttactcgccaactcgtgagcgagcatggagaagtggtcgcctcctcaaggcgagtatctgaaccgcctcctgctgccccctcgaagaatgggttatggagaaatcccctctattcccggctctggtgtatataacagcggaggcggtacccagcagacctacgatactactggcgcacggcaacagggcatgcgtgtcacctacccacgtagccctggaaattgggcacccacaaaaaaaaacggccacacgacg

SEQ ID NO: 597970 - DNA, 151 bp, Homo sapiens
agtcaggctaaatctctaaaatacatcttagtactccagttatgtcctcaggagcttgtgacctttcatctttttcactaaagtggaatctaaaactgcaagggaaatattagttggctgggcacggtggctcatgcctgtaatcccagca

SEQ ID NO: 597971 - DNA, 640 bp, Homo sapiens
aagcattggtatcaacccagagtgcccattacggccggggggtagtgtagctttttccgtgctgtgtaccgggctaacaatggatcacccgagaaggacgttcaactctccaaagacaggacagaccatagtgatatactatctcgtggagagtgttcacacagaaatagtgtagaataatatcgtagggaattcaatctaggatgcgaggacgaatgtggatacaggacataactgttgcaagaaacacggcactagaacagattgggtcgttctttgatgactcgatggaatgctggggaattcagaggaatgtgcttcaacttatagcgttgcgatttgcttcattcgttccacagtgttcgtgattagctgtatacgtcttgtcgattttgcttgacatgtagttcccccattatcttcgggagatagctattccatgggtgccccagtgaactgcctgtaaaacctcaaagcagtaaccaacagactttagtagcactgattttctgtaccactagtatatagtaacgctatgactaaacgtactgatgtatataatgagaggatagctgagagcattaataactaatgtaatagaactcggtggtgacattgctataataagagttgtgtgcag

SEQ ID NO: 597972 - DNA, 963 bp, Homo sapiens
gtggtgtctgtgtctttgttgtgtcttgtttctttttttgttggtctccttgttctgacggcttctttgtgtctctcgcgctttgggtccgtgtactccccgttcctaccgtgcggtccgatcctatgttggtttgtcgctcttgtccgttggtgtctgaccagttgtgttctatttcggcgttgtgtactctggtttccccttgcttctttagtctagcccctctttggctccgttcgtctatcactttcgttttctcctattaatttgctcgaccctcttaacgtctcttatctcacttgactcgtacggttccctcccctgcgctccttctgtggtctatgcgtcgtgtacagttacttccgtaatttcgtgggcgcctcactaagatgcccatgtctacgacttcactgacttccgttatggcgaaatatgagacgttgtcccgtactatatctcacttgcacactctgctatatgtaggctcccaggacacgccttgtacttttaagatctgaggcatgctcgtgcagagttctagatttggctttcagagttcatagactggtggcagtcttcaccttgaattcgtgtcaatgctcagggtaataaacctatagtagtcctaactcagtatatgctagttgagcatcaggcatgaattttctttccgtctggctgatcccagccctaaaggaagggtagacccgtgtcatttccagcctctaaaggaagggtagactccgtgtctttccagccgctaaaggaagggcagacccgtgtctttccatgcaccgagggccacgacgtcactatagcagggcacacgtggcttggtttaaaaaggtcatcttagatatatcttagtaaatgttaataaactattttgtttagatcttgaaatttataataaaaatactttacctactcctgatcaccaaaacctgatggtttaaagtgtgc

SEQ ID NO: 597973 - DNA, 353 bp, Homo sapiens
  misc_feature (353)..(353): n is a, c, g, or t
ccgccattgagatcccttggacgcctgatgaactaattggttccaagctgcgtgtaccaccaagctatggaggataggcacctcgaaacgtgacttcacactcaggaaccatcagagggtccggacatgaatcccccactgtactagctgtacgccattggcgccattggctccgcccccaaacttgcgtatggatgcattgcatgtcattgaaatcctcacagggacctgggaggggtataccaagccagacgttactgcttatagaaccacgacgactggttcgcacggcctgggtgagttctttgactgtgggccatgctgagatgagttcctgcgcttttctgggctgn

SEQ ID NO: 597974 - DNA, 362 bp, Homo sapiens
  misc_feature (20)..(20): n is a, c, g, or t
  misc_feature (36)..(37): n is a, c, g, or t
  misc_feature (57)..(57): n is a, c, g, or t
  misc_feature (62)..(62): n is a, c, g, or t
  misc_feature (64)..(64): n is a, c, g, or t
  misc_feature (250)..(250): n is a, c, g, or t
agagctggtggcatcttcanctggatacccactttnntagtctcaaatttaatatanttaanantagaacctctcctgctatcctaatccactcttcctcctgacttctgtatttctgttaatgaatcccaggctggagacctcagcgtcaccttgggcaacctcctgctcagaaacctttagcatcccctcaatgtgagcagaacacatgcccatgctccttatcttcatactcaaggccttccttgtngactcaaatgaggccgatttcctgacaaccctctaatccaggatttcttaacagtttaatggcttggactccatcaggagcctaatgaaacttatgggcacacattatggag

SEQ ID NO: 597975 - DNA, 132 bp, Homo sapiens
ggaaagcatggcccacaaggtccttaaggagaagagaagctgtttagtccgtccatggggagaaaggaaacaaataaatggcttacttcgatgaattattaacagacaaggggtgctgacacacaggagaga

SEQ ID NO: 597976 - DNA, 131 bp, Homo sapiens
cgggctacctagaggacccatttgagggctagtgtttaagctgtggtttataagcaaagctgtagtaaatgtaattattttagaaagatattatttgaaatcacttttgaagaattgcactatatgataat

SEQ ID NO: 597977 - DNA, 151 bp, Homo sapiens
tttgggagtgattggggggatggggtggaaaagggttagttggtattttcatggcctgattttttttgtttctattccttttaaatccctgtgtttgaatcgagggggaggggtggtaaccggaaataaagccctccgtttttccccccca

SEQ ID NO: 597978 - DNA, 1186 bp, Homo sapiens
gtgcgaagccggtggcgcgctttcttttacacgcgtgtggtcgttgctttttcgtggcaccccgcgggggcgccccctcttttgtgggatgcgttgctttgttcttgtttgtaagttcacctggatgtggttgtacagcacctcatgatgtggcggtgacacttcgtctgttggcacgtgtggcgattggctcctggggcttctatgggacccctcgcgttcgctcacgcggttttatttcgggcctctcgtgtcgggggcatccatcgtgttcgcgcctttcgtttagttatgccccgggtggggtgctgacttttgcgctgtattgggtccacgcacgcactctttgtgggttgaaccagggccacattcttttgcggtgtgagttctctccgcgctggtgtgcgccaaggttatttatcgcttgttgtggtggcgtttgtcgtgagagtatctttgtggacacgtgctggcaggtgccgcccccgggggggacccctctctgtgcgtgattccctcactgtcgcgctcgcgctctctggactgtgctcacaggctctgtccctgtgtccccctttgttatgtaggggttctcacaccgacgctgtgtttttggcaaaggtcactgtcccccacgaaatcttcatgcgcggtgggactattccccgtgtgttctctcatagaggaagagagggtctgctagatagagagtctccccttacgtatcactaccgcgcttcggacacatattggcacacaacgcgatgtttgtggcccggtaatcatgaatacaagggttcttgcactctgtgaagcacagatgggaataactcgcgagcgatctttgaataatgtcatataggtctaatcttgggtattatacaaaatatagaagactgagatatagtgcgagggcgatattaaagtgatattaccgcctctaagtgggatacacttttcacttatacataatctctcaaggtgtcttctagcagtcttggatcatgtaaaccgagagaaacgggggagttcctaggtgaatttaacagaacactggcgtctcagggcaaagtagttttttgttgtgacctcctttgatatatgtgttgatttttatggaccttaaattttcatgacattatcaagaaatactcttggtttttactccaaagaaaaaataaaaaat

SEQ ID NO: 597979 - DNA, 228 bp, Homo sapiens
cagcattttgggggtggcacccaaggattggaaaaagggggccccctttttttgcatggtgggccccggggcccttccgttggcttttccccaaaagacctttgcccgcttggggggttaacccccccctgtcaatgtttttttttttttgggggggggggggggcccctgttttttagccgcccccctgtcccccccccttaattaattccttgttccccccagcca

SEQ ID NO: 597980 - DNA, 491 bp, Homo sapiens
cactggacgatagtcgtcattactgtagctttactgtgtcttgaaattatataatatatagcctccagtttattcatttttatttattggttgagtcagagtctcgctcctgtgcctaggctggagtacaggggcacgatctcggttcactgcaacctccatctcctgggttcaagtgattctcctgcctcagcctcccaactagctggcactacagttgcacaccaccatgtctggctaatttttaaaaaaatatttttagtagagacagggtttcaccaacattggccaggccggtctcaaactcctggcttcaagtgatctatccaccttggactcccaaagtgccggggattacaggcgtgagccattgcacctatccctaatactgtttaaagagcacaaagtagtatcaggattacaaacattcttaatgttgttgcattctaaaatagtttcccacagaatattagtgcctactgggtggaaat

SEQ ID NO: 597981 - DNA, 650 bp, Homo sapiens
agtgtgcaggcaatcatttgctggattagaggaaaggtgccgcgtctgttgccatgagttctttaaaaactgcctatgaaagtgaaattagttcatcatgcttgcttccggtgtggcagccccctggcccgcagctgtgccaggcaccagtcctaagaggcatctatagactagtgcttatgtgggaccccaagcctcggcacagctccataccagctatcctgagctgcctcctgggggaccgtgctcttcagcttctaccagcaaggagggcagatacgggtgcgtgcgtggggcagaagacacacagacttctgagttcagggtctcccagatcttcactgggctctgacattcatggcctgtggcacctctgtgtgggcccgcttctgctgaggctccccatcctccaggccgcctgccagctccctggacaggagggccgcccgcacctgccgcagctcccgcttctccctgcgctcctccatctcctcgatgtcgccagcaaacagggctttcagtgggggaatcagcttgggcattgttggaaagtctccaaagcagaccttcatgtggtcacaggcaactcgcactttctcgctgaagttggggctgaagagggggaccttggcatagcgctggctgaagtg

SEQ ID NO: 597982 - DNA, 835 bp, Homo sapiens
  misc_feature (561)..(561): n is a, c, g, or t
  misc_feature (730)..(730): n is a, c, g, or t
  misc_feature (770)..(770): n is a, c, g, or t
  misc_feature (776)..(776): n is a, c, g, or t
  misc_feature (778)..(779): n is a, c, g, or t
  misc_feature (785)..(786): n is a, c, g, or t
  misc_feature (789)..(789): n is a, c, g, or t
  misc_feature (791)..(791): n is a, c, g, or t
ggcgagaagggcagaagggacaagagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaatggattgtggggtatatttggaagtgtgccagaatgtggtgaacggaagagtccttatgttgcagtatgctgtatagtaatggccttcagcatcctcttcatacagtagctggggaaaatgccagaatgtagttgccatcagatttgatgtgtgaacaaggactgactgcagaaaataatggaaaggatgtttaacctcttttatctccgaacattgaatgagataaatttccagatgctgttctctattttaatgttatgtggaccaatgttctgtataaacaattaagatgtaaccatttaatagtctgtaacaatcaacctcagtactgtcactacaatattacattctgcaaatgttattcctgtngtatcagatacaaaattttagtgaggtatctctaaggcacatagtagaaaacaaaattggttaattactcaagttcctttcactgtgattgggaatgatttaatctttatagaatgagaaccttttgggactagcttttattaaaatggtcattggtgtggaagggtgnttaaattaatagtggtggtttctctgggccacctttggtnttcacngnnacctannttngnaatcttttgcagtttactttacgagttgggtaagagaaaaaaga

SEQ ID NO: 597983 - DNA, 474 bp, Homo sapiens
gtgatacaggtgtgagccacgcagccggccgtaaatgtttaatatttgttgttgttgttgttgtgagatggagtcttgctctgtctccaggctgagtgcagtggtgcatcttggtcactggaaacttcaactggctggttgaagcaattcttctggctcaggctcccaagtagctggggctacagtcgtgtgccacatggccggctaattttttgtatttttaggtagagacggggtttcaccatgctgggcaggctggtttcaaactcctgaactcgtgatcctcccggctcgggctcccaaaggtgctggtattacaagttttgagccaacgcgcccagcccaagatgtttaaatgtgtaagcgagtttcagcttatgtttttttgccccctttttaaaaatttatgtcctcaatttttttcttacaaatttttatttttggcactttctccatcctgaagaacagcatggg

SEQ ID NO: 597984 - DNA, 145 bp, Homo sapiens
gacggcttcaacggaactttagacaggctgctgatagaggggctggtgtttgagagtgccgtctctaagaaggggtctatttcctaaaccccagggagggagaaaacaacaaccattgacagagctgggagagccacattccagg

SEQ ID NO: 597985 - DNA, 993 bp, Homo sapiens
  misc_feature (561)..(561): n is a, c, g, or t
  misc_feature (729)..(729): n is a, c, g, or t
  misc_feature (774)..(774): n is a, c, g, or t
  misc_feature (783)..(783): n is a, c, g, or t
  misc_feature (806)..(806): n is a, c, g, or t
  misc_feature (808)..(808): n is a, c, g, or t
  misc_feature (811)..(811): n is a, c, g, or t
  misc_feature (824)..(825): n is a, c, g, or t
  misc_feature (832)..(832): n is a, c, g, or t
  misc_feature (852)..(852): n is a, c, g, or t
  misc_feature (857)..(857): n is a, c, g, or t
  misc_feature (873)..(873): n is a, c, g, or t
  misc_feature (875)..(875): n is a, c, g, or t
  misc_feature (879)..(879): n is a, c, g, or t
  misc_feature (888)..(890): n is a, c, g, or t
  misc_feature (919)..(919): n is a, c, g, or t
  misc_feature (929)..(929): n is a, c, g, or t
  misc_feature (964)..(964): n is a, c, g, or t
ggcgagaagggcagaagggacaagagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaatggattgtggggtatatttggaagtgtgccagaatgtggtgaacggaagagtccttatgttgcagtatgctgtatagtaatggccttcagcatcctcttcatacagtagctggggaaaatgccagaatgtagttgccatcagatttgatgtgtgaacaaggactgactgcagaaaataatggaaaggatgtttaacctcttttatctccgaacattgaatgagataaatttccagatgctgttctctattttaatgttatgtggaccaatgttctgtataaacaattaagatgtaaccatttaatagtctgtaacaatcaacctcagtactgtcactacaatattacattctgcaaatgttattcctgtngtatcagatacaaaattttagtgaggtatctctaaggcacatagtagaaaacaaaattggttaattactcaagttcctttcactgtgattgggaatgatttaatctttatagaatgagaaccttttgggactagcttttattaaaatggtcattggtgttgataaggnttgcatttatatttaatagtgcttgcttttcctctgggcacaccnttttgatcntaaacagagtacctctactcttngnaanctctagtttatgnnaagtatntaaaatatttaaaacaagcntatgnagttcttaaggacgangntatntgagatgtnnnttaaaaatagtatttgggaaaatgttganagttaacatnagtggattaagactagccaatgacaaagtaggctntgaaacatcttttaagtatattttttttg

SEQ ID NO: 597986 - DNA, 899 bp, Homo sapiens
  misc_feature (625)..(625): n is a, c, g, or t
  misc_feature (794)..(794): n is a, c, g, or t
  misc_feature (834)..(834): n is a, c, g, or t
  misc_feature (840)..(840): n is a, c, g, or t
  misc_feature (842)..(843): n is a, c, g, or t
  misc_feature (849)..(850): n is a, c, g, or t
  misc_feature (853)..(853): n is a, c, g, or t
  misc_feature (855)..(855): n is a, c, g, or t
ggcgagaagggcagaagggacaagagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaacgtgggtatgctactaatgatgtctaatcacccaaattagttcttacagatgtccaatatcgtctggattgtggggtatatttggaagtgtgccagaatgtggtgaacggaagagtccttatgttgcagtatgctgtatagtaatggccttcagcatcctcttcatacagtagctggggaaaatgccagaatgtagttgccatcagatttgatgtgtgaacaaggactgactgcagaaaataatggaaaggatgtttaacctcttttatctccgaacattgaatgagataaatttccagatgctgttctctattttaatgttatgtggaccaatgttctgtataaacaattaagatgtaaccatttaatagtctgtaacaatcaacctcagtactgtcactacaatattacattctgcaaatgttattcctgtngtatcagatacaaaattttagtgaggtatctctaaggcacatagtagaaaacaaaattggttaattactcaagttcctttcactgtgattgggaatgatttaatctttatagaatgagaaccttttgggactagcttttattaaaatggtcattggtgtggaagggtgnttaaattaatagtggtggtttctctgggccacctttggtnttcacngnnacctannttngnaatcttttgcagtttactttacgagttgggtaagagaaaaaaga

SEQ ID NO: 597987 - DNA, 215 bp, Homo sapiens
ctgcctatgaggggggggggataactgtgcgctttcgaagaatatcataacatatgctcgttctgtggctgtcaatgttataattaaggagattcgtagggagattagtatacagaggtagagtttccttcgtgatattggttcactggataagtggcgtttgcttgccatgattgtaaggggtaggattcccgtagttagtattaggagggggg

SEQ ID NO: 597988 - DNA, 394 bp, Homo sapiens
  misc_feature (228)..(228): n is a, c, g, or t
gggcacaggcccccacgtccgggccccctgcgacaacttccatcattccagagaaaagccactttaaaaacagctgaagtgaccttagcagaccagagattttatttttttaaagagaaatcagtttacctgtttttaaaaaaattaaatctagttcaccttgctcacctgcggtgacagggacagctcaggctcttggtgactgtgcagcgggagttcccgccctcnacacccggggcccagacccttcggggcccttgcctttgttgggcctgtttccggccttgggccttcaagttggccgcccgaacaagaactggcttccttggtccttaaaaaaacttcctttcctgaagccaacacacccacccggggtgtcctggggacccaaggg

SEQ ID NO: 597989 - DNA, 93 bp, Homo sapiens
acggccgtgtattactgtactgcccgagggtgggagctcccgcgacggtacttcgatctctggggccgtggcaccctggtcactgtctctcct

SEQ ID NO: 597990 - DNA, 940 bp, Homo sapiens
tgggaggccaaggcgggcagatcaggaggtcaggagttcgagagcatccgtggccaacatggtgaaaccccgtctctactaaaatatatagaaatgagctgggtgtggtggcaggagcgctgtaatccacgagcgtacacgaggaggctgaggcacgaagaatcacttgaagtcaggagatggaggtttcagtgatgccaagatcagatgagtgcactccgagtctgggaacagagtgagactcctatcgtcaagaaggtatagaacttattgctgaaggaaggggtcgtccttgtgaaatggggggaagaaaattgtttaattttggaggctggaggggtctggtgatgttacgatattagaggcggtggctcagagaggtaggtacaagtagtaaggcggtaagtttgaatgcctaatgactatgcttttagggggggggaagaaaaaatggtaccatatctcgagcgggggaatctaaatagcagactgagtggttaaggggaatggtgagtccaagtaagatagtttaacccaatttgttgggggttgaagcaagaaattggttgtgggagaggaaggggcttcgacggagtacccatttagatactgttaactattaactttgacctcaataaggtttttgggtagggggtaacgctggagatggcatagtgtggtggagcagggggggtaactgtgcaagtgtgcgcacgacaattacatttcggaaagggacactcttcccacaggttcttccacgtcgagcagatgcttgggattggcccctgacaatttaacgttttaattaccctcggccatggtggttgcggcaaggaagtgggttttttagagccgcgaaaaaaagttaattgggggagcaagggttggggcgccagaataacggggcagggagatagggggacacgacaattataag

SEQ ID NO: 597991 - DNA, 192 bp, Homo sapiens
  misc_feature (11)..(11): n is a, c, g, or t
  misc_feature (142)..(142): n is a, c, g, or t
  misc_feature (148)..(148): n is a, c, g, or t
  misc_feature (163)..(163): n is a, c, g, or t
cccgggctgcnggaattcggcacgagtggtcatataactgcacagctgaagatgaaaggggaaaataaaggaaatgaaccattaaaaatggatctacagccatatattctgccgttactcaaaggcttaatatatggctgtngatccntttttaatggttcanttcctttatggtcatataactgcacagct

SEQ ID NO: 597992 - DNA, 363 bp, Homo sapiens
  misc_feature (106)..(106): n is a, c, g, or t
gcactgactgcttccgacctgcatgaggcgtaggagcggccctgcgcgttgtcagcggcagctgctgctgtagtagatttgtctccactcagtgacgtgggatttntctgtcttccttttggctttgttttaaactgctttagatattactgctagcgttgtgacttcctagttcctatgttgttagtgagccagcaccagtgggacctactagaaaaaggaactggcatgcacacgtgcccagcaggaaaagcttcgtcttcacgtcggctgctgcatccagaagaggcctggagctcacgccgtcgacgtgctctcaggcgttctgttccgggcgaggcttgtgctgcaaggaagggcaca

SEQ ID NO: 597993 - DNA, 269 bp, Homo sapiens
  misc_feature (44)..(45): n is a, c, g, or t
atcagctcggtacctccgtacgtggcttcaagctatcctcctgnncctcagcctggtgacagagcgagactctgtctcaaaaaaaaaaaaaaaaaaagattattcatacccgggaaatgcaattggggaaaatatcccaggtggtgtatttacttctatcacacaatttcagctgcccccctaagggtcttcaaaaaatttatcttttgtggactatcccaaaatgattcttacccatttcccaaattggtttctctgagttgaaccca

SEQ ID NO: 597994 - DNA, 638 bp, Homo sapiens
atctgttcccttccccataaacttctagaggctaggaatccctaactttctggaaatgcagcgcagcaagtcccagcctcattttcctagccctcactcaagatggagttgctctggtctgaatgcctctgacagctgctttggaggcctgtcacatttgtgcatccccgtggagggctaatagaagggcccgtgtggaagagctgtggagaaacccctgcctgaagctcctgccctgggcggggaggtgtagcgtgctgcccgcctgcggttggtgaggtcatcgaaacctcctcagttagcgttcagcaacttctccttttcaggtgcctgcaactggtatttacaaaagctaaacacccttcatcaccaaggctaccatttaccacatgactgtcagaagagaaaaatataaataatcctctcaaaattgaagtgacaaatatgcagacaattccaggccaggccctggaaaatgtattggacagacactaggctggcaagggtgacattgtctataaagaccttgcattttccacttgagcccaggagtccagggctgcagtgagctatgatcgcaccactgcactccagcctgggcaagagagtgagaccctgttgcaaaaaataaagaaaag

SEQ ID NO: 597995 - DNA, 166 bp, Homo sapiens
tgaacaggaggagtgcaggatggtggcgcacccaacaaggacccaacgccgggaagaggcagaggatgctgcgaatagagaagcctccttgccccttgacatcagatgtttcttcgctctacaagagtcgactgtcatacgtcacggacgtgccatgacggtggag

SEQ ID NO: 597996 - DNA, 119 bp, Homo sapiens
cccaactatatgtgtaccaccacacttggcttgataggttttttaaaatgcctgtgttaacgagaactgttttagtgtgtcagtttgaggttttaacatggatgacatctgtagaactt

SEQ ID NO: 597997 - DNA, 297 bp, Homo sapiens
accgcgtggatcttgtgctgggcatgggggcaggcgcctgtaagcccagttacttgggaggctgaagcaggagaatcacttgaacccagaaggaggaggttgcagtgagccgagaccgcgccactgcactctttccccgggcgacaatgtgagactctgtctcaaaaaaaaaaaaaaaaaaaaaaaatttcccttttaaggaaacaccttttacggggtactttttttggaaagggcgggcctttaaacacattactccattagccggggcggccaaaagaagcgcccaataaacgg

SEQ ID NO: 597998 - DNA, 392 bp, Homo sapiens
gacgaacagcctcagtcaggtctttcgtgaggtattccagaagaaggcattgtcatcataggagatgagagctccatgcatgttactgccccaaagaccctccagtgagacaagatgtagaggtggaaggcagtgatattcattatcttgaccctggataggcctagcctaatgtgtgtgtttgtgtctcactttttaacaaaatttaaaaattgaaaaaatgaaatttgaaactagaataaggtttatagatcaggcacagtgtaatcccagcactttggtcaaggtgggaggattgcttgagtccaggagtttgagaccagctcgggcaacatagggagaccttgtctctacaaaaaataaaaaagttagccaggggtgtggtggtacac

SEQ ID NO: 597999 - DNA, 176 bp, Homo sapiens
cctacctctttctggtccacgccagcttgtcgttgtggcggcgcctagttttctcagtctactcgtgtgatgctgagaggcaagagaatggcgtgaacccgggaggtggagtttgcagtgagccgagattgcaccactgcactccagcctgggcgaggagagtgagactctatctc

SEQ ID NO: 598000 - DNA, 395 bp, Homo sapiens
ggttgggttttttaccccgttccccccgaggagaagtctcagtggggccatccaaaaactggaaaaagaaaacgggtggccggagatttcccctacggatgggaccaagaaactgatgagaacggccaagtgttttttgttgaggcagaaaaaaaaatgctggcgtatgctgccttctctttttgcttcggctccctaaaagggaagggccctttttcctgtaatcccgtggcttgcttccccttgtcaatcccttagaagattccccctccttcccctgcccccttgttttgtatgcgataaatatcagggggcccacccgttgggggcccctcccggtttccccattttgggggtaggggccccccccctgggcccagctgttttttccttta

SEQ ID NO: 598001 - DNA, 114 bp, Homo sapiens
tacgatgaggactcaacgtctggttttcactgagccccacagcagtgggggagaagcaagggttgggccagtgtccctttccccagtgacacctcagccttggcagccctgatg

SEQ ID NO: 598002 - DNA, 1040 bp, Homo sapiens
gagaagggagaggggaaagaaaggaagaaaggaatgagagaaagggaaagggatagaaaggaagaaaggaactgaaagaaagggaaagagggaaggaaagaaagaaacgagaaagaaagagaacggaacggaaacgaggaaggaaaaggaaggaaggaaggaaatattttgtagacgcagtgatatggttttgctgtgtccccacccaaatctcaaattgcagctcccaagaattcccacgtgtcatgggacttacccagtgggaggtaactgaatcacagggcaggtctttcccttgctgttcacacaatagtgaagacgtctcatgagatcagatggttttataaaggggactttccccttttctcttgcttgccaccatggaagacatgactttgctcctcctttgccttccgccatgattgcgaggtctcctcagccatgtggaactgtgagtccgttaaacctctttcctttatcttttacccagtctcgggctgggcgcggtgactcatgcctgtcatcccagcactttgagaggccgaggcaggaggatcacctgaggtccgggagtacaagaccagcctgcccaacgtggagaaaccctgtctgtactaaaaaatactaaactagcagggcgtgctggcacgtggctggtaatcccagctactcggggaggctgaggcagaagaatcgatgaacccggaagacggaggttgcagtgagccgagaaggaaccaaggcaaaccaggccgggtgacacagaagccaaagccacaacgcaacaatcaaacagacaagcaaagaaccaaacacaggaaaggaataaattaaaacgcacgttgaaacaaattataataaccggaatattgtatgttgcccgaagagagacaaaacttgagataaataatgatccccacaaacaccacagagggaatagagtgaaccagaccagcacaataagaagaacagcaaataacaacacatcaaatcataatatgagaaaaaaaatacagaataataaatcaaacaaggcagga

SEQ ID NO: 598003 - DNA, 328 bp, Homo sapiens
acatctgacatctatctctatctctgcttcgtgggcctcactgggggctgaggctgatccaagttatatactctgtaaaccagccacagctctaaaatacgcctaagcattgcttccgacaacggtttcgtagactgcattacgccctctatacctattgccagaatctatggtagtgttcattctcgtaccaataaccttgaaatgcttgatgtgctcttcaagccctgggtagcactgtggtttgaatcacttcctcttatcagccccgcataagccaagtatcatgtgcttggctacagcagatgctgcgtatcctctatagtct

SEQ ID NO: 598004 - DNA, 188 bp, Homo sapiens
  misc_feature (116)..(116): n is a, c, g, or t
  misc_feature (120)..(120): n is a, c, g, or t
tgataggataggtgtataacataggtttctcgtgtgatgagggtttatgtttgtaatgtggtgcgtgagtgagcccattgtgttgtggtaactatgtagagggggagtactaaggngccntgtgactagtatgttgagtcctgtaagtaggagagtgatatctgatcaggagaaacgtgctactagca

SEQ ID NO: 598005 - DNA, 266 bp, Homo sapiens
  misc_feature (10)..(10): n is a, c, g, or t
  misc_feature (12)..(13): n is a, c, g, or t
  misc_feature (20)..(20): n is a, c, g, or t
tccagtctgngnnaatggtngatctccactcaccacaacctccgcctcctgggttcaagcgattctcccgcctcagccccccgagcagctgggactacgagcaggcgccactactaattttgtattttcagtagggacgggttcccccacgttggccaggctgaggcagaagaatcgcttgaacccgggaggcggaggctgcagtgagccgagatcgcaccactgcactccagcctgggcaacagagcaagactacatcacaaaaa

SEQ ID NO: 598006 - DNA, 141 bp, Homo sapiens
  misc_feature (17)..(17): n is a, c, g, or t
  misc_feature (38)..(38): n is a, c, g, or t
  misc_feature (99)..(99): n is a, c, g, or t
  misc_feature (141)..(141): n is a, c, g, or t
ttttataaatggaaggnaaaccctaaggagagtctggntttatggtttagctttattttttatatatggtccttcttgagaatctgatgaggagacatnctgctggctctttcagatgtgcctgcctgtgtacacacttan

SEQ ID NO: 598007 - DNA, 858 bp, Homo sapiens
  misc_feature (15)..(15): n is a, c, g, or t
ccatgagcaaaatanaatatgaacctaaatagaatgggctcaaacagtcataataaactcctttggttattttcagaaaatctatattcacaggtggcctgtgttaataggtgaattcattgtattttggtgtggctatttgtataacaaaacatgactaaatatgaaagatgtgtatgtctttttctttaccagatcttgcgccagtttttaagcaagcaaattatgttcatgtagtaaaattttaatctgtattgggaatagaggtgggaatagtagtattctgtttactgtggatttggagtaaaatctagaaatgctacttaatcagcatattgtaagcagaaattactttttgtcttttttacaaaaaatggacatgagagctcactccgttgcccaggctggtctcaaactcctgggctcaagcgaccctcccacgttagccttccgagcagctgagaacagaggcacgtgcaattgtgcccagctttagaaatcactttttattttaattcttatttgtaacatttcataaggtattaggctacttttcccagtcactaccgtttatacaatttagttttaatttcttaaaattttatttgaaattgtagaatgtcttaatcattcagaatgtgaattgtcatggaggtgtcagagatgcaatttaatttctcctgatagcagtatatcttgaaaatattttgcttaaagatttatttatccttgctgtcaatttgtttcttataatttgcctcatagaaacattcattcaaaacagagtgctgaaaccaaaatggaatatacaattaaaaccaaataatttttttcctgctaactacttcccagccccca

SEQ ID NO: 598008 - DNA, 377 bp, Homo sapiens
gacagagtggatgcacagtctaattgtagcgatatgtatatgaactctacaagctatccctagcggcccgcatacagtggtcgagagactatatactccattgcatccctgctgatccataacgtcacccagaatgacacaggattctataccctacaagtcataaagtccgatcttgtgcctgaagaagctgcccgatcagtcccctgtatgcccggagctgtccgagccctccgtctccagcgtcaaggtcccacccctctgttgtgactccggcagtgctttggccttcacctgtgaacctgaggttcagaacacgacctagcttttcgtgggtctatccgctgagcctcccggtcagtccctcgctgcagctg

SEQ ID NO: 598009 - DNA, 174 bp, Homo sapiens
gtacacgacagcatgctatcacctcccctgttggacttgggagaggactgggccattctcctcagagagaagggggtgccttttaggatggcatgggacttcctgtaacaacgcatctcatatttggaatgactattaaaaaaacaccaatgtgcaatcaaagtcctcggccta

SEQ ID NO: 598010 - DNA, 217 bp, Homo sapiens
  misc_feature (110)..(110): n is a, c, g, or t
  misc_feature (158)..(158): n is a, c, g, or t
  misc_feature (167)..(167): n is a, c, g, or t
  misc_feature (187)..(187): n is a, c, g, or t
tagcaatgtattaattttgtacggccttgcaattttggtcttttgttatattttataatacacatattagtaccactctactgtttcaagttaatctagtaatagagctncatatatttgtataactgctataccactgaactgaatttattttacancagtgtagnttcttgaaagttaacgtganaatatccaaaagcagttttctagaagtgtc

SEQ ID NO: 598011 - DNA, 243 bp, Homo sapiens
aggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagaacaacccaagggaaaaagaaaagaaagaaaaacatgtggaaccagcaaagtcaccaaagaaagaacactcagttccaagtgacaaacaagtaaaagca

SEQ ID NO: 598012 - DNA, 236 bp, Homo sapiens
taatggctgttacaaatggctgtactaaatggctgtactaaatggtgttacctaaatggctgtacctaaatggatgtacctaaatgagtgtacctaaatggctgttacctaaatggatgttacctaaatggctgttacctaaatggctgttacctaaatggctgttacctaaatggctgtaacctacttggctgtacctaaatggctggtacctaaatggcaactcgtgatcgcca

SEQ ID NO: 598013 - DNA, 218 bp, Homo sapiens
  misc_feature (79)..(79): n is a, c, g, or t
tgaccttacctggtcgggtgtaataggaatagtgttaccagtggactgccagccaggtgaagaaaggatcagtgtatanccaggacagcaagaatggatactgatgtatggaggtaaagctgtgaaagtaggagagcatcgggattgagtatgcagagtgagttacgggttgagtggtccgtgaactaagaaccactatgaccatgcctgcacctgac

SEQ ID NO: 598014 - DNA, 104 bp, Homo sapiens
aaaaaaatgtttagggttttttcgttttaaattttagattttattttagggctttgtaattaattggggtttaaattgataaaaatgtggaagttaacccccca

SEQ ID NO: 598015 - DNA, 289 bp, Homo sapiens
cgacatccccaggtgataacaggaccctgctcctcttgctacagcccgtttgggagcacccccacccaggcacgccacgccagccaggctcgcctctgaccagatagctagaaggagcaggtagagcaggaagtggagagccagtgacccaggttaccccaggtagcagccttggttaggggtcaatccagtactactccaatactatccagtacagagtggcacatctatgaggtcacggccaggtgcggggcggggtatcttgcggactgccctcctgggctaacgc

SEQ ID NO: 598016 - DNA, 405 bp, Homo sapiens
acaggttaaggcgcgtactgcgtattaggcgcgtactgcgtattagtgcgcgttctgcgtattaggcgcgtatctgcgtattaggcgcgtactagcgtataaggcgcgtactgcgtattaagcgcgtactgcgtggtcaccaaccgatacgaccagttctatgacgacgaatcggacccctacgaggatgctgaaggcagcagagaacaagaaaaaagaagccggcgatgggcggcgttgggggacctggggccaagagcgcagttcaggccgcgaaccaaatcaactccaacgcggaagtgcaaacagttgcgcaaggagtcccaagaaagactgcaagaccccgttgacccccagcgtaggagtgtttgacaagaaagacggcgacgccagacgaccgatggg

SEQ ID NO: 598017 - DNA, 772 bp, Homo sapiens
gcttttttttttttctcttgggcaaaatggcggagtacgacttgactactcgcatcgcgcacttttgggatcggcatctagtcttcccgcttcttgaattctctctgtaaaggagatatataatgaaaaggaatttttacaaggtaaattgggaccttcttagtgatcccaacatggtagactttgctatggttgtttacaaaacacctttatctctgatgatatcctcatgcttgtgagagagaaaagacccacaggtggttgcacacctgaaacagcttcaggcagaaacagacaccaaatgtgtgaagcatgctttgaagactccagaaactacaaggcaatatgcagtcacccagggatggtaggatgctctttgactacctggcggacaagctatggtttaaggcaggatattatttagatacatctctacagattatgcaaaatcccagtacgatttgtgggaattactcaggagcagcagaatatcttattttctagagtgctggtcccagcaaccagatagaattgctttacagtgcacccctgggggaaacgcgtgccctctgaaattcttatgcagacatgggcgatgccgtcctggaagcccttacacggttaacacgagcccctggatactatttctgcgagttcccccctccgtctccttcgcaggagaactgctctccacggtctcctgttgtttcttcaatccccaagtcgcgtaattttggcctcttttcggcccatttttgctccactgttccct

SEQ ID NO: 598018 - DNA, 91 bp, Homo sapiens
  misc_feature (37)..(37): n is a, c, g, or t
  misc_feature (81)..(81): n is a, c, g, or t
attcggaacgaggaaggacttaaaagtggaaacgtgnatttcaaatatgggagagataaaaagaatttgaaagagttagtngagtatagaa

SEQ ID NO: 598019 - DNA, 807 bp, Homo sapiens
  misc_feature (512)..(512): n is a, c, g, or t
  misc_feature (523)..(523): n is a, c, g, or t
  misc_feature (526)..(526): n is a, c, g, or t
  misc_feature (539)..(539): n is a, c, g, or t
  misc_feature (555)..(555): n is a, c, g, or t
  misc_feature (618)..(618): n is a, c, g, or t
  misc_feature (632)..(632): n is a, c, g, or t
  misc_feature (640)..(640): n is a, c, g, or t
  misc_feature (777)..(777): n is a, c, g, or t
cggtacgcttagtgttggcattgtcaaactccgaatatattgtagcctagtaaattgaggtagaaatcatgcacttgtcacatctaagactttgtataccgtccacgactaccatacactcccctcatcactaatcgatatctcatcaaacagctgctgcaacgagcaactatacatgtcatatctagtacctagaataaatcaacccattagagcggtacacattttagtttttattccggcttaaactcacgtggtccgatcttagatcatcttcaacctctgcacaccaagcaatcttcatctttacctcctatgttgctgccgcaccagatgcaatatccaaagggtcctgtagtccctcattcatttgaacctccccgcaaaatacacaccaagctttaaccagtgggccttaccctgtaaatccagtctaagcaaacagtggatctttggaatccagcatgacactagcaataactacacaaggttgcatcaggtacaattccagngtcaaatccantcnagtcctgccctgnaagtctgagaaagggntgaagcttgttcaagttgcctttacagcaaagggactgaaggatgagatgtcaaaggcgtggnactggaaaaaaagnagaagagntggttaacactggaattgaaggcaatctggtggtggcatctgtcactcactcactgccagggtcaattcatctgatagccaagtgaggttgtaacatgcacctactgaaacacaccagtactgagaaaagaagactnaggattaattggcttcacctagaccaatta

SEQ ID NO: 598020 - DNA, 256 bp, Homo sapiens
gaaagtccctgatgcaggtcagctcattgaggcagatgccttgctgggctgggggttttccaagcccttagctggtcctgataggatggtgcaagctcttcctttgctcatgagctcctgattagtggcatttgagcagctgattaacctgcacatgcttgctgtattactcctgtccacagcctttcctactgtattgaccttgagtggagaggtctgccttgtattaatgaggtagctatagtcgcagcccaag

SEQ ID NO: 598021 - DNA, 377 bp, Homo sapiens
  misc_feature (204)..(204): n is a, c, g, or t
  misc_feature (214)..(214): n is a, c, g, or t
  misc_feature (222)..(222): n is a, c, g, or t
  misc_feature (228)..(228): n is a, c, g, or t
  misc_feature (232)..(232): n is a, c, g, or t
  misc_feature (236)..(236): n is a, c, g, or t
  misc_feature (256)..(256): n is a, c, g, or t
  misc_feature (297)..(297): n is a, c, g, or t
  misc_feature (362)..(362): n is a, c, g, or t
gctcccatggttctgtgacagagatcatgctctgcactccggcctggggacagacagtacttggggaggcaagcacaggaaaatcccttgcaggtgcaggatgttcaaggccagcctgggcaacatagcaaggcccatctctgtaatcccagctactcaagaggctgaggcaggagaatcgcttgaacctgggaggcagaggcngcagtgagcngagatcgnaccacngcantccngcctgggtacagagtgagantctgcctcaacaacaacaataaaaaactttgcagtccccanaaaaaccatgaagccctgagagtatgaaaagcttcctgacattgaggtcactgtggaagatcagnggatcagagatctct

SEQ ID NO: 598022 - DNA, 171 bp, Homo sapiens
  misc_feature (91)..(91): n is a, c, g, or t
agatgaggatggtgcatagattttctttctggcctggtctgggggtggtgccatcccttctgctcacattttctcaccgtgacctgagtcnctggtcagacctgcagcaagtggggtgggaaatgtaatctgactgtgtgcctcgcaggaagaggagaatgtggatttggt

SEQ ID NO: 598023 - DNA, 269 bp, Homo sapiens
ctcattcagcatgcatagaaggtgtcggtgtccaggatccacttgcagtgaaccttcctatggttctcaggagtaggggcagtcttaccacagatggctcaagagcactcgctgggatccacgtgtcatatgtgtcaggagactagtccccagggctaccaagaatctgcttatccctcaacaagagtggtcgtccccatgcctcttctatcatatgacttcccgcagtgacaggatacacaacattgggaggcattgtcctaatcctc

SEQ ID NO: 598024 - DNA, 895 bp, Homo sapiens
aaataaatcttgatgcgtttcaattcagctttcctcccaatgtcagaatcttcaccattacattatccacattcttcgagcacccagatagcaacaggtagctcattactctgagggcagtcttctgttccattgtgacataactctagatgataaaaatgttaatcttcatcaagaaatgacttttacttcctaaaataccaagtaagtttattcccctcctataagacaactagcatatattttcacatttctgctgtctgtgtttaagttcaatcaaccccttatcactagctttattcttatttaaaccattcatgagagcatgtaagtgttaaacaatgatgagatattttcaggcttataaaataatgaaatataaaattaattatctacatagataaatagaaattgatgaaaatttctatgtatattattttcagtaactgttaatgtcttcctataacagcaataaatttaaattcaacatatttttaaatttatttcagatatgaagatattatataaaactctacaaagtaatatgaatttaaaaaaactagcagcaaaccatattaaccatattgtgtgttttagagtaaagctataacaaaagtacaggggattaagtgtatgattttaatagctgcttttactctggggtggttatagcaatggcgccttagggcaaccccgttcacatacacagtatccagctggggtggttactacctagggaagctgtgaactttaaatggcaggacagggatacagatgtaaaatggtaattgactatgcttgaaataattggaacttattgcacatattggctatgaattaattcaaggtcatactaaataaggatttaatgtatgaataatgataatatggggag

SEQ ID NO: 598025 - DNA, 110 bp, Homo sapiens
tcgcgatgaacggtacggtggcgctgtcatcatgcagttccatcggcgaggctgatctgggaggcgcgggcgccaagctcggtggcgagctgggccacgatacgggcatt

SEQ ID NO: 598026 - DNA, 223 bp, Homo sapiens
gagcgatcagaggacacaggaagtgagtgatgaccagatacacgagatgacttaaaacttaatgatctcgggaatatctttgacctgtcggtctgtagtttccaagttcgagtatgctgagcagaatcaccatggtgttgctgatgcaaatgtcgaggatgcctcctttgctgctgttcttgtttgaacttctacccagcatggaggaacagtcgctgaaaag

SEQ ID NO: 598027 - DNA, 92 bp, Homo sapiens
tgcgctgttctatttctccttcggccgccgccgccactgctgcacacagctggtgtcggtgccgcgcttttacccccttctgtcgtcttctc

SEQ ID NO: 598028 - DNA, 610 bp, Homo sapiens
gcattcctttcgctccgcaccctcaacctcggaagattatcgtggccgactcgtcctttgtaggcgaacaccacccgccggcggtgctatgtggtagattagaaaagatagcttcgcccccccctacatgccccccccgccagggaaaaaagatgtctttgaaagacgtcccccttcgcctagaaattctgatataaacatgggtggagggaacactccgcgcgagagtgtgctatattgtaggagaacataaattttagtgatcaaaggaatgaatctagtgtactttacaccacacctgtatattccacaagaacaaagagggctcgtggtgcaacaatatacctcgcggcgtacacataagagtgcacccctgcggtgttctatatatcaaagtccacatcttcaattttcgttcccggcgagctggttgtgtgggttacaccgcgccccgcgctgattactcccgcgcccacttgtgaggcgagcagggtacgcacacgagtcgttttttttttagtcacccacggggttgtgtggcagcccgccgcgcggggggtcaccgacccgctaaatctcccctctgtcccaacaatagatacaagaaatc

SEQ ID NO: 598029 - DNA, 262 bp, Homo sapiens
agagaagaaaaaagaagaggggaggggaagaagaaacccggaaaaaggagaaggaagaagaagaagaaaagaaggggaagaagaaagaggaaaaaagagaaaagaaaagaagaaagggaagaagaaagaaaaaaaagaagaaaaggggaagaaaagaaaaaaaaaaggggaagaagaaaagaaaaaaaaagaagaaagaggaagaagaaaggggggggaaagaagaaagaaagaggaaagaagaaagaagaagaagagaaga

SEQ ID NO: 598030 - DNA, 107 bp, Homo sapiens
  misc_feature (39)..(39): n is a, c, g, or t
cccgctcccgctggcaggtccacatccagttcctgatcngcaccattctgagcagcttcccaaactactagcttgtcccacacacatctgtagatgtagaatctgaa

SEQ ID NO: 598031 - DNA, 471 bp, Homo sapiens
ctttttggggtctttgctcatctagtcctgatttgcaagacagagaaactgccatgtaagtagatactccagctgaacaatttcttcagccttctacattctctacaatgtcagctcagtctcattcgacatcattttccaaaggaaggccttaattcaactctttggctattttctcaagacagtgaacaaagccagcctgtggaggcatctggccaccacacacatgatcagtttggtgaggataagtatgctgtggttcatctaatgatttttgatagtgaaaatttctttactggctattttgaaaggtactaaatcacatcaacttcttgttggaataaatgatcaaaatgacatgtaatatatggttatgtaacttaaacacaaaaataattatgtcttacttgcatgaattttaacaattagcaggaatcttcaatttatataaaacaattgttttaaaagcaa

SEQ ID NO: 598032 - DNA, 334 bp, Homo sapiens
  misc_feature (91)..(91): n is a, c, g, or t
  misc_feature (136)..(136): n is a, c, g, or t
agattcttatacaaagtgtggcaaatataaaacttgcttgaaaatatggaaattaaatttttaagagagttaatagtacccctcccttaangggctttttttatttttactttttattttttatatacttagcccngctctgtctcccaggctggagtacagtggtgtgatcttggctcactgcaagctccgccttccaggttcacgccattctcccgcctcagcctcccgagtagctgggactacaggcgcccgctaccgcacccgtctaatttttttgtatttttggtagggacgggatttcaccatgttggccaggatggtctcaatctcc

SEQ ID NO: 598033 - DNA, 284 bp, Homo sapiens
  misc_feature (14)..(14): n is a, c, g, or t
  misc_feature (22)..(22): n is a, c, g, or t
  misc_feature (142)..(142): n is a, c, g, or t
  misc_feature (205)..(205): n is a, c, g, or t
taaagagtacacgnctcagcanagtggctcccacttataatcacagcattttcagaggccaaggagggaggatcacttgaggccaggagttccagatcagcctgggtaacatagtgaggctctacctctgccacccagctantatatatattagctggcatgcacctgtaatcccagctatttgagaagctgagatggaggatcncttgaacccaagagttcgaggctgcagtgagctatgattgccccagcctgggcaacagagggagacgctgtccccactc

SEQ ID NO: 598034 - DNA, 115 bp, Homo sapiens
tgccagaaatacaacggcgacaagatgatctgccgcaaggtgctatgctcgccttcaccctcgtgctgtcaacggccgcaaggaagaagtgtggtcacaccagcaacctgcgtcc

SEQ ID NO: 598035 - DNA, 206 bp, Homo sapiens
cagctgaatagtagtctgcgtccctgtacgcataatgtgaggaggtggagagaccagcccacccccgtgtacactgtgacccctgttcccatgctagacctagtagtatactaccccagtcatctttcctgttccagagagatggggctggatgtctccatactctgtctcaactttatgtgcactgagctgcaacttcttgagtt

SEQ ID NO: 598036 - DNA, 137 bp, Homo sapiens
tcgatgaaggatatctggttccgcgctaggtatcctgctctctcagggtgtgcccggggttcttctctagggggccccggtgacaaaccaagccgccccccctcgaaagggcaaactatatgttcagaataaaaaga

SEQ ID NO: 598037 - DNA, 190 bp, Homo sapiens
ggtcgatctagaggtcccgaagcacagaggagggagagagagagagagagagagagagagacagacagagagacagagacagacacagagagacggagagacagagagagagagagagaaagagacaggagaaagaagaactccgggtgggtcccattcctttaaaaggtcgcctcctctgtgctgtcca

SEQ ID NO: 598038 - DNA, 146 bp, Homo sapiens
acgcaacgatttttcctaaagatacactaaaatgaaaatctctaagagaaagatgtcttcttcaggacgtgaaaggggtactatatggggtataacagaactcgtatgtacgctgcgctgtgaccttatgtggacgattctgcctg

SEQ ID NO: 598039 - DNA, 268 bp, Homo sapiens
gtagtagctgtatttaaaaaaaaaaaaaaaaaaaggtttgaacaattatagaatcccattacccagagatagaggggagtggtgaataaaactttctgggtgaattcttccagatatctctctatgcatatgtatacacaagcaattttgggaagaaaagatactttataagggataacgcctgaaaaccggcaaggattggcaatggtgggagaatggaagggcaatgatggtgggcagaagaaggggccaccacaattctgggtgg

SEQ ID NO: 598040 - DNA, 229 bp, Homo sapiens
cataagcatgtgaatacagcagtgagcaaaacaaagttcattgccttccttcacgggcttatatttagtggggatagggagaagacagtcaacaaataggtcgaatttatagatcgtcagaagatgtttagttttatggaataaatatttgccattcaagggacgggaagggctgggttggattgttttaagtggggccattcagagaatggcctcagtgagtctgaca

SEQ ID NO: 598041 - DNA, 514 bp, Homo sapiens
ttccgaggactttaccaaattaacctaaataaaggcaccggattgcttgagtaggacaacatggagccttcctgtggcaggagaagaaacaaagcgctattatactaaggtcaagagaagtgtcagcctcacctgatatatattaataatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttcccagaagcctgttacaagcaaggtctccccacaagcaacttctctgccacatcgccaccccgtgccttttgatctatgcacagacccttcacccctcacctcgatgcagccagtagcttggatccttgtgggcttgatccataatcggtttccaggttacgatggtgtcaaggt

SEQ ID NO: 598042 - DNA, 265 bp, Homo sapiens
gggcaccgtattgagagtgcacacggctattgggagtgcacagttacaacgtacaagtgaaatgaactatgattcgcattgttaaggctccaatctgccggtttatatttattgtgaaacgacagaggaaattattcagcagacttaagaaagaaagtatgttcattgatttctatgaagtttctccctagaatttaatgcacaaaatgcgtcactccaaagggagagattccatgcatattaatagagtaaaacagcattaggg

SEQ ID NO: 598043 - DNA, 334 bp, Homo sapiens
acaggtcaacgccagcctgggcgacacagtaagaacctgtctctacaaaaacaaaaacaaaaaagtgtagccgggcatggcgacgagcacctgtggtcccagctactcaggaggctgacgcaggacgatcgcctgagcctggaagttggaactgcagtgagccataatcacaccactctactccagcctgggtgacagagtgagaccgcatcttaaaaaaaaaagaaaaaaaaagggccattgtgattaatgaaaacaaacattgcctggggataaggaaagtaagaagtaggattgttctcagattagggacccaggagataaaggagtaaca

SEQ ID NO: 598044 - DNA, 81 bp, Homo sapiens
  misc_feature (21)..(21): n is a, c, g, or t
  misc_feature (63)..(63): n is a, c, g, or t
  misc_feature (73)..(73): n is a, c, g, or t
caattccgatatcaatgtatnagcatgcaataaataagcttatctttctgaattattttagtnggcattttangccaaaaa

SEQ ID NO: 598045 - DNA, 787 bp, Homo sapiens
agcggagcggaagcaccgccattggccggtgcgtgcgggtggcaggcaagagcctcctggcacagaagggactcgaggcaggtgacgcctattggatcccagaggtcatcccaggtccatgacagtggtaccgacatttcgtatctcaatgtaagtgtctactggggatgacggacagactgatggccctgtgcaggagcgttcactcgacgagcccggttccagagtccataccagctggggagcacgtggtcgtatctggaggacccgtcgtggcgctcgtacgacagccggcgcatcttcgagcgtgcgaggtgatggacaactgtgaacgacactgattcctaatagctgtgttcctacctccgaggacagtctagtgatgcatgcggatggacatgctggcatactgcgcagtatcacatcatgccgaggagatcgggacacaagctggcacccgtggttccaggaggcacactagataccagacgacggtgacacactgcgagaccctgggagtcattattgtcctccgctgggcttggaggcaagatacgaggacctggtgcagggactagagcaggatgggcctcgccggagaagtggaaagctacccttgcaggagaaataagagttgaatatcgtgaaaaagatacgaggcttaggggaagaacgtaatccgcaccaacgtgggaaagtgttgcaggagttggacctggaatgagccaggccatcttaggtattagagaaaaagtgcaaggatcaggaggaaacaagtaatggggaa

SEQ ID NO: 598046 - DNA, 378 bp, Homo sapiens
cgcgaagtatggagggctctagacacactatcattagcacggcaaagtgagcgaagacccatgtccttttcaagagctctctctgtcataagcattggccttctttccaaggtcacagaaggctatcaaaggcaaaactggggttccgcggtctcttctctctcatatggcaagagaaaatgggaaatctctatatccaagcttggattaaaaattattttcaattttgtggtccagaaaacttgggtcctatgcccaagcatggaccaaaaataggcttaaaggggtgtatgtgccgaatggatttaaggtctgactctgaatctgggaatgtgggcacctttctcagagacacagttgagagaggtggcttattgt

SEQ ID NO: 598047 - DNA, 81 bp, Homo sapiens
gtcagccgaggagaaggtgaggcccatattggcagcggtgatggacagccctggttagattacaaggaccagaagagcaat

SEQ ID NO: 598048 - DNA, 447 bp, Homo sapiens
ttcgcagaaatttttccacgcgggggtactttttatattacgggggcttcaaaatgtaccctagagcatactttgaactccactatcacataagattcccactgttacccaaattcattggtcattgccttgattaccagattttcaaactccttcactaggttaaacccttgaaccttccattcgcgataatgatcttctatccgttatactttttgtaacgccgtcaataatttagaccggtgtattaatcccctctcgttatgatctcttctatatcattcggtcacagttaaatcccccactttcggaccccttatttcctcacccattagatttctcgattgttccacttttttgaccggatctttcctaataggaccatgtttattttatttctcaagctcgcccatcactttgtcctagttatcacctcgctatattttc

SEQ ID NO: 598049 - DNA, 1282 bp, Homo sapiens
taatgtacagggaatgtttccaagacttctgtgcgtgctgttgtgtgagggcaaaggaggacaccacactgtggggaaatcctggttgtcgtaatatttagcgcctttgtaagaagatcgctggtgatgagagctgaagacccagggtgcgctgctccccctaatattattttcgggttctagagacaatggcaacaggggtaatcctctttcgggggtggaaggttcctccccccagcattttttcagagggccttatatatattcccggtttaaacaaaggatatttttggtttggggcgcataagactttctttggggggttgggggcgcaacattgtatgtgtttggaggaaatataggcgggcttctaaacccccagttgtagtaaagcgcccccacagatgttccacatagtcacaacgtctgcgtttggcccaaggaggtgtgcacccagtgttctctgtgagggttttacacataagtgttaggtggttcaccctccttatagagtggttaacatatgtgtgtgtaaatatatagtgtgcgccccactctgtaaataaggtgaataggtgtgaaccccccgaagagatgtgtaaataaataaatgtttgtaaaccccgcacggagtctcaagagattgtgtaagaaatattttttgttgtgataagatatgtgggagtgtattctctcaaatataactcgtgtcatactctctctcacacaaagagaaaagtgtgtgaatattgggtgtttttgttaaacacaacacagagaaacagtggggtatatattgtgagaaatataaagttcacagagatgtgagaaagatgtcacatttgtcttagaaaatttccccgctgtttgtggtcacccttttttctgtgagataaaaagagtgtgccacatatattacccccgtatttcggcgcccacatggatattctcacggatacccccactggaagactggggtataagttaaatataggaatttggtttcacacgccctgagggcacaattaaaacacctcttggagaagaatggcacataaacctgtttcacacctggaacttaagcgtctggctctaaattcacacacgtgctcttttttcctcacctgtaatccacggttccctcccacagaaggaggccacccacgttttcacatgggtggcacactcacagtcttttttttttccagctgactaaactttttttctgtacccaggtaatttttccaaatactaatagaataaaggcagattttttaaacca

SEQ ID NO: 598050 - DNA, 602 bp, Homo sapiens
atgctctgtgctacgcgtatttatgcaactgctgctctagatcctcacgttagctgaactgaggcaggtactattgctctccctatcccatgcaggaggacactaaggatccgcgagacatatgccacgtacccatgggtccacagccaaaagctcagtggaattcaaatccactctgtctcctaagcttatgctctctcggccacataacctccccacccatgtatcgtaaggggcatctgtatatgctggggtaaacatacccgcatggtaaagggcttgtccagagctatagcctgaaatgcccagtgctgctgactctcacttgtaaatccactggcctggatctgggggtctgcacctgaagccaaggagcataactttgctgtctacaaaagcaatgattgctgtggggtccaactattgtcatttgtcaggtcttaccacggttgaaatgtctgcctctcctcgtgtgctatgagctgggacgtgggttaaagtacactcctaagagtgtatcttaccccaaaatgaagtgccttcaagtgcgctgcagagtcgactgctcagggctaagttgacacatctgggtgctcagcata

SEQ ID NO: 598051 - DNA, 550 bp, Homo sapiens
agcggaccgaatccggcaggcacaactataggtagacttattcaatgcttatgctaagccacacaacactacctctaaggatttaacaccacaattaaaacaaatcagtggaaggattatagttttccttggccttagtgtatatcctaatatctggaaggagctaaccttatggaatgatgaactcaccaattatagagggctcactcactgtaagacacaacactatctttcaaaatatggttttaaaaaatatggtatgttctctgtaccagcaatcattaaaatatagtgctatctaggcatagtggctcacacctgtaatcccagcactttgggaagctgaggccagagaatcccttgagtccaggagtttaagatcagcctgggaaacatagcaagatctcatctctactaaaaatcaaaaagaacattagttggtgtaatggcatgcacctatagtcccagttacttgggaggctgaggtggaaggatcccttgaacctggcaggtcgaggctgcagtgagacatgattgtgcctgccggaat

SEQ ID NO: 598052 - DNA, 1345 bp, Homo sapiens
aatctcctactcctcattgtacccattctaatcgcaatggcacgttcctaatgcttaccgaacgaaaaattctagagctatatacaacgtacgcaaaggccccaacgttgtaggcccctacgggctattacaacccttcgctgacgccatagaactcttcaccaaagagcccctaagaacccgcgcacatctaccatcactcctcgtacatcaccgccgcgcgagcttagctcttcacctatcagctcttgctacctatgaaccgccctgtcccacatatcacgaaagccacctggttcatagccgtcaatctgaggactcatcactagtgaatcactagaccactctcgtagatctagccacgggcacactcaactccttcttgattcagcggtgaagcctcgacctctccaaactacagtccaagaaatcagctcgccaaacgcaccacgccagcaaacgcccagagaaacacaccacgactacatgacaagcacacacgcaaagaccaaatcgacaactagcaaatcagaacacagaacccagcccaacgtggacccctaacgaacactagctccacaacacacagaacaatcgcacgcagagaacccacacgcaaccaaacgatccacgcaaatacaccaacaccatgaccaaagtccactcgaacaccgcaacgcagaccaaccacaaccacatgcagaaggaatcatgcggagcaaccgaacggcgacgagaacccacgagccagccacaaaccctccctcactgccaggaccgccgtaggcccaccacaacacggagaaaagcccccggacaccccacacgaaccctcacaccccaatcacacaacagcagccgaaagataagcggacacactctacgcgcccgcctataccgcgccccactcacacacccagcacacaccgccccgaagaacaacacacacaaagacacacttaaccaacgtaaacgtgaaacaccaccccacgtctacgcaaagcacacaacaacaatgacaccacaacgctcaactagacaatcacaggacaaccaacaactctgcacccaaccacctgccccacaccaccgaacagacctaaagcatacacgagaaaccgagagaaacaaccaacaacgcaccccacccacacagaaagaacaagaaacaagacaaagaaacacaacacgcaagcaccaaagtcaagcaaccgacgactcacaacccgtagaaagagcaacaacaatgtcaaacccacaaacgaccacagcacgacagccaacagacaccagagcgacccacacacacagacaagagcccaagcacaacgcaccacaacagacc

SEQ ID NO: 598053 - DNA, 319 bp, Homo sapiens
ctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatatcaccagccacttgtgctattttatcacatttggctggtgataaaatttgaaattatggttaacctcagctgtgatcttatgtatgtaaagtgaaatttaaatagataattataggttgattacaaaaaa

SEQ ID NO: 598054 - DNA, 142 bp, Homo sapiens
agatggtatccacatcctggtcctgggtcagcttctactaggatgggcttgcttcactctgcaagtgctgttgtccagtgatggccctatcttctgcagagacttggcaacaatgaagcggacatttggcaccctgggtccc

SEQ ID NO: 598055 - DNA, 232 bp, Homo sapiens
tgggaggatatttagcagcccggcagcctgaattgcctttgggaagaggggtgggaatgacttttcaatggaccccttttggcccttttgaattttggcccatggacatgtattatctattaaaaaatagtttttaatttttaatttgggaaactttttttaatagaacccaaatggaagaaaattttgattctctaaatctgcttttttaaagataaagcctttgattcca

SEQ ID NO: 598056 - DNA, 539 bp, Homo sapiens
  misc_feature (32)..(32): n is a, c, g, or t
  misc_feature (38)..(38): n is a, c, g, or t
  misc_feature (41)..(42): n is a, c, g, or t
  misc_feature (53)..(53): n is a, c, g, or t
  misc_feature (56)..(56): n is a, c, g, or t
  misc_feature (63)..(63): n is a, c, g, or t
  misc_feature (72)..(72): n is a, c, g, or t
  misc_feature (74)..(74): n is a, c, g, or t
  misc_feature (181)..(181): n is a, c, g, or t
  misc_feature (256)..(256): n is a, c, g, or t
  misc_feature (314)..(314): n is a, c, g, or t
  misc_feature (534)..(534): n is a, c, g, or t
tcagggctccggttccatgtgcgctccaaggncccgtntannaatttcacgtntgntgaagtnctagctcananccctctcgccgagactttctggtcaccagattccagcagaactcaacagagacctctacccgcctgagctcctgaccaggttagagggcatctggctcccaggcacngggtcaagctccagaggcatctcctgtgtctgcccgcgacccatggccccgctcagggcctgccttccatctccngggtcttccccagtgcaggtgggagctctgctcccctggtaactgcgagcctctcaanaccaccttcctcctcagtgtcatccccctcctgtctgccccctctcccccagtgcaggggccataaagccttccccggagtcccactgccaggtcccactgccgggcctccaggctttgctgctccacctgggctcaagcctggccatactttgttctaatgactctgtccccctgtggtacactctctaccacagccaccctgggctccccatacccancccag

SEQ ID NO: 598057 - DNA, 1362 bp, Homo sapiens
gctaaaagccaaaatgggaaaggcaaagactcatatcaacattgtcgtcattaggacacgtagattcgagcgcaagatccacacactactggccatactgatctataacactgcggatggcatcgacaacaacgacaccatatgaaaaatttgagaccggacggctgctgagactggcgaaacgggctccttcaagatatgcctgggctcttggataaacctgaccagctgagcgatgaacgtaggtcatcacccataagcatcatctaccattgataggcacaatattagaaacaccgagcaagtaacatatgtagactcatccattgcatgccaccaggcaccaccagccagcacttttatccaaaacaaccatgcatacacagagggaccatctccaggcctagacctgtgctagtacctagacttagttagcatagactgagatgtaagagatgaattaagcaagactaggataatctcccacaaacataggagacagaccacgcaggagacatgaccctatactggggccttacacagcgactgggagtgttgaaaacaaacactacaggttggtcaggcagttctaaccaccgcactgggcattcacaaatggcaggccaacccataacaggccaagaccacgagcatacagcaggcacactcgcagaccacgacagtccccagacacatcatcaccaaattcaaaggaacaaaacagaagcaaacacaacaccacgaaaaaacaagaaaacacgtaaagatagaccaaaaaccccgggacagaacacagggagaaaacacaaaggacgagcagccccaaaacagagcacacagaagcacggacaaacaaaggggacgggaacagagaccaaacagaaaaaggaatacgacaacgaaaaaaaaggagaccaaaacaaccagcaatgaaagagacaagaaacaggcaacccacaagcgagcccaaaaaaggaacaaaaagcgaagaagaacacataagaacacaggaaacacagccaaggacagacataacaagaaagagaaacaacacagggacaagaaccagaatggacaacaggaacaagagagatgaccaacacagagaaaggaaggaaaacacatcgcgacgaggcacgcacacacggagaaaaagatcgagaaccagcacaaaggcgcagagaacacatcggagaaacagggacatacgacgcaaacgactcaagaaggtcgacacaggcggagggacaggacaccacaagagagcagcgaacagagtaaacccacccacagcacggaccgtaagagcagcagaaagacagacagacgagtaaaaacacagcaagagaaagatcaaacgct

SEQ ID NO: 598058 - DNA, 217 bp, Homo sapiens
  misc_feature (3)..(3): n is a, c, g, or t
  misc_feature (14)..(14): n is a, c, g, or t
  misc_feature (33)..(33): n is a, c, g, or t
  misc_feature (86)..(86): n is a, c, g, or t
  misc_feature (134)..(134): n is a, c, g, or t
  misc_feature (173)..(173): n is a, c, g, or t
  misc_feature (177)..(177): n is a, c, g, or t
  misc_feature (180)..(180): n is a, c, g, or t
acnatttacctttntcctagattttacatgcantttcccaaatctttgtgtttgcctatctgtaaaggtaatacaatctgattacnaaaaatgaaatgttacatagaaatgtaccgttatccatctaccagatnactattattaataatgtgtatttatttttccaggaattnaaanacntctatcatataagtattgcaaataaaacttaaaaagc

SEQ ID NO: 598059 - DNA, 313 bp, Homo sapiens
ctcgggctgtcaacacatcacgtagccatctcacggggggaacgcaatgcaggtggcctcgtacaaaacacttgattgtgctggtgattatgagtctgcgaatcccgggattctggcacagccgggagtacaggtacgagatgtgctgcatggccttatccaataccccgaggtcttctccctccaaggtcaataccaactgactgagatgtgcttggatctgcacgcctctgccactgtctacgaggaactgcaggtccagcccctccttgcaggatatacagacagacgatcaccttcttatccgagagtt

SEQ ID NO: 598060 - DNA, 206 bp, Homo sapiens
accgaagtgcggtcacgtttgggatgtcaggtgagctggccctagtaatcttggttagacgataaggatggaggcccattgcactgaggccaagcctgctggttaggacactgtcattcttttctgtggatgtagaccagtggtttccaaatctgtctgcaccattagattaaccatggtgagtccccaacggtgaccggcgactt

SEQ ID NO: 598061 - DNA, 1124 bp, Homo sapiens
  misc_feature (37)..(37): n is a, c, g, or t
  misc_feature (1076)..(1076): n is a, c, g, or t
ctacgcaacagtacattcagtgtagcattgtgtgtgntgcttcagctcagatgcagcgtgcgcgtcgatcatcgtgcgacgcgatcgccgccgcacatgactttctcacagtgacatatgtgtctgtctcagtgcgtatgcacgacgtctatgctattcactagtctccgtgactccgtgtatgagcgatgcgatagagtcagcagcacgatcagatgcacatgctgctaggtactagtggagtctattcatgatagtggatgagtgaagtgtgtatgcattgtattgtatgtagtgcatattacgtcgactgtgcatcgaatcgttcgttgagtgatgcttgacttgtgagtagtgattggtagtatgtatatcgagtcatagtcggcgtgatcctcagtatcgatgcgttctctgatagcagtcatgcagatctgatgactggacgtgctgcgggagattgcatcttcgacttccgagactgcagtagtatcacgctatgcagaagaggctatgcattgtcgtatgtatacgcactagtcgccgctatcgttagtgatcatcgctgctctcgagctagaactgtgcagtagctatagtaagcgtgtgagatgtcgtgtgtagatcgatagtgagtgatgtagtggcagtgacaggatcatgtttagcacatatgcgtgaccactacagtcgtgacgagagctctagaattgtagacgtggcactgtgatgtgcagtgcattatactaacacatgtatagtcagatctatagctgacggcatagtaatacttgatgtacgtagtagatcgagtgtagagattctatgtagttggttgagtgtgattagtatctatgagatatcttaatccgtccgatcatcatgctagtcgactatgtattctatgggaatcgtcacaatagcatatatgcgtgagctgttgatacagtagcgatcagatcgtgtagttattatagcatactgcagtgaatcatcgttgtcgtatatcgtgtggcatatgaactattcatactcgtctgcgctgtgtctactcgtatctaggcacgctcgttctncatgcgcacagtcagtacatgatgggctcgtgtctgtgcttacgtgtc

SEQ ID NO: 598062 - DNA, 729 bp, Homo sapiens
  misc_feature (729)..(729): n is a, c, g, or t
gggagagcgcggagagggaaggctgggagccccagtgagtcttcactacctacactgccgctcagctcccgtgcgcgagtggaggtcggggtggggagacgcgactcctgcccgggatggctgacactctgcgagccccggcggcccgcggccgggcctgggtgactagtgcgtgagggcgctggagtggtccgcgagcgggcgggtggctgctgcagcagcctgggcacggcatgccgcctgcccgctgggcgacgagtgtgcactgggtgtggcaaggcctggatgtgcgggccagtgaggggttgtgcgctgcttgatgccgtgagcggggctctcccctcgtacggctccctgccgcccagccggtgatcgctctccggccgtccccggcaccctcgtgcccccacggccgttggtcccggcgggggaaggagaaagtgagactcggtgtcatcaccaatccatcgccagaaggggaggaaactggaatccagcagcagcgagcagcagctggacggtcacatctggaaatggaaagccgacctccccactcctcctccagcatcctcctcctccatctcctatcatactccatctcacaccaggatcacattccgcaaaacacttagcgcttccagaccatgacatcaggacacagggttaacatttaaaactgaatagtaaccgaaaagctgaacagcgtgcgaggcgagtgaggttggaacn

SEQ ID NO: 598063 - DNA, 130 bp, Homo sapiens
ctcactgcgcttatccgactgagcgtactgccaacaacgtacacgtcaataccaccggcttcaaggaatcgcgcgcgagttcgccgatctgttctcggccaccggctacggcctgtcgaagaatgcggtg

SEQ ID NO: 598064 - DNA, 121 bp, Homo sapiens
aaccaacacaaaacaagagcaactgcacctcactctgaaatgacagtggcaaacatcactttgctattggaaaattaaaagaaaaacactccctcttgctattgaaacttctaaaactagg

SEQ ID NO: 598065 - DNA, 717 bp, Homo sapiens
ataaatattatactagcatttagccatctcacttctaggaatactagtatatcgctcacacctcattatcctccctactatgcctagaaggaataatactatcgctgtgcattatagctactctcataaccctcaacacccactccctcttagccgaatattgtggcctatggccatactagtctttgccgcctgcgaagcagcggtgggcctagccctagcgtagtctcaatctccaacgacatatggggctagactacgctacgatgaagcctaaacctactcgcaatggcgtaaaactaatcggtcccaacaaggttatattactaccactgacatgactttccagaaaagacataagttgaatcaacacaaacacccacagccgtaattattagcagtcatccgccctactatgttgttcaaccaaagtcaagaacaagctatttagcgtgtgtccccaacctgtttcctccgacccgcgctaacaagccccgctcctaatactgaatctagctgactccgtaccgccgtcaacaatcgatggctaagcgcgagccgcgcacttgatccagtgacaccaactatcgatcgaaaaatgaactcgtaccgtcctcgtatagctaatctccgcgtatgaaatcctcctttaagtttagtaacttggcaccagtgcacaggaaacgtaatcaatatgggatatgcttgcttcgaaac

SEQ ID NO: 598066 - DNA, 87 bp, Homo sapiens
agacagggttggctgggcatggtggctcatgcctgtaatcccagcactcggggagagcttcgagaagaggtgggacatgatggtgga

SEQ ID NO: 598067 - DNA, 230 bp, Homo sapiens
  misc_feature (95)..(95): n is a, c, g, or t
gtttaaaaagccccgggattgggggggccccccccaaaggggggggggggcaaaaggcccccttgggcaggggccaagctttttgggcagggganttggttttttgttccccccggggcccttcccggggtttaaagttttttggaaaatggtgaaggtaatttgaattggccgattttgttgaccgggggggttaagcgggggccttaaaaagcttttttttcccccca

SEQ ID NO: 598068 - DNA, 151 bp, Homo sapiens
cactcctcctaccatttgaggatacagtgagaagccttcatttatgaaccccaaagtagccctcatcagaccctgaatcagccagtgccttgcttttggacttcccagccccaagaactgtgagaaataaatttttgttgtttataagcta

SEQ ID NO: 598069 - DNA, 1258 bp, Homo sapiens
  misc_feature (1143)..(1143): n is a, c, g, or t
gttattgtgtgggatggtgatactaccagacaagttcagagcaatatcatgcttccacgctctactgtacaagtgtttaactgttcttcagagacctagatgctttggcttatctaggtgcggaactgacctgctgctgctgtggaaccgacacaacctctagactctccatgctgtaacgactagaccagcctattcctgactacagcgctaatctagctgactctctgcgcatctgaaacctacccctaacgcacactgctgcttgcctgcgtccgccagctctgcgcacaaagaaacctgcactacactcctctcagcgctctcgcgctacggcaacccccacacgcacaggactccacctacgcacactgcggcactaattacatgtgcacaggctctcaacgcacgccatccatttggactccaccacaaggcactacactactctcctccatacgactactgcacctctacactagctacaacacctcgtcaatctcacgcacgcctccacacggataccaaccacagagacacatccccccaacccgactccgcgcaacgcacgcccctaggacctccgacattcccttgcgcgcaactcggccaccacactgcgccacaccctggcgcaaccccgaagatggcccacggggacccgtctaggtgccagaaccgggccaacacgcatcccccctcgcgcagcaacaccaggaacttcctacccggaacaacaacccataggggccacccaacaccaccaagagcccacacgcgcacaacaccttcacaacacacacgccctccgctggcccccgcaagcccacaacacttccccaacatattagcaaaccactttactatatccccacacttacacccaaactcccccaattactcccccacaccaaattggcgttgaacaacatgtgcaacacacgcgaacgccgagacaccgtgtgcccattccactagccacacggcacagatcagagcagcaagaagcacgcaacacaggcgcagaccaaacgcatggcccgagcgcatccttaccagtcaacacacccacgacgtaggacactctaacccctacacagcggcccccgaccagcagcgcaacacagaacgacagtggacagnaccggcagcccggccctcgaccagtcggaaaacgagtgggagccccgcacatcatcgcatgcccaaagcgaacaaagcaaacctcgtcggccgccaccacacagtatgcaaaaca

SEQ ID NO: 598070 - DNA, 895 bp, Homo sapiens
  misc_feature (9)..(9): n is a, c, g, or t
  misc_feature (24)..(25): n is a, c, g, or t
  misc_feature (28)..(28): n is a, c, g, or t
  misc_feature (31)..(31): n is a, c, g, or t
  misc_feature (187)..(188): n is a, c, g, or t
  misc_feature (195)..(195): n is a, c, g, or t
  misc_feature (236)..(236): n is a, c, g, or t
  misc_feature (257)..(257): n is a, c, g, or t
  misc_feature (278)..(278): n is a, c, g, or t
  misc_feature (308)..(308): n is a, c, g, or t
agacacccntgtatcagacatccnnggnagnattagggagtgggggtaattatagttcctaggtctatggggtgagaggtgggagtagaaccagaagtgccctggaatccatctcgtgtcagccctcaccccagggccccctggatatagtcatggcctgcttgaagccctctgctccctgcagaannctggggncgaggaggagctttttccttcagttagatctttcccttccntgctgcctcgctcccttagcnttggagccctaaagttagtgnacaagacactgggataaagctctatggctnctggaaggaggtcctgagtctgtgtgtgtgcatatgcatgcatgtgtgtgtgtgtgtgtgtcctcatttgcagaagtcttgctaccagttagggtgttaagagcatctcccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttctttatcactgcagcagtgtttatcagtagttcaaaatgatttatttgctcctggggagtaaaaccttttttattattaaaaaaagaaaaagaaaaaaaaaaaaaaaaaaaaaaacccgggggcttttttttgggggggggaaaaaggggtttgaagggcatggtcatgtgttcccggcccgttttttgttcaagggggaaatcggcggccccctaagggggccgataaatggaaagccgggtactgtaaaagaaaaaat

SEQ ID NO: 598071 - DNA, 630 bp, Homo sapiens
ttagtaatacttactagtaataaatattgaaaaataatgtggccgcatcattgtttatttatttattttatttaacaaggcgaccagttaggggacccaggttaagcccttcaacagaactatcctgaagagcaaaagtagcaaatgacaggctatgactagggattgaatttggggaaggctggatttgtgaaatgagagccaaaaaagttttcaccttctagcccacaggttaagttactgaaaatcagtcatcaccatttctacccacttgtgtgtttctcctactctggagagtaatctaactcatcatttgcaatcagggcctctgagttctgtttgtgttagcttttgctcttcactctgctacttgtccggccgtttgccttcgcatctgacatctgttggaaatagaagcctttggctttaatgggccccgccccattcctccttggttctcgccctatggggcgtacggataaacccttcttcactgagaaggggtcatccacgttctagcgctcgttcgtgctttggtgaaggtctcttttacatccctgtattccatggtggctgttctcagattgccctattcaaatataagtggagcaaactcctattttgaccgtt

SEQ ID NO: 598072 - DNA, 532 bp, Homo sapiens
cctcaacaacttccagaccccacatccgtccaacatagctgagttctgactgatggtgctccggacctgtcctcttaagtggtgaccaagtgccctccccaccccacgttggtgctctcagatagaaggtgctgtgcccatctgcatgagccccaagccccgagcctggtcttcaggacaggcagctgctctgtgtcgccacgggcggatacgccaagggataatgatggagagacggccgagatccctggactaaaacaagacacattcttataaacactgtaattaccatacttgcactccctctagggtgacagtggcacagacacggagtgcacaatcaacgaggtaccatgcagaatgtgccaatggacgaggatcctgccccacgacatgcagtcaaacgaaatgttcacaggaacaacgcacatgaagatatcaacaagccacatggcccatagcaatgaaatcctcctatgtaacaccaacatgaggtcaaaatagcgtagtaccaaaatgatgaacatagata

SEQ ID NO: 598073 - DNA, 461 bp, Homo sapiens
aagcaaggcaagttacttctatatagaagggtgcaccccttacagatcaaacaatgcttagtgatgtgtgtcagacctctgagcccaagcaaagccatcatatcccctgtgacctgcatgtatacatccagatggcctgaagcaagtgaagaatcacaaaagaagtgaaaagggccggttcctgccttaactgatgacattccaccattgtgatttcttcctgccccaccttaactgagcgattaacctgtgaacttccttctcctggctcagaagcttccccactgagcaccttgtgacccccgcccctgcctgccatagaacaaccccctttgattgtaattttcctttacctacccaaatcctataaaacggccccacccctatctcccttcgctgacactctctttggactcagcctgcctgcacctaggtgattaaaaagctttattgctcacgca

SEQ ID NO: 598074 - DNA, 1400 bp, Homo sapiens
  misc_feature (673)..(673): n is a, c, g, or t
  misc_feature (1149)..(1149): n is a, c, g, or t
  misc_feature (1384)..(1384): n is a, c, g, or t
agcgggcctgggaggcagaggttgcagtgagccaagatggcactgctgcactctagcctgggtgacagtgagactgtttttaaaaaaaaaaaaaaaaacaaaaaataaaaaccaaaaaaacaaaaacaagagaactaatttcccattcacggctcggataagatttcttcatttcttccttttccaattaaactcctttttattctcccagaaaacaacgcatttcttgggttccacactcattgtggtacaccctgtgggtcttaaccccgtggtttcttaacaaccttttccatttctacatcctagaaaaaatttcatataccctacgcgggcttgggatatgtggtgtctcgccctttcgtggctataaagtgatctctcatcattaagggtggcttctctgggggtcgaattacatccccacgtgttgtgcacgtgcgcgcgtgtatatctatacggggggggtttctccctcttttttttcacccacgtgcggctgtgcgaaacataggcatatcctcgctgctggtgcgctcgtgcacacacatatacccaccccacacaaaactattctgcgcacatatatatttctgtgtgtgccccccccctgtgtgatctgaaccgtagagacgcccatcttggggggcggtctgtgcctcctacacatacntgtgtggctgcgggcgcaatcatctcttattgtgccacacttacacacgctgcatacccccaggcgagacatattatctccgaccataaacactccgcggtgtgatatttaaccgtgctgctcttctctctaaaatggtgccccgcccctctatatgatggtgctctctcctaccgacgtggtctaatactctctcgggcgggataataacaacatctctacgccctcataaacggcggcgtcgttcgttgccaccaccatcttctcctgttgtggaaacgccctcctcttatacggccgttgggcttacaacaacccactcttgttgttgttaccacgcgaaacaccgtcgcttcgtggtgcccaccaaaaacaccagcaagcgagttggtcgcgtcactcataccaacagcggcgctctacacaactgtcgtggcgcgatcaatctacccaatactgatgctgcggacgaaccnacgccccccccgcccgcggtggtcctttcaaaaccaaccacggttgttggtcgtctgctctctaaccaagagacgaaacgattctacgcacgctaggtgagatgacggaccacttatacaacgacaatactaccaccccatgcctaacctccaagcagccgacaacttcttgtggcgaggaccacaaactcttccccagacgcgtgtccctctttctatcttgcaaacaactatnctctaagtctccggcc

SEQ ID NO: 598075 - DNA, 1281 bp, Homo sapiens
tggttaaggtgcccgcttaattttccatgtgcaaacggtcaactgtctaaagcttctcaaaaaaacgtgtcacagacccctgtgcaaagacgagggttcatgacttgggccctctcctgtgcctctgttggtggtgtgggggtgggggcagtgggggcgcgttcacagaaattagacgaaagtgacagtgttccgcttgcagtataaactcttaggtcccgtgattcggatccatccaagaggcgggggtgtgagggagctccctcagtaaaggtggattgtgtgccatctctcttggaacaagaggacttacatgggagagtgtctgtagacccacggcgttgttgctcctgtacacagcccagggcacaaggtctgagcctagaccatgggtggcacccgggttgtgccatttctgagagactcttagagcactctggagtctccagcggggtgtacacctacagagggtgctcccacacaatatacaagcacaattcaatttgtgccccaattcgcacaacccgagacgtgacaaagtgtgtgtcccaatcgtgttctgaggagagaccccatgggcacacagtgcaacgaacagatttattcagcgcaatggaggtgcgtcccctaataagagacacacaactatttgggtacagctacacgagaatgtaacagcgcctgtacaagagcaaaaatacagcctcaagaacaacaccctggtgtgatgaacccacatcttttagtcttgtgggaccttttcaagcaaacgacccacgtggaaagaaaggggcacaaggtgccgccaccacgacaagagagggaagaaagtaaaaggggcccaaatgggtgtactgaagtcaccacagggaggacccccctattgggggcgcacttactctaaaaagagaaaacgcctatttggccgcccttacacatataccaatttatacgaacgggagttgatgatgtgcggccccccccagagaggtattgtggtgcaaaacttcaacacaaacgggggacgggacaaacacggtcttgagaccgcgttaaccaccacaaataaccaccccccaacaatattgcggaccccaaccccgagtggagttccacccccgtgccatcgtggtagtattatgcacacctcatgagcacacacacaagaatttacgagagggaagcactcacgtacaaagacacccgaggagtgttattggacagcaagtcagttctagaaaaacgaacacatttaccgcttcttgtgagaataaccttgac

SEQ ID NO: 598076 - DNA, 507 bp, Homo sapiens
cccaaagacctttacacatcgtgaccttgagaaccgattatggatcatgccccaagtatccaagctactggctgcatcgagaagagggatgaagggtccagtgctagatcaaaaggcacagggtggcgatgtggcaaagaagttgctagtggggagaccttgcattgaacaggcttctggaaaagctagggaaaagtggttgcccgctttccccctttccctccccttcaagcaccgtaaaaatttgggctttattattaagagctgctataaaaacagcttgttaaatgttaagagaagcccaggggtacttcaagcattccttcgaatgcttcactccagaaagagggagtcgaggcaagtcctcattactaataaaaatcaggtgaggctgacacttctcttgaccttaggataatagcgctttgttgtctctcctgccacaggaaggctccatggttgtcctacttttaggcttcggtgcctttggtgagggttacttgggcg

SEQ ID NO: 598077 - DNA, 169 bp, Homo sapiens
ggcttgctcaatgggttaaggatctggagttgccatgagctgtgatgtaggttgaagacacgactcggatcccacattgctgtggctctggtgtaggccagcagctacagctccaattagacccctagcctgggaacctccatatgccgtgggagtggccctagaaatg

SEQ ID NO: 598078 - DNA, 492 bp, Homo sapiens
ccgacggccggcgactaggggtaatatggcaggacaaagttaggaggcagaggaccgaggaggcgagtctgtatgggccttgtgtggctgtgctcttggacagacctgttggcactagagtgatacactaggcagctgatagtactagtaggacctgcggcagtcgagtaccatagcaaggtagcgccatatagtcacaacctaggcagctagccacataggaaaaatatagtactatgcaactacagcgaactcatcgcgacgcgcaacacaacaacacggatgcacatccgctgaccgcacatgaacacgacacaactgaaacgacttctttcggacgacacgagcacgcaccgcactggcgattaaagaatccaaaggctacgctacgtacacttaccagcacctacctgggcgaagcaggcagataacccccatgtaactctttaccaggcccgtatcccggagcacgagctgactttcgacccacag

SEQ ID NO: 598079 - DNA, 252 bp, Homo sapiens
agtgtcttcaagacaaactctggcattatcgcccaggctgcagtgcagtggtacaatcttggcttactccagcctctgcctcccaggcccaagctgttctcccacctcagcctcccaagtagctgggactacaggtgtgcatcaccatgcctggctaatttttttttttttttttttggtacagaccaggttttcaccattgctgcccaggcgtgtctctcaaactcatgagtttcaagctactccaccgtg

SEQ ID NO: 598080 - DNA, 810 bp, Homo sapiens
tggtaagtaaagtggccacctttcctagtggatgggtagatcgagcgttttcggcctgatttctcttgttgtagctctccgagaagtgcttttaagtgtgtttgcaatgcgccagtcggtgggtcattcgtggggcctgtcctagccctcttcccgccatccttccccatagtgacgtccactgccttgtctacctagctgacctgctctgttcatgccctacctccctgaggaagcatggggaccctaactaccctggtgccctgcacctagtacaggccgtggtcaggccctaggctctaccggtccgggttctgcctactagcttctcctacgtgctttgctgactatgcgtgtgcctgtgtgtggtgtctgttgctgtgtcgtgaaactgtgacctatcactcagtccatactaagtgagtggcccttcgaggccactagttatgcatctttcagtgtgtgtctataacgacgtctactgctttttaaactcgataactctttattttagtataaatgcctctaggtagtctggaatagctacgcggacttgcagaggttttacttatatataggccattagaatctggcagaaaattaagagaggcaacccgagcccagcgcagcagacatacaggaacacacaggatatgcatttgacctataagacaggaataatgtttatatcatgattgtattttaaaatagtttttttactatatagaacttaatgattcttttttccccacccattaatcaaccttacccatctggaccaagcccctccttaccacaaggggtaagtgc

SEQ ID NO: 598081 - DNA, 236 bp, Homo sapiens
cgtcccatcagtgtgtgagttataataaagcagctgaggctgggagcagtgactcacacctgtaatcccagcacttgggaggcaaggtgggcggatcacttgaggtcaggagttagagaccaacctgaccaacatagtaaaaccctgtctctactaaaatacaaacattagctggccatggtggtgcatgcctgttaattccagctactagggaggctgatgggagcaagatgcgc

SEQ ID NO: 598082 - DNA, 255 bp, Homo sapiens
acatcctgagggtgatggcggccagtcggggttgatctcgatagttgatgagcctcgcccatggtgacagcaggcgggccatgcggacagttggagtagccacagtaggcccccagctccagcagcacggagggctagtagtccttgaatcacggcgtccacgaatcttgcctattcttgtctgcccacgttccattggcccaattccttcttggctcgcaggtaggtgtcaattggcctaccagcactgctctt

SEQ ID NO: 598083 - DNA, 461 bp, Homo sapiens
  misc_feature (38)..(38): n is a, c, g, or t
  misc_feature (72)..(72): n is a, c, g, or t
  misc_feature (99)..(99): n is a, c, g, or t
  misc_feature (118)..(118): n is a, c, g, or t
  misc_feature (178)..(178): n is a, c, g, or t
  misc_feature (231)..(231): n is a, c, g, or t
  misc_feature (453)..(453): n is a, c, g, or t
acccgaaaagctcatccaagtcccagcttcccgggtgnaggcatcccttccctgcagctccctggctccggnccccagggtgtgtgccgcacgaggganacttaagattggccaggcnacggcccaagaaaacttgctgtttccgtaactgtcaatggagaaagattccttcgccaancgcagtggcacatgcctaaaatcccagcactttgggaggctgaggcaggtggnccacctgaggtcaggagttcgaaatcagcctgggcaacatggcaaaacactgtctctattaaaaatacacacatacaaaaaaattagctggacgtggtggtgcacatctgtaatcccagctactcaggaaccaaggcaggagaatctcttgaacctgggaggtggaggttgcaatgggctgacattgcaccactgcactccagcctggatgacagagcaagnctgtctca

SEQ ID NO: 598084 - DNA, 131 bp, Homo sapiens
aagtgcatcactttcctcccctctcccactcagcttccatgcacgttccagtgcggtccagaactctccggaatctctagggtggcgggcgacgtcttgtagtttatcccagatgtataaagggggtggaa

SEQ ID NO: 598085 - DNA, 510 bp, Homo sapiens
  misc_feature (381)..(381): n is a, c, g, or t
gacagaggactaaatctcagtactctgtcatagggctgtgaggattagaagatgacgcctatcagagtggctggcacagtgtaagtgcccagtaaataactggtgttttgcagtcgtttctactctgtaacctggagtaatttacttcacttcactgttttttcctctctaaaaggggacggatgaaagccaatctcatgagatctggaggaaccaatgagacagtaggcacacggtgcccgctgttgttgtattgtgattgagagcacagactctggaaccagactgcatgaagttccaattcctaagcccatttactttaggctttacggtgccttttctgtgccacagatgtccgtcatgtgtaaacttggcgagacnataagcagtaccagggtccagtggtactctgaacaaaaatggactgtgaagtattaataaaaacgcttagaccgaatatttggcatatggtaagcacgaaaagtgtgagatgtaagaaataataaaata

SEQ ID NO: 598086 - DNA, 254 bp, Homo sapiens
aacaaaggtgcaatcattggactcatgtgtgggcggtgtggtcatcgcgagggtgatcgtcatcatcttgcgtgatgctgaagaagaaacagtacatgtccattcatcatggtgtggtggaggtagacgccgctgtcacccgagaggagcgccacctgtcccagatgcagcagaacggctagcgacaatgcaacctacaagttctttgaggcaggagtgcggaactagagccccgccaccggtcttcgcctgat

SEQ ID NO: 598087 - DNA, 556 bp, Homo sapiens
  misc_feature (26)..(26): n is a, c, g, or t
  misc_feature (60)..(60): n is a, c, g, or t
  misc_feature (64)..(64): n is a, c, g, or t
  misc_feature (76)..(76): n is a, c, g, or t
  misc_feature (80)..(80): n is a, c, g, or t
  misc_feature (135)..(135): n is a, c, g, or t
  misc_feature (163)..(163): n is a, c, g, or t
  misc_feature (199)..(199): n is a, c, g, or t
  misc_feature (358)..(358): n is a, c, g, or t
  misc_feature (459)..(459): n is a, c, g, or t
tggtttgcttttttgcaaaagaaaanaggatggttgttttatcaggggtagttttaggtncagngtaatgaaaaantagnggcccattcctaaggccggagggttggtttcagggaaaaatagcacccagggggngggcaagatggttcccagttttgcccantttgtcaccctgtaagtaattcagaaccaggaggantagagaattcttttggcccagataagatacgttttttattgcagttctgaaccagagactgatgttgacacattttttttccatttggcaggaatgggagtacagtgccattaggaccagcaagtgacacaggaattctgaatccagatggttataccntcaactacaatgaatatattgtatataaccccaaccaggtccgtatgcggtaccttttaaaggttcagtttaatttccttcagctgtggtgaatgttgatnttaaataaaccagagatctgatcttcaagcaagaaaataagcagtgttgtacttgtgaattttgtgatattttatgtaataaaaactgtacaggtct

SEQ ID NO: 598088 - DNA, 354 bp, Homo sapiens
  misc_feature (151)..(151): n is a, c, g, or t
  misc_feature (274)..(274): n is a, c, g, or t
  misc_feature (294)..(294): n is a, c, g, or t
  misc_feature (308)..(308): n is a, c, g, or t
  misc_feature (332)..(332): n is a, c, g, or t
gagacggagttttgctctctcacccaggctggagtgcagtggcacgacctcggctcactgcaatctccgcctcctggggtcaagcgactctcctgcctcaccctcccgagtagctgggattacaggcgtgtgccaccacgcctggcctgtnacgtcttcttgatgattaattctttgatcattttgaaatgtccttcatgatctctggcaacataccttgttttgaagtcggctttgtctgatattaacatagtacaccaatctcaccattctngtgattcatgtttggtatgncctttaacatcctntgactttcatctacttgtgccttntatatttaaaatggttctcttg

SEQ ID NO: 598089 - DNA, 707 bp, Homo sapiens
ggcggggcgcggtggctcacggcctgtaatcccagctctcagggaggctaagaggcggaaggatagcttgagcccaggagttcgagacctgcctgggcaatatagcgagaccccgttctccagaaaagcggaaacaaaaaaacaaccaaccggacaaaaaacaaattacggggtaatttcccttcaaaggcaagggcccaccaattccctgtgagcacattaaccaccttaattgagggccccacccttgcccattaggtattaacggcagtggtcccttttttaaaaccgttgaaacaaaacacccacaaccaaacaatacacaccaaccaacaccactgcaccacctacatatttataacacgacatacacacacacagcacacacaagcaacatgctgggggggggcgcgccgcaacggccgcaccccacgagaagagaggttccaaacacacacaactggtgggggggcgcgacgcgccgccccccgaaagtgagcagacaggaccacacggtgcgccaagggggtgtccccagacggagagctcggtgaggaccaacacagggcgtgggggggtctcccacacaaaaaaaaaaaaggcggcgggcgggcaccaccgggctctgcgggaccaccaccgagcggcgaggcgcgcacgactcaggcgaccccaaacagggcgcccgaggggcgtaaaaagacgag

SEQ ID NO: 598090 - DNA, 178 bp, Homo sapiens
acctctacctcctgggtcacgcaactctctgtactcagcctcatgagtagctgggattacaggcacccaccaccatgcacagctaatatttcgtattctatagtacacccggggtttcaccatcttagccaggctggtcttgaactcctgaccgatctacctgcctcgtcacccccaa

SEQ ID NO: 598091 - DNA, 513 bp, Homo sapiens
tgccgggccttcggatgtaggaagtcgtgactgcgtttcccccgcttgtgggtggggggacatggtggagctgccatagaggccaggaatattgtggggtggctgtgatggtctggggtcccagatacgtgttctggacttctagcgcctgtgagccgccggaggctgtcaggaatcttggatgccgtgaattgcaggagttccttgctcagggttggccacctccttgtgggctgactgcgtgtatcctctctcctacctctctccagtgtgctgtctgtcgtcctaggtgcgcctagctgccgtgtccaggtcgactttcccaccgggcacggagccgtcagtgaatccgacaagactcggatggcactttcactgtctgctagctgcagctccagccagccatcggccaccaggcgggagcagtcaccattggtgtccaaagaccggctaaaaagcaggagggactggagggcagggatgcggacgcagttcaccaggtacggcttgttg

SEQ ID NO: 598092 - DNA, 179 bp, Homo sapiens
ctacagtaactgaagagtaacagctaggctgtgtaaagtaccaagaagagtgtgtagaatgatattggacaagccaggcatggtggtttcatgcctttaatcctatctacttcggaggctgaggtgggggaattacttgagctcagcagtttgagttcagccgtcgccagactgagtgg

SEQ ID NO: 598093 - DNA, 1403 bp, Homo sapiens
  misc_feature (624)..(624): n is a, c, g, or t
gctcctaccggcgggatttgatggcgtgatgtctcagccgaaagttctccgctcccagagatgggtcctctcggtgtttctggctcgtgaagcggcagcgagccggcatcgatgtggaaggatgaaggagctctcccgtacggagtgagcccgatccaggccgggtccaccgtcatcaggctgtcctgggagtacagaggtctggtcatgattcagcatcgaagtcgggaagctcgagcagtgccggtgtatctgaggatgaatcacatggaatggacggatgtgttgagatggcgtggtgacgcgactatgtatgtaggacgacctacctaaagtgagttgcgtttgcatgtgagcaaatagatggtgtcttacaggatgggaatagagactcccattacggaagagacttcggcgggaagcaattcattacgaatcttggctaaatctatgtcgatgagaaacccaaccattccccagctgggccattagggacgattggcacaatagatagcgctagatacttcttttatgtacaggagaaattatgcgacgctctgccagattatacggtaataaatgcaacaggatagacgcgctcaattttattaacactatagggtntcgcacctttgtccgtaggatacaacaatagttgcccaaagtcgccaatcggcacacgcgtccattcggggccaaaagggtaagaaggcctacagaccttaggtgcaggtacccccgagtagcgttctccaagtctctcggtcccacgtgacaatcatctagaggtgacgttggcacaacagtgtactattcactgatccgctcatttttatgaggctccaaagggaatacggcgaggacaattgccggcccacttggcgatctccttcgtctttgacctggcgcgcaagcacgacgggaaaggaggccccccaactcttttggaataggggaaaacgcatgtccgccacgggggtttgtaaacagcgcggggaacagaagacttccttggggcgggcgcaccccgcaccgcaccactcccatagggcaacgatagaaggatgcacccagcgtcgggacgtcaaggggctcacaggaactgcccaagcacaaccgggttcagccctgcggtcaggtaagtacccaagaggtggaatacgcggagtgaacatgcgggcactggggcacggactcgcgactccacgaaacaaagactgcgcagaccgcgggggggtcgaacacccaaaacagagaacaagagacagagaagttctaactaaaacacgtggggtgatccgacagcgagagttcggacggaacagagggctagcgcccccgccacaaaagaccgcttggaccagccacacgccacaactgggaacgcacaaagaacacgtgaa

SEQ ID NO: 598094 - DNA, 129 bp, Homo sapiens
  misc_feature (88)..(89): n is a, c, g, or t
aaaaactgaaccttggggagccaggtgtgttgttcacacctgttgtaatcccagcactttgggagggtgaggcaggagcactgctcgnncccaggctgggcaacatagcgagaccttgtctctatttac

SEQ ID NO: 598095 - DNA, 243 bp, Homo sapiens
ggactccccttctgggccaggacagagcgaaaatcgaccggcggggggcggtgcaccttcctctcttcctcagacacagtcttgggcttcactggccgctgcaggtgggcacggaaatccatcggctcggcggggatctccttcaggtcgtcttccgatagggtcttggtactcaccttcttccccaggaggtctgggaagtccagcggctccacctcggggggggggatcgcctcctcaggg

SEQ ID NO: 598096 - DNA, 643 bp, Homo sapiens
ggagtgcatgatttatacagtaaagggcatctgcctattatatcatcagcaaagggtatgaagaccagctggaagcctggaggagtcacctgaatgatcgggtcatccaactcttcttcctgtggcaccagagccacaaaataaggagggatgttcctgcggggtgtgtatctgcacaatgctgcaacctccttctccagacacttgatgagcagagcactgaacagggtggagctcccaatcaccagcgactcctctgggtacacgaacagggagggcctcaggtaatggtgtctctacagcagtaccaacggcttgaaacccatgagcatcaaagctggatcatcaaaccgtgttagctcttctgtttcctctttctccagtataatctgacgactcccatagatctgagacctcttggtatcgctaggcagaagcaaaccgcctgtacttgtattaaaggtccgggtcttggtgtacactggttcatttgtctcccgatagagctttattggaggaggcttgagagccttctggaccagattataaatgcccacagagatcactatatctttgtggagcttcagcgttaacctggtgagtgatcgcttcctggtctcctgggggcgaccttccgcgaagg

SEQ ID NO: 598097 - DNA, 327 bp, Homo sapiens
gttagccacgccccctagctatgctggagtcagcctttatctgcacttctgcctggtgtatcccaggctaggcttcacacctagtacataattaaaatcccaaatttagcaacttttggtgaaaaaccttggtaagagtcaacattataacatgtaattgatactactgaagaaacagttttatatgcaattatgtaaagaaagtgaaatggccaggtgctgtagtcacgcctgtaatcccagcactttgggagtccgaggcaggtggatcataaggtcaggagattgagaccatcctggctaacatggtaaaaccctgtctccact

SEQ ID NO: 598098 - DNA, 461 bp, Homo sapiens
gtgtttgcgcctgttttaggggacagcccagagcttgggtgcccattatgtggccccacccaatcaagggaagagggaggaatgttggattgggggcccctggagccaaatggcaagagggtgacagtttcctttcctgtgggttctttgtccggttcctttaaaaaaaatggatgcccaggggattcccaccccgggtttggggtcaaaaaacagccagcaagagttaggggccttagggcattgggttgttgttccattaaagccgatttgggcccgggcccttaatggttttttaagctttttggggcctttccagtttgcccctgtcccccccctccaataaggggtctgggggcaaacactcccccctcccccttcctttttccccccctattgcggcccctccgggcctgttgttatagggcctccctgtttgtcaataaacaccagttgaagca

SEQ ID NO: 598099 - DNA, 838 bp, Homo sapiens
  misc_feature (1)..(1): n is a, c, g, or t
  misc_feature (73)..(73): n is a, c, g, or t
  misc_feature (97)..(97): n is a, c, g, or t
  misc_feature (713)..(713): n is a, c, g, or t
  misc_feature (752)..(752): n is a, c, g, or t
  misc_feature (833)..(833): n is a, c, g, or t
ntgtttgtaatttatggcaatattcagacaagtagttcacaactgcatgtatatggacagtttcagcatatgntcccgtctcctgccggattaattnctgccactacacgacccatctgaccctcgccgttgtccgtcttgcctattgatagtgataggataataaatgagaaaacacgaggtatgaagtattagaaagataggaagctaatagcaaccgtcgtatcctacattcactacatacattaaactttcgttttttacttcttacgctctttttttagttaattatatatgatggagtgttttgcttgaggacgcagggtatgtctcttctcgcgaagctcagtcaagataatcctctcctctcccctacttcaatctatcccaattcctttatcactcttacgtttactatctacttgtatttttatattatctcccgacgtcttctcatattcaaacattttccctccaccacattatctcatctctctcctctattaccacaactatattatattctttactctttctctttacgtcctattctctgtttcttttatacatcattttacttcttttcccctaaatcatatttttctagagtacaagtgtttctatatcttcccttactctttttatgattcatcttatgttatcttcaggagtggcaggatagcagatgcaccgcagcatattgagcggctcgngctcacattcatatgttcttgctaataatcaatttcatnacattatgtggatatgcggtagctgactgcgcgagacatcgctctcctcgactcaactagccacgacgtgatgacagtcangcgcg

SEQ ID NO: 598100 - DNA, 606 bp, Homo sapiens
agcgggaacagtcacttcaggggccataacttgggcattctgcatacaagtacacaattctaagaaccacaggcaaactgggtccctgacctcacagagctgacaatctcacaggaggaagaggcaacaagaaaatataattaagcagagaacccagggggtactaaaggataccttcttcgctcattttttttcatttttaaaatctaaagtataatttagatgctttaaaatacaccaatggacatgtttcattagatgaggttggacaacggtatgcataacatcaccctcatgatgaaagttcccacatgcacctttaggcacttctttccaagcatactttgacttctttcaccatagattcattatgtgggttctcggatttcagataaatggaataatcgtaattctactttttaaaaaggtgaatcaggcttctttcatttaacatgttttggagatatattcatataccaacagtttattcttttttactgctgagtagtattccatttaatgcatactacaatccattccccttctgaagggcatttgggtggtttcggggggaggaaataataaggctgtacattcattcttata

SEQ ID NO: 598101 - DNA, 253 bp, Homo sapiens
gtggaaatagatggggtatggtacttaacaaaaagggcacaggctgaaaggattggcttctggataaaaagaatccagactctaggacagcttataccctgatgtacacctgcatcattcctttcccttcaccccaggaggtggaacgtccagaaaggtctgcatttcacagcatgagctcacctggctcacatacacgatcagctgagatgcagcaaacaagttttacagtgcagtttttgggaaccttggg

SEQ ID NO: 598102 - DNA, 748 bp, Homo sapiens
  misc_feature (257)..(257): n is a, c, g, or t
ggcatgagccaccacacccggcctctgctttgttttttaaaaaaaaagaaatgcaagagagggagggaggcagcctcctgaccataaaagctgatttcttgatttttgggtctttttttttggaacatggagtctggctctgtctccaaggctggagtgcaggggcatggtctcggctcactgcagcctccgtttccggggttcaagtgatgtgtcctgccttggccgtgagtagctgggattactggcacccgccnaaggcccagctaattttggtattttagtagagacagggttggatggtgtggacaggctgtctcaaactcctgacttcaagtgatccacccgcctcggcctcccaacgtgatgggccctatagacatgagccatcgtgctgtggccttctgtgatctgtgaatacggggttggaggtgaaagcatttcatgaaaacttaagttcatacacaaagagcatcatgaataatttctaaaagaggtatctgtgcttttggtgaccacaaaatatacttcttatgaaatgtttcccctagtgtgaggaaaagttcattattaccttaaaccgtccttatttttaagatttcacatggtatttggttcgctccagaatcttctggtgcctggtgactaagtcctatatgctgaggagttcaccttccttagtacccttctggatgtgacctcgcgctaggaacattgcaaatgtgggcctgcactcttttggccatag

SEQ ID NO: 598103 - DNA, 123 bp, Homo sapiens
aacgctctccccttcctcttcctcctctccctcctctctgaatgccacggagcacacagttgacaggaaggcaacacatgcaatcacaaacaatgaacaactctacagacaacaaggtttggt

SEQ ID NO: 598104 - DNA, 274 bp, Homo sapiens
cttcacagactgcgcgacggtatgatctgttgcctgaggcctcctcagccatgtggtaactgagtcaattcaatctcattttctttatacagactgcccaattcttgagtcagttctttataacagtgtggcaatgagactaatacacccacctactcgggaggctgaggcaggaggattgcttgagcccagcagtttgagactgcagtgagccatgatcatgccactgcactccagcctgggcaacagaatgagatcctgactcttgtctgtc

SEQ ID NO: 598105 - DNA, 299 bp, Homo sapiens
gactgcccaggggccgacagcgcccagacgggcagaggggctacatgtcagggatgcccgaaccagaggctgcgcgcttctggagcgggggccactccggacacagctatataggaaatcaaaaagaaaatgaatactgtgaaacacacaatctgggtgttgactgggaaaggcggcgttgggaaaagcacattcagggcccaccttgcccatggcctagcataggatgaaaacacacagattgctcttctagacatcgatatatgtgggccatagattcccaggataatgggattgga

SEQ ID NO: 598106 - DNA, 116 bp, Homo sapiens
cgctgtaccagttgacgtgaggacactgtgaagcatgcctggtcccccatgtaaggatggcagcagccccaaagtggaattcagcaatgcccacggtatactgctggacacgagtc

SEQ ID NO: 598107 - DNA, 309 bp, Homo sapiens
  misc_feature (139)..(139): n is a, c, g, or t
aggaccgtgtatgctgacaggtgatgagcagagaataagtgtgaaggagagatggggctgtctgagagttcgtctgagatctagaggagagggtccctaaatttctgagtcggagaatcccctctggagaagaggttgncccagagtcgaacatctctgatctaactgatctgctgccttcattccacttccccacatctgttctttctggtgaggtatcctccccttctctgtgaattatccatgtcctctcttttgccattttcaagaaagtattatttggctattttaaagctaaaaaaatttaaa

SEQ ID NO: 598108 - DNA, 250 bp, Homo sapiens
cccttaatatgctgtctcaattctttattattttgttaaaacttgtgtattgctaatacggaaagagaaagaactgtccaagaacgacatgaatcctggtacagagcttagatatttataaattccttttatgtgtttgtggccactccttaccttataaattcctcccttcccttgggtccactgatttggagggccacaggattggggaaaaagggtacaggggctattattgttttcttctctaaaa

SEQ ID NO: 598109 - DNA, 694 bp, Homo sapiens
aaagacgtctcggtggaaactgccatggtggaaaggtggcgcgcttctcacggctgagttgctgcgcctgcagcacggaagctccccacaggcagagctgcttggatgtgtgagtcatgaagccagagaagccccgctccatgagcagctgactccccgaggccctgtgacctccctcctgtcttgcagcttcctcctggcaccatgtccccacggctctccgtgttggtacgttccgtgcttttcttcttggaaattcctcggtggacctcgagatcttttaccctaaaatagttctgttgaatttcaccctggcaatgtaattgatagcttatcttcacagatgccagacaatggacaactcaccatcagtcctctgctcacctgagacaaatgcactgtctgcatatgcttccctctgcgcctatccgtcttactgctgaccacatgcagcacttcactgaagccagacctaacggcatcagcctgactgttccctctacctgccctctcacatgcgagcatcgtgtatcccgtgaccaggctgatcaaagacccaaaggaatgcaacagtttatctcttatctactatgactgcgagctgtccaacaccccagttgttgcgcctttccagacagaacccagtcgcacactcttacaccgtattaacttgatgtccctgtgtcctccctaa

SEQ ID NO: 598110 - DNA, 537 bp, Homo sapiens
atgggggaagaaaactgaccctaaataggtataaatgccttatgagctattgagagactgaagtttagctgcatagtggacctatagaaaaatctttatgtgcccaaatatagatttctcatattcttaaggactgtggaacataatatataatatgggaaaaaaatattttatcagctctattgaggcatgatttaaaaaattttacattatttactaataaagagaactgtattttatttttcatttactattccttgtggtcttctatctagttgttcactgcctcattgcctctctgattttcaaacttggaagttattgacacgcgtctttctggccctctcctctggagcacctctgctgccaatttttttctgccatttttattttgtcatttactttaaaaaaaaacttactgaggtgaaattcacatagcatgacattaaccatgttgaaatgatcaatttagtggcatttagtactctcatagtgtagtgtaatcaccatatctggttctgaaacctttccttcact

SEQ ID NO: 598111 - DNA, 111 bp, Homo sapiens
tcataggaggcttcattcactgatatcccctattctcaggctacacctagacagactacgcaaaatcattcatatcatatcatcgggtaattacttctcacaattctcggc

SEQ ID NO: 598112 - DNA, 104 bp, Homo sapiens
cgctcagtgttgcaagcagagcatgagtctccccacaaggacactgtctgtatgagactctgccaggagatcgcactgcacagcggacgggaaccggccccaga

SEQ ID NO: 598113 - DNA, 454 bp, Homo sapiens
  misc_feature (89)..(89): n is a, c, g, or t
  misc_feature (106)..(106): n is a, c, g, or t
  misc_feature (139)..(139): n is a, c, g, or t
  misc_feature (294)..(294): n is a, c, g, or t
  misc_feature (308)..(308): n is a, c, g, or t
  misc_feature (337)..(337): n is a, c, g, or t
  misc_feature (345)..(345): n is a, c, g, or t
  misc_feature (353)..(353): n is a, c, g, or t
  misc_feature (362)..(362): n is a, c, g, or t
  misc_feature (367)..(367): n is a, c, g, or t
  misc_feature (390)..(390): n is a, c, g, or t
  misc_feature (407)..(407): n is a, c, g, or t
  misc_feature (424)..(424): n is a, c, g, or t
  misc_feature (435)..(435): n is a, c, g, or t
  misc_feature (451)..(451): n is a, c, g, or t
aaaagtgccgcgaaaaaatggatgagttgcaatttctctcgggatggcgcgggtggtgtgtgtgtgttcccacgggccccggagccacntccgcggagggcacgcngcgcggtaggcaagcgcgagggcccagcggcgngggaggacgacctcgtatcccgcgtccccgccgcgctggatccggactgagcggccgggcctgcggacttggaatgtgcggggcctggacttgcctaaggatttcccgaccccgtacaaaccaagttgccctcttccgagctaaggccccggccnagaagcgccttaanttcgaagttcggattccgtgtttggggcngggcgttngggttttnggggggganggttncccccaagcccaaggattcgggnacttaagttgaagccgnaaaagggcccggcgcgncttggtaaaanccttgcttggcccccncgc

SEQ ID NO: 598114 - DNA, 200 bp, Homo sapiens
  misc_feature (21)..(21): n is a, c, g, or t
  misc_feature (38)..(38): n is a, c, g, or t
  misc_feature (58)..(58): n is a, c, g, or t
  misc_feature (85)..(85): n is a, c, g, or t
  misc_feature (116)..(116): n is a, c, g, or t
  misc_feature (121)..(121): n is a, c, g, or t
  misc_feature (140)..(140): n is a, c, g, or t
  misc_feature (169)..(169): n is a, c, g, or t
aaagtaactctgtcctaattnctagaatctgtgactangttgttacatggcaaaaggngctttgcagatttgattatgttatggnccttgagatggggagaatattctggattgtntgggnggacccaatgtgatatggnttggaagtgtgtcctggcctaaatctccngttgaattgtaatccccagtgttagaggagg

SEQ ID NO: 598115 - DNA, 104 bp, Homo sapiens
atcccaaacttttattgtattcctaagtctcattgaacgacctcaattccacggaatctggtggcgcttaaagtgtacgggcattttacgagtctcacggaagc

SEQ ID NO: 598116 - DNA, 123 bp, Homo sapiens
cagtgactacagcgaaagccaggaccctaacctgtttctctccattcggtgctctggtaacctcccgttgtccacagatgagctactttattttcgctccagcgtacaaagcactaacagccc

SEQ ID NO: 598117 - DNA, 89 bp, Homo sapiens
ccacgcgtcgcccctctcctggggatcttaacggccttgttctctctccctggcacccacccccaggcgggtgatgccgccaagagaga

SEQ ID NO: 598118 - DNA, 298 bp, Homo sapiens
gtgacatcgtctttaaaccctgcgtggcaatccctgacgcaccgccgtgatgcccagggaagacacgccgacctggaagtccaactattccctaagatcatccaactattcggatgattatccgcaatgtttcattgtgggagccagacaatgtgggctccaaggagatgcagcagatccgctagtcccttcgggggaaggtcttggttctttagggcaagaacaccatgtaggcaaggcatcccggggcactggaaacaccgattttgggaatcttggtctatatccggggtatggg

SEQ ID NO: 598119 - DNA, 849 bp, Homo sapiens
caaaatatattgaaacgataggtacttactgtattatctgagtatttcagtgtcctacttcgaagtgtggcagatttgctcgggtttcacattggagatggcgtgggaagtagaaatgtcggagaactgtgcaagataggcgcgttcgacgtagtcggagtgaacacattgacacctagcctttaagactgatttatctgtgggtgtactgaaggtttccatgtaggacttcgaagatgtggacatacaggaaaaggcagctcaggaaaagtggggcatgctctggagagtcacgcgttgtggagttcggacatgtccgtaggagctcggctcccagtgttgtgttcctcggtcgaaagggtctctgctgtattggggactcgactggcctctcctagggactccttaggcgttgtgaaccccacgctgttggattctgtatcattattgctgaattctctgcacagttttccctggccaacctgcccacatccttggagatttgctttgccagtgggaatccttacatggctgtttcacagtagacgggacgaggtcagcgggagtcgtgctcctaacacacacattgaacgaaacagaagatgattgaaagtgtgaggaggctcgtgtgcaagggagaacagggttactatacatattagtgtatatatatacatacatatatatatatatatatatggtcatatctcagatgagagtcaatgcaaactaggtgcacaactgctgacattcagagtctggattgaacctctctgtgcccattatctctgaccgtgcaccctggtccagcgagcttttgaaagcctgaactgtcaggcactacattcc

SEQ ID NO: 598120 - DNA, 1030 bp, Homo sapiens
ggtgggctgtcgcaagggtggtgggcctcccaggaggacgtatgtgcgcccctgtgtcactgccctcgctcctgcagatggtgcggctgcgctccgtgggtgctccaggaggtggctcccaccccagcactgtggtgccatcggcccccagaaaccactgcgaagggccctgtcagggcgtgggccagccagtgcctgccccctcctcagggctccatgctgcggtccgactcaaggactgcagctggcgcagtgaaggcctctcaagtgctcagcccaactggaccgcctgagggagagccacggctccccagtcccctgcctcaactgtgcagtttcatcttctccaagggctctaggaagctgagctggagcggccgtgtcccctgagaccccaggtgaacctccagacggaatcttggtgtgcacgaactccggaggcactcttcagacgcatgcgggccaacccaggggcccaagaggaatgttcacctaaaggtctacacccacactgtggaccgaaaagcagtactgtgcagaggtccgcgccacgccgatcataccacccaagtaaggccttcgagctgagacccctatatggctctaccaaagcaactggaggatccatccaactcgatgaaaggactagacgagagcgttggagggagaattgggcagtggacatagagaagattggtgcccaaatggaccataatatgtagagcctagatagcctcccgggaaaagatggctagaagagaggacagacatgactcgagcagaagtcaagcgcagccagaggggccagagcgctaataggcagctaggaacgtcgagagtaaatagtgctagaacgaaggagaatgagcaaaagaagagattaagtacagacagtcacgatcgacatgaggcacaggagaagaacggcaagagacaagtcgcgaggccgcacgacggggccatgcggcagtggacgagaggaagcaggactcaagcaacggacgagtagaacgacaacctgccggagaaa

SEQ ID NO: 598121 - DNA, 729 bp, Homo sapiens
  misc_feature (483)..(483): n is a, c, g, or t
ggctcgtagctccgggcactcagacatcatgaggtggtcctcgcaccctcggaattaaattctctactggtatgctgttggatttctctcttcatcatgtgtcgcatatggagcgttccagagacaactgctgcatggtagatgaatgatgcggtaggtattgtgcaactacctgtggccttgcagatttgctggctacttatcaagaccaacgtacacaaggatctacagacttgtggaagacatcctcatcaagttgctgacaaagcatcataagtcaaacagctgataaaagctatacaactcactgataatcctgatgaatcatcagaaccaaatatcatagacgctgctactttgaagcaccacttgtgacaagaaattatgaaatatgaagcatcgattttaacacatgactgaagtattcgatattcgcaggatatatataattcacataatcaaccttagcaagacaccgcgcanatgcatgatatcactgggaaagattgccaagacattgccaataagggagctaaacagagcgggcttgactttattaaacctctgaaagctaaccagcaattcttagtctactgtgaaatccatgggtctggaaatggatggactgtgtctcagaagagacttgatgggagagctgatggcaagagaactgggttcatgtaaagacgatttggcatctgtctctactggccaaagttttggtgggtg

SEQ ID NO: 598122 - DNA, 831 bp, Homo sapiens
cctggagcgagtcagagtgtcagtgaagtgtcaggccacttctatatgggacggcatgctggccggacatgcttattcttcagtattccccgttcgaaagccccgtcaatgacccgttgtcccggagatcgggcccctgcgtacaacattcggtcaacctgtagcaccatccgtacgcgtcatgctccagttctttgtgcacgttcctgagccttgtctacctgtacccgtgaggcccaggcccggagcccgcgagaagcaggagcagttcgtggacttgtacaaggagtttgagccaagcactggtcaacagcaccgtctacatcatggccatggcaatgcagatggccaccttcgccatcaattacaaaggcccgcccttcatggagagcctgcccgagaacaagcccctggtgtaggagtctggcagtttcactcctggccatcattggcctgctcctcggctcctcgcccgacttcaacagccagtttggcctcgtggacatccctgtggagttcaagacatggtcattgcgccaggtcctgctccatggacttcatgcgctggcgctcataggccgaacacgcgtcctgcagttattcatggggaccccgaagcatgataagtgctattcttgagatggctagtgctggtactccacatgctcatcatgtgcgtgacacgctgggcgggaaccgcacttacagggccccgggagggaactctgccctctaacccccctacgagcaaggctagtacagtcatcgcccttggaagactgagctgggacccacacagccatccgtgtactggccagcagaacaagcccc

SEQ ID NO: 598123 - DNA, 372 bp, Homo sapiens
  misc_feature (61)..(61): n is a, c, g, or t
  misc_feature (98)..(98): n is a, c, g, or t
gctgagtcatagattttgaaagaagtctgtccttaaggcattaatgtgttgggtgatcatntaagaagtgattctgctggtcacggtgggctcacacncttgaatcccagcactttgggaggctgaggcgggggatcacctgaggtcaggagttcgagaccagcctggccaacatggtgaaaccctgtctctaattaaaaaaaaaaatacaaaaaattagcctgcgtggtggtgcgtgcctgtaatcccggctactcaggaggctgaggcaggagaatcacttgaacccaggaggaggaggttgcagtgagccaagatcatgccattgtactccagcctgggcatcaagagtgaaactctgtctcaaaaaaa

SEQ ID NO: 598124 - DNA, 1671 bp, Homo sapiens
tacttggcctgtaaatggctgggtcagttgccgctcaggcgttatcgcagatcaactctgcttccctgaactggtgtgcatatgtctcacccatgcgcatagctgaagtaacttgctcatcctgtcgagatgccaggaagcatctgttatctcatgtcatagaagagtaaccgctcgcaaatctgctccgcaaagaatccgtgaattggcctctcgctgagggtgctgtccaattcaggatacacgtgagtgatgcagaccgtcgatataacatttcatgactacgcacggatggtcacgcgtcagaccctaggtgatacccgcataccgatcagagccttggtagcgccgtcattaacacaagaggatcatcgtaccccttactttggggaatagccaaacataccataggactggcccccgtctggttgatacgcgtaaaagacacagcagtccaaaggcaccgcctggatagaggaaagtccccagtgatatttagacagaggggccactggcaacgtgtgaatcaggcaatttccggaggtacaccccatttggtgcacactgtacggggtcgcgaaattcatggcaaagtacaatcgcgaagatgttcaccctgacaataagggttggcacgatgtgacgacagcccgagggaagcagttactccccagccattggggtggtacaccgtgggtcattagcaaggtctaggcgagacggccaagcaatgatgccattacaaaacaggctgatcccttggtggaataggattggaagacctccaaaaagaccccaattggccagcaacataatatgaatgacttcggaaagtcgccacctaacaaatcatacggaactagtcgcatggaaccgtcggaacgtacttccaacaatggaatgatgctgagacaaagagacatagggtagcaatcatttatgtacagaggtcaccgctggtgaccacactgtcgcaaccggaattgtggccatattggcacccacaccagtgggcaggcgcacgaaccccgcaaacagtttcaagggactcccctacacgccttccatgagtaacatctccgataattaatgctcctgtgacgcagttcttaacgaaagtgcccctcaagtgacaccgactatcgaggaccaggtgaacaacataggggtacagagacattaccagtgacaaacaaactccctgtgcacagggcaggcacccctgtgtgacagatctaaacggctggtgtgcgcacctgatcaacccaactgggagtaggacactatggtcaagagaacgaacgtgccacacaagggtaaatatgagcaccgcaacgagacgaaagcgcacacgaccaaagagtgggaaagacagagaaccagccagactcgaccagaccggaacaacagggagcacggagggcaagaaacaccaacaacagcacgcggagtaattggaacaccagaggcatacaacagcggcgcggaaccagtgtgagaagacgaagagcgaccgaacaagaacagcagtgaacgaagggcgggcgcgcggcaggagaacacacaagacaaatgcgggcacgacccaagatgaaaaaacgcagcaaggcgacgcggaccaggcgtgcaacaaaggcgggcagaatcaaagaagatgagccgcaagcaaca

SEQ ID NO: 598125 - DNA, 499 bp, Homo sapiens
cgatgctttattaaagaagtttccaccgcctgggcgagagatgccccaccgacaacaacgcgccgttgcgcagagagaaaattcccctcttttcccccccccacaaaaagtgtctcccccaccagaataaatagccggcgtttattttcacgcccactcttgttgaatgcgcgaaattttctaaagagaagccccactcaagagaggattatttcctcctccctcacctccctacggaaggagaggaggggaaaaaaaggagagaacacaaatatattcctcggaaggcttctaacccctgaatcacgaggagattattttaagatagaatcccccccccactctagggaaaatccttaaaatttttgaatcccccccttttccccccctccgggccccccccccccccttggggggaatttccaaacccccgggggccccttttaaataattttttttattggttttttttttttcaaaaaattgggggcacccccca

SEQ ID NO: 598126 - DNA, 133 bp, Homo sapiens
  misc_feature (28)..(28): n is a, c, g, or t
  misc_feature (31)..(31): n is a, c, g, or t
  misc_feature (42)..(42): n is a, c, g, or t
  misc_feature (49)..(50): n is a, c, g, or t
gaagggaatagacccaagaagccaccgnctncatccgctccngtcatcnnacaggggcaggcaccactgagagaaaacatgaaattaaaaagatacctcctgaaagaccagaaatgcttttcaagaactaata

SEQ ID NO: 598127 - DNA, 147 bp, Homo sapiens
  misc_feature (73)..(73): n is a, c, g, or t
  misc_feature (78)..(78): n is a, c, g, or t
  misc_feature (81)..(81): n is a, c, g, or t
  misc_feature (135)..(135): n is a, c, g, or t
agaaaaataaaatcatcagaacagagtctacttttctacccaataaaaatctcacacactcttcttccttccnctaanatnggaggacctgtttttcccttctgaagtcagtccttccatctgtgctttgaagcnattctcctccta

SEQ ID NO: 598128 - DNA, 328 bp, Homo sapiens
cggaccggtgatacctttgtctctactaaaaatacaaagattagctgggtgtggtggcacacgcctgtagtcccagctacttgggaggctgagacagaatctgcttgaacctgggagacggaggttgcggtgagctgagattgtgccactgcactgcggcctgggtgacagagcgagactctgtctcaaaaaaaaaaaaaaatttgtggaggtttagaaagcagtaggataccaaagtgctgaaagaggccaggtgcagtgtttcataccttgtatccagcactttgagaggccaaggccagaggatcacttgagacaaagggaaaca

SEQ ID NO: 598129 - DNA, 183 bp, Homo sapiens
  misc_feature (176)..(176): n is a, c, g, or t
cttctgggacggtgactcagaatctttggttgaggccttttttgctttcttcttcttttcttttttttctttgtctttttttctcttgtcggatttcttcttctccttcttgctctttgggttgctttgatctccaccttcaaccgtccccatccccttctgtcgtcttctcgcanccgtata

SEQ ID NO: 598130 - DNA, 130 bp, Homo sapiens
agacagagaatgaacccgagcaggagaagaggagaggagacagccacaagaggacgttgttcatgaggaccatgtgaaagaagccgccggctccgcttgtcattgagagagagaggaaatgggagcaaca

SEQ ID NO: 598131 - DNA, 371 bp, Homo sapiens
caggacagtcttttgtgtactatgatatccatattaccagaactgtgattacaatatgcaaagagtcataaatatgccatttacaataaggaggaggcaaggcaaatgcatagatgtacaaatatatgtacaacagatttagctttttatttatttataagtgtaattttatcagcaataattctcgggatttgagcaggatctaacacctatttttctgtataacatattattctgccaaaagtttgtttatacttcagacagtctgactactgctgaatcaaatcttaacatgctttgtttaattaaacaaacaaacaatcaccacaaatccaagcacatgaaagatatcagttcaaacaaatactgta

SEQ ID NO: 598132 - DNA, 961 bp, Homo sapiens
cccacgtgggcgcgtgctgatgacagtcctcatctgagaggactggcatcctcatcgcctctctggacagcgtggacccgatcctctccatgttcttcctcatgtgctacctgttcgtgaacctggcctgcgccgtgcagaccctgctacgtacccccaactggcgtccacgcttcaagttctaccactggtgaggccactcagcacgggcgtgaggagccccacaggctgggacactgggtgcctctgccactggtgagccgctcagcacaggcgtcaggagccccacaggctgggacactgggtgcctctgcaagccagctgctctgggcctgaagaccccagcgcgtccttgactgttcctttgcggagtaagcccctgcgcagctgatgagactgcaactgaggaaggcctctgagttacgaggatgcccaggacccttgtccatttctgggtcatgagcctgtgcatggacgctgaatgttcatattgctcctggtactacgcgctgtccgccatgctcatcgctggctgcatctagcaattacatcgagtaaccgcggggccgagaaggagtggggccgatggcatccgtggcctatccttgaacgccgaccgctacgcactgactggagcggtggaggcacgggcacccccccaacagaagaacgggagggcccatggtgatggtgatgctgcaacaggaagcggagaaggcaggtgaaggaaccccggccctgggtacatcgggtgcaaggtaaggccggcagggcagacaacgggggacggacggaagagacgtacggacaagcaatggagcttaagggaacataagacaacgggccaatgacacaaacacaacggctggcccgtgggctgtacctggcagggccccgtcacaagaggcaggagaaacaaaagtgaggacgagcacagaacaccgacacacgcagtggacac

SEQ ID NO: 598133 - DNA, 336 bp, Homo sapiens
gaaagggtttttaagtggggttttttcccccaaaggggcccctttccccttgtttttcgggggggaaataaatttttttttccccgttttgaacccctttgaaattccctaggggaccttggaagttgtggggtaaaccaaattattttgccccccaaaaccaaaaaaggtaaatttttttggggcccccccccttgggggagccaaaaaaaaaattttttttaaaatttgtattttgctacctttatttgggttagtaaaaatgggcccagttttttgttttttttcccccatgaaatttgtggtgggccaaaaaccaaaagcaatggggcccca

SEQ ID NO: 598134 - DNA, 209 bp, Homo sapiens
accaggactgctgagacatttaaaagaactacattttaggctgggtgagtggctcacgcctgtatcccagtactttaggaggccaaggcaggagaatcgcttgggccaggaggtggaggttttagtgagccgagattgcgccactgctctccagccagggtgacagagcaagactccgtctcaaacaaacaaaaaaattgctccatctg

SEQ ID NO: 598135 - DNA, 714 bp, Homo sapiens
  misc_feature (176)..(176): n is a, c, g, or t
taaaaagaaaggccttacattttttttactgaatccagccaaccaagcgtgttcataacagattcagagaggaaaacacgtcgaatatctccagataggtggtgacatttttcagctttgatatggtaacattgactcggtgacctttcagaacagcattaaatattgttgtgccnatttcatgtgtgtgcaattcctttattaagacccagcttgtggttcattctcacaagtggtctcctttgtgtgggagttgtgataccgtgtatgttttatttctccacgtgttttcattcgcgaatctccagctggtggggcaatgtgggcaccgatttgtgtggctttgtggttctcgtgtgggccgaggaatctgcgctataatctcctgtgaaagtctcgtgtgtgtgagagaagagacacatgtgtgcgagagagacacgcggagagtgtctcaaagagacacacacacacgcacacagcagtatgtgtggccgcggaccagatacagagagagaaagagagacgagacactttagtgtggcacagcgtcgttcgagagtgtgtgcattgactgtgataagcgcgaaaggacccccggtgaagagtagagaagagcggggagggaggccctactgtgggtaatctccggggggggacccccttttgaaggcgcggcccagaggacacccgtgcggcgctgttgataagcgccga

SEQ ID NO: 598136 - DNA, 171 bp, Homo sapiens
  misc_feature (3)..(3): n is a, c, g, or t
  misc_feature (34)..(35): n is a, c, g, or t
  misc_feature (146)..(146): n is a, c, g, or t
  misc_feature (154)..(154): n is a, c, g, or t
canaggcggaccctgactgtgcagacccactgtnntgccgccggggttctggcctgcgcccgcatcccggccaggtgccattaactggggcgaatacagcaagtgtgacctgcccctgaggacctgggagagcctgttgagtgggntgggcgancggacctttttaatatg

SEQ ID NO: 598137 - DNA, 773 bp, Homo sapiens
tgtccccgggaggcggaggttgcagtgagccgagaccgcaccattgcactccagtctgggcaacagagtgagattccgtctcaaaaaaaaaaaaaaaagggaaaaaaaaatagctttatacctcttcatgttgtttcaaccggccatgaaaatttctggaacactccaaatttcaggtggaattaattccaaaacaaattttataaggtattaaaattatttttacttctttatagtaattaggtatactttaaaaaggcctcaggggtatatttatcttctaaacaggctacaatccagggcagctactttaaccaactaggtcctctagtggagaacaacttaggcctatttcactggcgggtgtagcctcagggcctaacttggggtgccaaattaaattatttcgtagaatttacactggattggtaaaaacccattcgttttggtttacaagtggccaaaattctcaaagggctcggtatttattgtaattcttggaaaatttatcatttaattggattcctcagttatggactggctgggtgtggacttagtacataagtcctcatattataaaaacctcaaataatggactggattttacacaacatccttcccttttctacaagttacatttttttacaactcatggggttatctcctaaataggttaatttatcgcttctagaaacatgttcaatatttgtgcttatcagaataatttttaatattccccaacatttcttattttcaagataattctgcgagat

SEQ ID NO: 598138 - DNA, 925 bp, Homo sapiens
ggccagagtttggagatgccatttccacagcctcataggcactctgtagcgtcaccggagccgctgtacacgcgctgcctatcgtggattggtgtctctgaccccgattatccaagctggacaggatagggctcgatggagcccaagatagatattgtacgatgcaaaccaggcaaatatccaagatggcctgccagagtttgtggagagccatggcgtgtacccagggccaggtgctctctgcagacaccatatgtggctaaacacacctctgcactgtgtaacagctgtcgcctggcttctgcccgtaccaccaatcctactgccaagcgccagttttgtacagtcagccaaggaggtggccaacagcacagactaatcttgtcacgaccatcaaaggcgctagatggggacttcacagaggagaaccgtgcccagtgccgagacagcaaacagaccctctgcatggaggctgtggacaaatctgagtgactttgcagtcagacctgaagttctcccagacatacctgaccagatcagacctgagggtcgggactgccatggaagaccatatgtgatctctggcaagacaatgtcagagaagtgacagggggactcatccagacagaccgggaccatcgcagacaaatcccccagggaacccacagaagcttggtcaggtgatgagcggacagttacagtactggtctcagaagtccaatcaaggaagctaaattagcaagcatgaagggacaagggatcgcaagggaagatggaattgtgaaaaggaacattgaagctctgaaaaagtgtctacagagacctaagaacaaggattaccatcgatgcaagaaaaggcaagagaggtagattccccggtgaggagaatcatataaaggaaggcatttgaaaagatcaacatgga

SEQ ID NO: 598139 - DNA, 150 bp, Homo sapiens
gacaccgacaccccctatcccgcatactagtaatatcgaaaccatcagcctactcattcaaccatatatccctggcctgtacgcctaaccgctaacattactgtcaggtccacctactcataacacttactggtgagcatccctaatctg

SEQ ID NO: 598140 - DNA, 118 bp, Homo sapiens
atgagagcaagcagcttctcttctcatcaaggaggcagagacccctgtgtggaagccaagtagtgaccggagagagggcttgcatcactgtcactaccagatgagttcccatcacttg

SEQ ID NO: 598141 - DNA, 867 bp, Homo sapiens
  misc_feature (451)..(451): n is a, c, g, or t
agcggattcgtttcacgcgtcccggtgtggctgtgcctccggtcctgtgtcaggtcgcttagctcaagatgcctaaggaaatccctagactccaagatctgccgctggatgaggaggaggtagagacgttccccctttcatggtcatgccattagagttgcccaggcttgactgtcggtatgagtcatcgactatctttctcttacatcgagaactgaaagatagttctgtcctcgtgtgatataggcgtcagttgtcacaagtgcagtctaggaatggcagatcggagcatatacatatcacgtgatatgtaacatgccattgtacctaggaagtacccacgtatatagaatctaggtaactttcctgcgtgggagacacgacgacatggtctattgaatataaacccgttgttactatctctgtaaacctacatatctacaagtagtcncgaagacctttcttttcaaccatagtattggtcgcgtactaccctagggaggacttcgtgaaatttgaaacctatagggaatttgaacctttgcatgtcaactacaccccttgtgatacctagtccgaccatatgatctggcagacccaaatatgctgtgtcgatggacaaagcgtgtgctacgcgctgggctgccagtactctcgtccttgggtggacattgaggcctatgatctccgtggtgtctttgggcttgtctatattctctgtggcgtctcactatatggcgtctcgacttggtagggaaaccaacggtgaaaccctggttgcatttcatccagaatattccacttcacaccggacttgaactgaagcctaaggtacctgcgttgtgggcgaaagttcacaatctagcc

SEQ ID NO: 598142 - DNA, 1000 bp, Homo sapiens
gaagaggtgggatgagcgaatcgaagggcaagattgggtcagcgttaagctaaaatgtatgtgatggctcgtggtgcttaagatgtcattcaacgacataactagatggatagctctcaatggtggacaggatgtgcataggttaataagaattaatcaagaagatcctagattctattgaagagtacctaagtagatactgaatagatagcctctggaggagaattgaaattcattaaattgttgatgggtgcagatgtaatatacaaaaatgattgaggagatatacagtggaatattcagaaggcatgagatggggaaatgtggagccaggcgtattatgcaatggacctatataaaatgcattaggtgatatagggcataacagaaatgagaattaggatactgtctttactattgcatctactatacatttccttgcagcaaggcatatttaaataagagtaataacagtacgaacaatgactcgcccaactaaatgtggacatgagtaagtaggtacactctcatacctaaaaagaataccagtcgatgtatgcaggcgatagtctacatgtcaactcatcccctatttcgaagctgcatcagatactcagcaatatgggttgtgatgaacgaccaaatgttaactaggtgaatatcccaatggtctctcataaagaagaggttggaacgcacaatatagttctttgaaaataactctctctctgttaacctggtagatgaagagtgtgccttaattcaagactctgtggatccagtaaaggtcttctcctgaagtaaatattgggcgtgagggtgacggtaaaaaaaactgtaggggccggggtaagattatagacgcctagaaggggtgaatgatgtaccaacgtgttggggaattcattgtaccaaaaaaaaaacgggggagtaggcaaattgtgagggagaaggggatgacaatagacgaggaggaaatcggtagtacacaaaaaggtat

SEQ ID NO: 598143 - DNA, 613 bp, Homo sapiens
tttttaataacaaaaacggaaaaggggatttctccaaaagatataaaggggagaccccggttttttccagtgcaggtttggaacccgcccggttatttgaaccccccccccaaggggggttgggggccggcccccccccaaggtttttttttacaacgggtctatttagggggcattcatcagcatttatagaaccaaaagtggtagggacaggatctctagcactggccagtgggtgttctagaggccaggtggggttgaaacacaatggtctgaactcttcggtgggtggcagtctgtgttccaagtcccacaaaatagctcaagaagttagccagttccgttccacctttcttgaggaggggtgtcagctgctcctttttctttacaaagtaagacttggcctcggcataaagttgtgggctcttcaccttccacagcaggtccttacaatagtcagtcgcggtctgaaagtattgagaaaccaggctctccacacatggctcctttgcctgtctcagaaaaaaagctccttaaagtctgcagatgccacgcagtagcacagttctgagagcatcttcatgttggctcgtgcaatattcctgcagccggg

SEQ ID NO: 598144 - DNA, 200 bp, Homo sapiens
  misc_feature (94)..(94): n is a, c, g, or t
  misc_feature (120)..(120): n is a, c, g, or t
  misc_feature (151)..(151): n is a, c, g, or t
  misc_feature (166)..(166): n is a, c, g, or t
ggtgcaggaggtggcagggaaacaaatgagccaaaatgcttccacaggtggggtgtccacatgtctgttgacaggagccctgagctattctcanccccactaaggactctgaaaaagganaatttgggacacaacaggcagggcctcgcantccccatctaagcanatggaggagtccgcctacctcaactgtgcccagg

SEQ ID NO: 598145 - DNA, 367 bp, Homo sapiens
tttgcagttcggtctcctggtgtacggccaacgccaagtaggggattgcgttccctccagtcgcagccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatcttgggtggacatgttcaagctcgaaggtgtgggaaaaataccttccggccatccatgg

SEQ ID NO: 598146 - DNA, 874 bp, Homo sapiens
aagagtggtatcaacgcagagtcgccattacggccggggggggaaaaaaaaaaaaaaaaaaaaaaaaatttttgggcggcctggccctcggaaaaaggtttttaaacccttcggttgggggcggcggggccccaaggagcggtaacggtcgaaccgttggtcaatgaagggggctacacaaagagaacaccggggacaacagagcaaagacgggcgtggaaatttccacacgcaatataaaaagaaggccgggggggaacaccccgagaaggtattccgggaacaaaaactcccaagaaggagaagctcggagagcggacaatcagggggggaacaaaaagcacacgaggagaactccacagaggaaggcgccgcgaaatactcaaaattgaagcccccgagaccgtgggggaaaaaaacaaaagaaaaaaggaggagggggacggagaggaggagcgagcgagagagagaggagagggggggagaggcggggggcgaagagggggagggagagaagagaggaggaagaaggggagagagggggagaggaaggagggggaaggaggggaggggagagaagacagtgcacggagcgggcggggagaggagggaaaggaggacgagggcgcagggaaaaggggagagcggaagggacagtggaggaaagcggcaaaaggaggagaacccgaagaggcgaacggagcgaggacaaggcaacaaagacggagaagagggaggggagacgagggaaagagaagaaggagaaggcaagagagagagacagggagagaggagccgggagggggcagaggggggagagcaagacggggaacggaagaacggaggaggagagaaggagagagcggagaaaaaa

SEQ ID NO: 598147 - DNA, 487 bp, Homo sapiens
  misc_feature (67)..(67): n is a, c, g, or t
  misc_feature (75)..(75): n is a, c, g, or t
  misc_feature (78)..(78): n is a, c, g, or t
  misc_feature (81)..(81): n is a, c, g, or t
tttgcagttcggtctcctggtgtacggccaacgccaagtaggggattgcgttccctccagtcgcagngtttcccnctngtngcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatcttgggtggacatgttcaagctcgaaggtgtgggaaaaataccttccggccatccatgg

SEQ ID NO: 598148 - DNA, 378 bp, Homo sapiens
  misc_feature (28)..(28): n is a, c, g, or t
  misc_feature (33)..(33): n is a, c, g, or t
  misc_feature (118)..(118): n is a, c, g, or t
  misc_feature (120)..(120): n is a, c, g, or t
  misc_feature (136)..(136): n is a, c, g, or t
  misc_feature (159)..(159): n is a, c, g, or t
  misc_feature (191)..(191): n is a, c, g, or t
  misc_feature (194)..(194): n is a, c, g, or t
agcccagcggggcaagcggggcctggtncgctncacagaccaccacaaagtcccatggggttccaagaagccattgcccagaacgcccttcccagcccctggaatctcccttgaccancngagctgatctggcccntaacgcaggccacggaggccttntgtcgggcagcttcaggccactggcccttacnaangccgatgcattattctaagacgattaatccgtgcatgctctggggacagcagcgttcccatttcagagcccgcatcctgtatttcctcgccgcctccatcgccccgggcaggcgctgaatgactcgcgatgccactgtcatttttataaagccttgttccgggtaaaaagcctctttgtttcat

SEQ ID NO: 598149 - DNA, 114 bp, Homo sapiens
gaagtcctgacactcgaatgtgtattcgttgtccttaccttctggcgggatatgctgttcgaattcataagaacagggaggttagaagtagggtcttggtgacaaaatatgttg

SEQ ID NO: 598150 - DNA, 196 bp, Homo sapiens
gtagtgacttatatgggattctagaatcaagagcataggcccttagccactctgcttcacctcagagggtcttcctattgagaggacgccgtggagagaggaagaagcaggatattcactcttagcgaactgagaatttgtgcagttctttcctctctgcctttcacggaaaaggcagttcttatacggagacacc

SEQ ID NO: 598151 - DNA, 848 bp, Homo sapiens
tatgctttgtagttggatatatggaggatggggatatagctaggatgaggatggatagtaatagggcaaggacgcctcctagattgttagggacggatcggagaattgtgtaggcgaatacgtgacactactcattcgggcttgactgtggggacggggtgtctacacggggttggcctacgggtactaacttgtcctggggtaggcctacggagctgtactggtgacgaactacgtgttaacttgtcctttaacacggccgacaacggggaccaacaaccgtaaaccgcgagcgggcaccgaccatcggactcggagagcacacgaccacgcgagcggaaaacggaggcacacagacactccgccacagtgcgcacacggcgtagacataccacaacacagggagagcagagaaccgagaagtccccgacatcaacacgccacacagcactctacggcacgcggtgaaacgatgacgcgaccccagcgcgcacagcaccaaccaaccacgcgacaccgagcgggccactcgccgtaggacacaggtcggcacaacgggggcctaccccccccccacacccccgcgcgcaagccacacgccgataggagaacaccacagaaacacaccgaaggccgactacacgcccacatccgcccacgaccgcaagcgggcaaagaaacgcacaaccgcacagacggacccggcccccaccaacaccacccgcacagcaggcgccgacaacgacgagccgggcccaccaaacagaacccagcctccgacagccccacggcaccacaacacaggccccaagccacacgcgcccacaccaagacacaaccacgccacc

SEQ ID NO: 598152 - DNA, 360 bp, Homo sapiens
tggtgtgaatgtgggatgtgtgggaagccctgtgaggacagagccggtgggacactggccctagtagcccagtggggctggttcaagagtgttggaggctgggcgcagtggctcacggcctaaggtttctttttttcttgttttgagacagggtctcactctgttgcccaggctgcggtgcagtggcacaatcacggctcactgcagtctggacctcctgggctcaagcaatcctcccacctcagcctccctcagtagctgaagcaggagaattgcttgaacccaggaggcagaggttgcagtgagccgagatcacaccactacactccagcctgggacacagagcgagactctgtctcc

SEQ ID NO: 598153 - DNA, 1896 bp, Homo sapiens
  misc_feature (157)..(157): n is a, c, g, or t
  misc_feature (456)..(456): n is a, c, g, or t
  misc_feature (1190)..(1190): n is a, c, g, or t
gacatggtaacgttaccatgtagtcactgatatgagctgatcggaactgactctagtgtctacctcgtggcgttggatcctgtgggtggcatttgcgcgtacgtgtcagtgtctgcagcaatcgcgataggtggcctgtggctgtgagtccttgctngactacttctcggagttgactagcccgtccgcttccgaccgttccggcgatgctggtccgtgcatcacatcacgaacacgacacatcaatcacacacttgagtggcactcgcatgtacgcgcatatgagcctgaactggtttgtacccctatgatacgtaatataggctttgcgcagatcagtgctttagtactatatgtgggcatcccagatcccaaggggtacttaaatctgcgagctttagaccaaagaggttgtccctcagggtggcccaaaacgcagagggaaattaacatacntaattaggatagactacactaggagggtcgaagcatttgagcactcgggacaattggagaggcagtacacggaatagctgaattagggctgtatctgacaatccctattgtttaggctgttcgcccgtcatggtgagaagctcgaatcgtcgtcgctcccattcttattgatcccggggcctcaacagacgtctcagagttacgagggtgtaaagacaccatcttaatctagctcaattcgccaattagtggcaagctcaatttgtgcggcacccgaaaatgcctatttggccaataggcccatagccttattagaaagttggccccttaatcttaacagtctggccaagtttcgcaagcggaaatagggacacgacaactaggagcaaagatgccactttgtgtgcacaaatctgggcgatcgagtcggtaacgtgggcatcgccaacagggaggaccaccaatctgacaccaaggttttgaacataaacccgagaggcacagcaggaaaagtaacggggttgagactttgcgacacattaacggatggaggcgaagggcacgtatcgacggcaccaaaccggggccaagacacctagttcggaaggtcaacacacttcttctgtacatagaaacccaaaacttggaagccacggtttgcaccttagggctgaaacgtttggcacaaaaggacaagttcgcaatgagagacattcacgttggtggtgtcttgntatttatcttcctcaccttaagttttgaaccagttggacgcaaacaaaagctttccagacaaagaggtgggttaataaagtaaagtcttctaaggaatatccaaaggacgacgttaaatagaaccaaagatccagaccattaccccaaggccatataaaatatccaagtactactctcactcggaagaagagctacatattcccgattgccatggaacgaggtatatgagacacagcagcgttatactacagagagcaaagcgccgcccacagattccctacaaaagaccacccggaggtgatatggaaacaccgacccatggaattggggaccccaaaacttatagccagagagatatcattcacctgtggcaacccatttgtgtgtcccacgataggtaacacacccataggaacgaaagaagacgcaatttccccacagagcgaaaccacaagggcagaaggcaccaggagaaaacagagcatatcggtcctcgctattaaaagaggtggcagaaggcttaccactacaattaggactacttgtgccatagcacaattgttagttatgagaccccgttgatcaaaatatgaacgccacgagtatatccaaatgacataaaggaacaagccctacaacacatctatagagatgaccactgtatcacacaatgacagcaaagacatcatacaggagagcaataaa

SEQ ID NO: 598154 - DNA, 801 bp, Homo sapiens
  misc_feature (581)..(581): n is a, c, g, or t
tggcaatagttgaagctaaagaagttccctactaagttttcgtatgggatataggatggtgaaggagttccttagaagtaatattagaagaaggtgaaaataagcatcaagatgctccggtaatgcgtgtgggtacaaagaaattcttcatgacatgtcgatcgatataagatggtggaaatgctcccagagaagatagatctgtgaagagttgagagtaaaatgaaattagttggatcaatgttctatccaagggatggaatgattgatctttaccagaagagcggaatctactggattgacagacttgacttggtgctgccgcactgtcaatgggtgtatagtagaacacggaaactgcatcgaggaaccatcgctgtggatctatcagaaaatcagatggtggtatactagcatttgcaaacataaagattgagtttagcagtgaagatatcttctgagattgaagaggtacgagggggattcacccgcctattccactgggactatctatcctcaggtgtattgttcgctgtgatgagactgcataggtaggacttgatggtagattaaggagctgnaatgcatatgacaggaacctagatactataagttccattgagtgcagacttagaggaaaggtcaaagtgggataataaatgtgtgtgatgctcattgtgacgggaaatccggatgctgatgtgggttgggaaaaatggggatataatgaatggtgtgatttgaaagtcggattggggtgagatcggcggtaataacgttggaatctagggtgaagggggg

SEQ ID NO: 598155 - DNA, 108 bp, Homo sapiens
  misc_feature (1)..(1): n is a, c, g, or t
nccacacaccttcctttcaaagaggatctgcttgtctttcagattacatttaataacttctgactgtcatcaatgaccaacaatttattggggtaccgagtctcgaat

SEQ ID NO: 598156 - DNA, 134 bp, Homo sapiens
  misc_feature (44)..(44): n is a, c, g, or t
ggtaccagccttagctttgtcgatcacgttatccacgcggctgncacttcgccagatcgtctacatccggcatttcacctgcgaattcatccgagttagaatggccttccaagaggcgcgaggtatcatcctgt

SEQ ID NO: 598157 - DNA, 450 bp, Homo sapiens
  misc_feature (17)..(17): n is a, c, g, or t
  misc_feature (24)..(24): n is a, c, g, or t
  misc_feature (45)..(45): n is a, c, g, or t
  misc_feature (343)..(343): n is a, c, g, or t
ccaacgccgaatggggnaagttangggacaacgccttgtccacangaacagacccccagaactgaagaaagaatgccccaatgtccccacaagtaatgaaatggttaaaaagaattgtggttccatcctacattaggaattgaaaaaactttttcctccctaagagcccaaataggaaatgcattgcccctttgagagcccacagactctcttgtcctttgttgccagcctactcggttctcccattatggtggaaaagcagcccactgacaacgtgtaaacaaatgggtgcccactgtgttccaataaaattttatttacagggttggatgtggtggctcanacctgtaatcccagcactttgggaggacaaggcgggtggatcatgaggtcagatgttcgagaccagcctgaccaacatggtgaaaccccgtatttactaaaaataca

SEQ ID NO: 598158 - DNA, 519 bp, Homo sapiens
  misc_feature (22)..(22): n is a, c, g, or t
  misc_feature (31)..(31): n is a, c, g, or t
  misc_feature (73)..(73): n is a, c, g, or t
  misc_feature (105)..(105): n is a, c, g, or t
  misc_feature (107)..(107): n is a, c, g, or t
  misc_feature (120)..(120): n is a, c, g, or t
  misc_feature (147)..(147): n is a, c, g, or t
  misc_feature (162)..(162): n is a, c, g, or t
  misc_feature (241)..(241): n is a, c, g, or t
  misc_feature (249)..(249): n is a, c, g, or t
  misc_feature (271)..(271): n is a, c, g, or t
  misc_feature (299)..(299): n is a, c, g, or t
  misc_feature (308)..(308): n is a, c, g, or t
  misc_feature (310)..(310): n is a, c, g, or t
  misc_feature (327)..(328): n is a, c, g, or t
  misc_feature (338)..(338): n is a, c, g, or t
  misc_feature (352)..(352): n is a, c, g, or t
  misc_feature (358)..(358): n is a, c, g, or t
  misc_feature (380)..(380): n is a, c, g, or t
  misc_feature (385)..(385): n is a, c, g, or t
  misc_feature (391)..(391): n is a, c, g, or t
  misc_feature (393)..(393): n is a, c, g, or t
  misc_feature (396)..(398): n is a, c, g, or t
  misc_feature (421)..(421): n is a, c, g, or t
  misc_feature (432)..(432): n is a, c, g, or t
  misc_feature (435)..(435): n is a, c, g, or t
  misc_feature (453)..(454): n is a, c, g, or t
  misc_feature (460)..(461): n is a, c, g, or t
  misc_feature (474)..(474): n is a, c, g, or t
  misc_feature (483)..(483): n is a, c, g, or t
  misc_feature (486)..(486): n is a, c, g, or t
  misc_feature (493)..(493): n is a, c, g, or t
  misc_feature (508)..(508): n is a, c, g, or t
ggggggactggttttttatttnaaaaagacncttgtcaattttcagtttcaaaacagttgcccttttgatttntttttttcccaatcggccccaaagagaccccntnaaaggggagtccnttttaagccaataagctgcaggatgtncacctaacaaacctnctaaaaaccttaccaaaaaatggggactgggttgggaaggaaacttaaaagatcaacaaactgccagcccacggactgnaaaggctntcacaaccaaatggggtggccngggtgccacaaacccaaagcaaagtttnaaaataatntnaaatttaaaaagttttnnccataagctnttcaagatttttcnagcctnacttgttcaaaacacaattganatggnccttcntnagnnngagttttaaacccaaaaagggtnatgggatgagnttnacatggttaaacaagggnnaaaacnncgtccccgccctnatgggcganttnccgggtnccaacacaatggccnctttccgagga

SEQ ID NO: 598159 - DNA, 355 bp, Homo sapiens
  misc_feature (159)..(159): n is a, c, g, or t
  misc_feature (316)..(316): n is a, c, g, or t
ggagaggaggaagatgaaggggaagaagaagatgaggaagaagaagaagaggatgatgaagggcccgctctgaagagagctgccgaagaggaggatgaagcggctcccaaacgggagaagacagaaaatggggtatcggtgtgaccccctgacaacagngtggggttgggaggcctctctggctctggaggtgggggtgggggaagacaagtccagacactctacacctggctccctgctctgggccctagcaacagagatgacaccctcttctctctccccagtcctctcatttccgtctctccagacactgccncctccacccacactctgacattgctccacctcctgacct

SEQ ID NO: 598160 - DNA, 719 bp, Homo sapiens
  misc_feature (288)..(288): n is a, c, g, or t
ggtctctcttcacgcctgccggtccatgtctgagtcagagtctgctaacagagcccgatcaggtgaggaagctcttcattggagggttgagctttgaaacagctgagtgacggagcctgaaggacgaccattttgacgcaggtgggtgaacagctcatcggacgtcgtgctggtcatgtagagatccgaaatgaccgaatcgcgtcccaggggcttatgggggtctgtgctgcacaagtaatgcgcactcgtggcaggcaggtgcgatgcgagctcatggaatcgtcnacaggcctacgacacaggtgggatggcaacgagatatgtgcgagagccagatggagaagctgtctccaaagcaggaagaatatctgcaagagatccaaggtgcgctgacgtgtaacgtgtgaaaaggggaatattaggttgggtggcattagaaggagagcatgacgtgcaatcacacgatccatctaaggagaatttattttgggaacccagatggtggcagggagacatatgcagagatcgcatttgtcaactgtccactcgaactgtgcatcgcggcagggccaggtgggccacaggagacaaaggggaggcatgtgtgaccgtcttgttaacccctttttgtcacgtacgcgatggaccctcgcggatggacaatgcacgagttgctccacttcgagcagaaatacccgatcatcttgctgaacctg

SEQ ID NO: 598161 - DNA, 485 bp, Homo sapiens
gcaccttgacggtactgagtgacgacgccgaagcccaggctgaacagggaattggacatgctgttacctctacacaaatggaaggctggcctacttgagggccgccgaataactatctggcatgaagccaatcagggttctgtcaccgagatcgagcaccgggcgcttgatcatcgagggttgtgcgagcatcaattcaatggctttcgactgatcgagatcggcttagcgttcgtctacgagttagcgaaaggtggtagcccgcacggtccaaaaccacctgccaaacgtgctcgtatgcaccattgggtcaagtgttcgcggtcgataccggccgtttagtagtcatggaactcatagctcaccccgtgctcatcgagccaggtgcgcgccttattcatggtgtcgcaggctttgatgccgaaaaggtgcaaggttttgcttgacgcaactcaaggaattgcccccgcagggacccactcgga

SEQ ID NO: 598162 - DNA, 204 bp, Homo sapiens
aattactaccttccccttggggggtttcctcccccacccccccccccccaattttatgacttccctttggcaattgttgaattaaaactgcggctgaaaccaacagggtcataaagatgaattttttgagaaacaaaaatctacatgttggaaaattgggttttttttccatgtaagtgaacataaaaacatcttttccgggga

SEQ ID NO: 598163 - DNA, 459 bp, Homo sapiens
  misc_feature (102)..(103): n is a, c, g, or t
  misc_feature (105)..(105): n is a, c, g, or t
  misc_feature (148)..(148): n is a, c, g, or t
gtgaccaggatgtggattttggcgacctgtgtggtggccttgagctgctttctgtgtttgtgaggactactcccatttccttgaaaaaaaaaaggggggaannanaattggcccccccccgggggggggggaaaaggggaggacattngggaggaagatggcctgagtgtgcactttggctctgctacctgctcctgaagccccgctaaaaataattcatccaagattcctttgtagttaaagggtccagttctgactggagcctctagagagctgggcttgtatgttcttttggccttttgttcctacctaaatgaagaaaccatgcctggaggggccgtgaacacagaaccctcaagacaaggatgacagagctggaggacacatctagctgccattgcaacctcactgggctccccagactctgtgtgtgagaaattaaaccccctgcatgcttga

SEQ ID NO: 598164 - DNA, 1186 bp, Homo sapiens
ggaacagataactgaatgatagattttttttattttacaagatacaaactttacacacctgcacatttagtatatagcatcactacaatggtgtgtaaaacattcagggtttctattgcctctctaacactcacactaaatctagccataaaggtaggtatagtatacatcatttatacatgctaatacatccataacctaacctaatctattaaaatataaacaggtaagacaacatatatacttagatatataaacataacaagaccatcattctaaactacacatttcgagtaaaataatagcataaatggtcagattaccaaaaatggtcattaatccatataactaataagtacagcaataataccacatctaacaaaataaaacggctgatactaagaaaatgtgtaaccagaaccaagaatactgcgtaatatgggacagaatcctgtgcaccgagcggcgtggaacctggacaagaatagtagcgaactatagacatatataaaacccaatgtaacataaccataaatacttctaaagatgaatcaatgacaatactaagtataatacataaagcaaatacatttaaaaagagggtattagagtaagactgaaaaggacaggaaaaaggtagagtagacaaggaaaaaaaataatttaaagtaaaatatgacaaaaagaagtgtagaataaataaagcatcgggacacacgccaccgtaacacactacgaaaagcaaccaacaaatgggggaaaaccaagagaagtcccacacaagacaacccagatacacagggaacacaacaatcagccaaaaacaaacaccgcaagtggcacccacacatgtacatggccactaaggaaaaacccccctccataaaccgacaaaaattaacacaaaaccccaacatgtcaaaacagcgggaggagacttaggagccatcacagtagaaaagtacatgaaattgaacaaaaaaaagaaagggattaggcagaaaaaatgatataagataaaagacacaataaaagaaacgtcaagagacagatgtgatagaaaaagaaagattaaagatgagaaaaacaataaattaagatataatacaataaacgatatcaagtgagtaaacatttggtcacaaaacaatataatagctaattaagagaaaaaatgtacgaggcc

SEQ ID NO: 598165 - DNA, 337 bp, Homo sapiens
ctcacgcgcttgcgctactgcgcacggccaccacactgtacccaacaagcagatagcacatgaacatctagtgccaactcactgtgtatgatagctatcaatatacattcattacaggatcgattaccttccctcttacgccccacctcttaacactgttagagccacatttcaacttgatatgccgagagggacagacatccaaaccgtatcattttttttgatactttcatgcagtttgtttggctctagatctgtttagactcctgcagtctggtatctgtaactagcctctggtcctttgtgagagtccacggttcggtactacgctttggca

SEQ ID NO: 598166 - DNA, 136 bp, Homo sapiens
tagacgtcactccaatggacaatctatctcctatagaaactaatgttagtataagtaacatgaaaacattctccgaacgtcactatatcaaaatcagaccccatcacctcctttctaaccacccccatcccagtga

SEQ ID NO: 598167 - DNA, 713 bp, Homo sapiens
ggcagaacctgcattaaggaatcgggaagaatcgatgagcgccactctttaaaaactcacttgacgttgtccttgtacactttgaaaagtgggaatggatctgctgaggcccagtgcatatgcaattgtataggtgtctattagtcacattaactctcaaagagattcgaatgacggtaagtgttctcatgaagcaggaggcccttgtcgtgggatggcagtttggtctcaggcagcaccacactgggtgcgtctccagatcatctggtaagagcttgctccagattctgatgcatacgggctatattggttatgtagtcagttgcattcattaaatcaactttatcatatgcgtcttttaaatcgtgcggttctcatcagtatcccctttaaaaatcctgggctggcacattgactgggaaacctgacgtgagaaccaggcaaactgcattctactcccttctctctcctgacggtgaagcttttccacggtttagccgaagagatacctggccagcacttctgccaagctgcacatttacagaagcaaattcaccacgaagggaaaccatctcacggccaacatagggcaaactgacacaagggctattaacaatattcttgacacctttgcaaacattgcaggctttggtacaaagaggtctgtccatctttccccctgggatatacagatgcatctagctcccggtaga

SEQ ID NO: 598168 - DNA, 843 bp, Homo sapiens
gggccagaaaagctctgggtggccgtaaagaggcgccaccccatgggtagacccacgcacacaagcggacaatatcggggacgcacgtcgctgcgcacagcgaaggccaggcgtgggacgcagcgccccacgtagttaaaggaaattgaaagagaaaaagtatgtgtgccggcgcacccccgtgtccgcggcacgcacaggggggggggcaacggcccccgcggtgcgtgatatctatgccaggggtgccggattcgtacagccccaccagccgggaatgacagtaaactgtgtgcgtagaaataaaccaccacacatggagagtgatgtatacatgagacagacacataccgatgagtttctgtcatacatacccgggagagaccccacccccatgttcccagatgggtgggagacacacgcacatctgtatagatattgaagacagaatgggggcgtgtcgacacacacgtatgtgctcatgtgtgaggctccacttcacactgcgtgtgagaagaaagcatgtacgcacgggtaagagtcccgcgcgcgggattatatacattatgtatgtaagaagccactcctgttatgtgggttatatatgggttcctcgaagactcttatgtattgatgcaacattcatgatggtctgcccatgcgcttcctgatgatgctcccttgtcgagcccacgcttcttgtggccggcaatcaatgaacgtggcgaagacacccgcctcgggtttttcaggtcgccatgatggtgatatggcagagaccaggcgacagatggtccgtctctcctgagatatcactccctcccgctcccacaatgacgcaga

SEQ ID NO: 598169 - DNA, 141 bp, Homo sapiens
gtgtggcccggcgccgggcggtgctgcccggagagcgcgcagcccccagccggccgcgccagcgctgcgcccactctgctctcccaaacccagggctgtcatcgtttccacgcctgttccctttcagagccagagacgagc

SEQ ID NO: 598170 - DNA, 260 bp, Homo sapiens
agcagacggcggaaggtggcaatcttctgctccagccgcgacttcagatccagcatgacgttgcgtacgtggttctgctgctcgatctcgcaccgaagctgggccagcggctcgtacacgctgccaataataccctgtatctgctacagatgcacgcagaatcgcatctctgtctccggctgcacgcactccaggtaagctaacatgctgagacgggactgcagatgtatctacaagccctgcatggagcgccgtagctc

SEQ ID NO: 598171 - DNA, 992 bp, Homo sapiens
cgctgaggctgttgggtatgaagtgtaacagaacagactttagcatctgaaactgcgtgcttcaagtatcagattcgggcaacggaagcaaacctcgtagaccagtaacaagaccaaggaagagtacgagcttcacagttgcacagacagcaagcaacttgatactgaacacaatgaatgtgggacgcgcctacgcggaccaagctgttgacacatgatgctacttgcccaacttgcctgcgtcacgtaagtctgtgtgttctcctgtcgagtggcgtggtaacctagtggaggatcaggtcgcaggtgacgaggcgagccacgttcgtagttcgtatttattaggcgtgttcgtacgatccattgtcctgcgtcgctcgtttggtggaactgacttacgcaacctttcatcctttttgaagaactgtgctggcgtggagtaaacgatacggtcatcgatgcaggatacgtagcgtgaaaaagtgcaagtagtatggaggctagtcaatcgggggaggatgagcatgagaatggcgaaagctttgtttgcagaatgagagtggacataagtggggtagccgctaatgggtatgtggcacggaggcactgggggtgaaactcctgggtgttactggaaattagacgtgttgaagccttcttggcgggttttattgaggtgtcgcgaaatgtggaagggtaggcactttgtcttttcctactggttcaccgttattagtgcgcaatccagggagaagttaaagagtaaggcagatgactgtcgggattcagacgctacttgtccggacctgacgggatggtaaaacccaattgcggttatgccggtcagaaaccagagaaatgctcctgcaaaaagtgattactgggcggcaagtgttgtgcgggggtccacccctggaacagtgcgaggcacgttctctggaagcggagcaaaaagaaggtaggggacacggaccagtggtgggtcgacaaac

SEQ ID NO: 598172 - DNA, 1598 bp, Homo sapiens
gccgagggcgccattaaacaggacgtgaccaggcagacagggtccctgtcgtagagcggagtatctcagggaccagttacattcacgagcaatgccataggtccatggaatacttgctaaatacgctcactcgcttcatgaggtaccagcgattcttcagcccatgctgcctgacacatggctccatcaagaggaccaagaagccagtcgaagcttgatcagaaacgacgagctatgcgggcttcgcatctcgcgttcgcagtcaccaggagtgacgaggatctcggtgagggctgccatagaatcttacaagaggacgtcaccgttacctcatggaattccttgctgaagtcccatgctaggcaccagatgggcaactgtcctgggagtccttgcgtcacggcgcgcgtgagaccctggtatccatgtgagacatctacctgtcgagtacggtagcgactccgtttggaaccaagcagcattcgtgcatctgcgacgagattaccatacattcaaggtggcaggagtccacattgcgtgtcaagacatggtagattctgtgcctgtcgtgcataagcatgcacagaggtgccactgggacagagagccgtttcgacaagggacctagatctccagacgccttcaacttacaggcggacgaacttgcgagagcggagcttgaaaaatatgattccttacgggtttgattggaactcgatttgagagacccaacgggaccttttgacgcccttagaaagacgaaccatattgtgttttggcgaaacatggttgcctttggcatgaataccccgtcttgtttgcctcggttaccaaagcagggagagatccaaaacgtcaacacgaactatttttactggggggaccggaacgcaagtgttttgggacactctcctttttcaacgccgtttcccaagccctcttgtgtcgattagggttactcctcacaaggggtccaccatttgtagccaccggcgagttggttggcaaacacaggacacacatcttcgacacgatacacacatcttcgcgcagggacaatataatgtagcgtggcattgcaacagagaaaagaaacgagagacactgtgacaacaacagggatacacatcaggtaagcaaacagaggaggtgtggaatctgcgcgaccccaaaggttattctttttggacaaacacgaggagtgagcaaaaaacatgtggccgggagactcaccaatatatgagtagaaaacccagttaaataattcgaaaaccgaaggtttaacacggatgaataacaaactatgaacgacagcaagcaaattaaagacgacatggcaggcacagggatacaccgatcttattcactgggaagatctcgtttgatacccagacagcctgccgaacactgagagtgagttaaccaggctcagaggagtatagcgagtcagcgattaccacagaggaagatccatcgtataactcggagagacacatgccagagacacgaaatgaaacgaaagcaacaaggaatgactacgtgctgaagcacatcaatgaaatacgatgacgaatcgtaactcgatccattctcatcag

SEQ ID NO: 598173 - DNA, 134 bp, Homo sapiens
tcccccccatgcacttgtcaacaggcctaacctaatttaccaaggatgaactctttcaattcttcatgcgctgtcccttttcatatacttatttcatttattatccataatcttatagacactctgcatcggga

SEQ ID NO: 598174 - DNA, 190 bp, Homo sapiens
  misc_feature (37)..(37): n is a, c, g, or t
  misc_feature (94)..(94): n is a, c, g, or t
  misc_feature (125)..(125): n is a, c, g, or t
cggtcttttgtttgtttgtttgttttttaagagatanggtcttgctttgttgcccagactggaggtcagtggcttttcacagctgcagttatancctactgcagcctcgaactcttggcctcaancaatcctcccacctcagcctcccaggtatctaggacaacaggcatgcaacacaaagcacagctct

SEQ ID NO: 598175 - DNA, 117 bp, Homo sapiens
aggaagggagagacagagagagagagaaaaagaaagaaagaaagaaagaaagaaagaaagaaagaaagaaagaaagaaagaaagaaagaaagaaagaaaggaaagaaagaaagaaag

SEQ ID NO: 598176 - DNA, 353 bp, Homo sapiens
acggatttcacatctgattgttttactatatataattagcatttgtctctctctctttagctcacatgctacaggaggtcaagcgccatggctcatgtgttcacagtgcccagcacagaggcatgcacatagtaggtgtatatttaagaaagttgattgaatgctgagtgagtgagtgggcactcttcgctgacgaactggggtaaggcacatactccctgttagatttcagtgtagcactgccctatagctggtgcaaacaccttggtgtctccccttaggagcatgtggaaagaagagcgaggatttgccatgagctttctctgggacaggagcaatttgggaggcagaga

SEQ ID NO: 598177 - DNA, 162 bp, Homo sapiens
ttgacatgatacgactcgagttagtaccctcggattaaggggccaagatctatgatcccacagactccaagtcctgagggctgggacaatgccgcgatgcatatccctgagcctgtatgctaagaagctcgcgaggactgggactgaaagagatggacagga

SEQ ID NO: 598178 - DNA, 123 bp, Homo sapiens
aagaggggctaagacccaagtcatcctccactttcgttttgttatatttcgcttagaattgcctcttcttctccacttcagaactgcctcaaaattgacccccttgactgatttattgtcgtc

SEQ ID NO: 598179 - DNA, 357 bp, Homo sapiens
  misc_feature (21)..(21): n is a, c, g, or t
ggcagagaataaaggataaanccaattctctgaatgaaagtttaatgtgagctcggctgggtgcgttggctcacacccctgtggtcccagcactttgggaggctgaggcaggtggataacctgagctcaggggttcgagaccagcctggccaacgtggcaaagacccatctctactaaaaatacaaaaattagctgggtgtggtggcaggcgcctgtaatcccagttactcgggaggctgatgcaggagaatcgcttgaacccaggaggcggaggttgcagtgagccgagattgcgccattgcattccagcctgggtgtcaagagtgaaactctgtctccaaaccaaaaaaaaaaaa

SEQ ID NO: 598180 - DNA, 662 bp, Homo sapiens
  misc_feature (294)..(294): n is a, c, g, or t
  misc_feature (377)..(377): n is a, c, g, or t
  misc_feature (379)..(379): n is a, c, g, or t
  misc_feature (553)..(554): n is a, c, g, or t
  misc_feature (556)..(556): n is a, c, g, or t
  misc_feature (561)..(561): n is a, c, g, or t
  misc_feature (563)..(563): n is a, c, g, or t
  misc_feature (567)..(567): n is a, c, g, or t
  misc_feature (572)..(572): n is a, c, g, or t
  misc_feature (576)..(576): n is a, c, g, or t
  misc_feature (578)..(578): n is a, c, g, or t
  misc_feature (581)..(581): n is a, c, g, or t
  misc_feature (583)..(584): n is a, c, g, or t
  misc_feature (588)..(588): n is a, c, g, or t
  misc_feature (607)..(607): n is a, c, g, or t
  misc_feature (614)..(614): n is a, c, g, or t
  misc_feature (619)..(619): n is a, c, g, or t
cggtcgcggagggcagtggcggcagaatgtggctaccaggtatttagcctagtcggcaagcgagcaatttccacctctgtgtgtgtacagagctcatgaaagtgtgtgaggagcgaagacttttcgctcccagcttatatggatcggcgtgaccaccccttgtccggaggtgggccatgtcaaagcacctgtactgccagaccgagaaggcagctgaaggagaaggagaaggcctcctgggagcagcctctccagtggatgagaaagtcgagtctgtgatcgcattaagttcanggagagcttgctgagatgaacaggggctcgaacgagtggaagacggttgtgggcggtgccatgttcttcatcggtttcaccgncntcgtatcatgtggcagaagcactatgtgtacggccccctccgcgcaaagctttgacaaagagtgggtggccaagcagaccaagaggatgctggacatgaaggtgaaccccatccaggcttagcctccaagtgggactacgaaaagaacgagtggaagaagtgagagattgctgnntngcctnanctgngcctngctntntcncnncatncaatcatgcctatttactngaaactnttatnccaaacagttttaccacttctaattaatgacccgtttacctga

SEQ ID NO: 598181 - DNA, 509 bp, Homo sapiens
  misc_feature (50)..(50): n is a, c, g, or t
  misc_feature (53)..(53): n is a, c, g, or t
  misc_feature (60)..(60): n is a, c, g, or t
  misc_feature (95)..(95): n is a, c, g, or t
  misc_feature (141)..(141): n is a, c, g, or t
  misc_feature (224)..(224): n is a, c, g, or t
  misc_feature (226)..(226): n is a, c, g, or t
  misc_feature (400)..(401): n is a, c, g, or t
  misc_feature (403)..(403): n is a, c, g, or t
  misc_feature (408)..(408): n is a, c, g, or t
  misc_feature (410)..(410): n is a, c, g, or t
  misc_feature (414)..(414): n is a, c, g, or t
  misc_feature (419)..(419): n is a, c, g, or t
  misc_feature (423)..(423): n is a, c, g, or t
  misc_feature (425)..(425): n is a, c, g, or t
  misc_feature (428)..(428): n is a, c, g, or t
  misc_feature (430)..(431): n is a, c, g, or t
  misc_feature (435)..(435): n is a, c, g, or t
  misc_feature (454)..(454): n is a, c, g, or t
  misc_feature (461)..(461): n is a, c, g, or t
  misc_feature (466)..(466): n is a, c, g, or t
atccttcagctctgtgtttcctccttcacaagtgtggttttggggagaantgnttaaatnttgcagaggagggagctgctgagcctttgtgcctntaaatgtctgtcctctctgcgccccagtttatcgcattaagttcanggagagcttgctgagatgaacaggggctcgaacgagtggaagacggttgtgggcggtgccatgttcttcatcggtttcaccgncntcgtatcatgtggcagaagcactatgtgtacggccccctccgcgcaaagctttgacaaagagtgggtggccaagcagaccaagaggatgctggacatgaaggtgaaccccatccaggcttagcctccaagtgggactacgaaaagaacgagtggaagaagtgagagattgctgnntngcctnanctgngcctngctntntcncnncatncaatcatgcctatttactngaaactnttatnccaaacagttttaccacttctaattaatgacccgtttacctga

SEQ ID NO: 598182 - DNA, 326 bp, Homo sapiens
ggctgagagtctctgagaatttatgagatgtgtgtctcatcagacttggtcatcaaaaaaaaaaaaaaggaaaaacccgtctgggggaaaggcccctttcctccaggggaggggggggcccttttggttttttttgggaccaggtttttggtgggggggcctttaaacccccggcctttggttttgggtaacaaaaaatttcaaacccccggggggcccaattctttttttttttccgggctaaagcctttggcccctttccagggtggtttttttggctcaagacggttaatttcccaaaggcggagccctttttttttcccttt

SEQ ID NO: 598183 - DNA, 1280 bp, Homo sapiens
gatactggatgcttgcggcacgcgtctctaggtggagctctggctggtgacgccagccgtgtaccggaacaaccacgggtcatactcttcagggaatctccgtagtgattgccagaggctccattccctcggcgagtgctagaatgccgtgtccagcctggcaagacaacagaccagaacacagtggatacgtcggagtggtgatggttctgctgacatgagatgaagtggggaaggacgtacatggagaggtgaggtactattcagatgtggcaggtgggatcaccagagttccgcaagcacgtgagacgctgtccacaatgcgtgtgatagacgtgcatctactgacgctaatggactgcatgcgaatgtttgttgtgatcgtgaggacttctgtgagatgcttaggacgagagcacgatttgtcggtggtcctaatatggaggatagatagtttcagagagatctgtaatgacgtaagaatgagagatgcgggatgggaggaagagtggggagcttgagaggagccgcctaaagtacgggcgatgtaggacactcgtgtgcacggggcttgccaggcgcgagagtccctcgtgggcactccggcattttcagtggtgagcaagggtgagtcttaccaaaggggcgtatcttgttcgtgagaaattggttggactcacggcaatctacacgttacggaactgctgccacggctgtaaagaggaagcgcaaaaacagcaaaccccgtgggaagcacgtgcacgaaaggcctgcagtagcctctattagcacacacgcattagacaggagaggggaacccttcgcaagggaacgcgcgggactacgcaagacagggacattggacagcggaagcggaccatctgtccaggaagagcactgggaaagcactcaagagctccttgacacttgggttagggggaacagaaccacacaccttggcaaccggcccacagaaggagcagagcgctaccacaggaggaccatatagggaggcaacatcccccaatgaaccagggacccaacgccacgaggcagggacaagagaaaagggggaacaaccgcattactgggggcaatacaccaggggcagccacaccagaccaactacgcacaggcatacacatgcggcataagaaggcagaggacttccagcaccacacacagaggcagaggacctacgacaaaccggcccatcaaacaacaaacggccctcacggcgccaagccaggggagactaccccactacagaccagacagaa

SEQ ID NO: 598184 - DNA, 125 bp, Homo sapiens
tgcacacgccgtagttccaaacatcgagtacacattatccccaaccctcagaaatcctgatggacgaagttgttgcagatcgcaatggacgaagttgttgcaggtcagggtggacgaagttgttg

SEQ ID NO: 598185 - DNA, 854 bp, Homo sapiens
  misc_feature (145)..(145): n is a, c, g, or t
  misc_feature (163)..(163): n is a, c, g, or t
  misc_feature (244)..(248): n is a, c, g, or t
  misc_feature (256)..(257): n is a, c, g, or t
  misc_feature (264)..(264): n is a, c, g, or t
  misc_feature (274)..(276): n is a, c, g, or t
  misc_feature (279)..(279): n is a, c, g, or t
  misc_feature (287)..(288): n is a, c, g, or t
  misc_feature (303)..(303): n is a, c, g, or t
  misc_feature (310)..(310): n is a, c, g, or t
gggctttggcatggcgactttttctggcccggtgggccatcctgtcgcttaatccgcagggaagatgtcgagtttcaaaaggaggtggcgcaggttcgcaagcgcataacccagcgaaaaaaacaagaacaattactcctggagnagtctatgtgcgccaccnactaacctacttgacgaaacccagatctttcatatttctcccagtttgcactgtgacacggttcaggctgtccacgaagtnnnnnggactggnnaatagcnaaggctatgnnnttngtggagtnngagtctgaggatgtngccaaanatagttgctgaaacaatgaacaactacctgtatggtgaaagactcttggaggtgtcattttatgccacccgaagaaagtacataaagaactctttaaagactggcaatattccactttaatgcaggccatcatatccatcatgtgaaacggtataatcggaatcggacactaacgacaataagctacggactggacggagcgatttatcataagaacagaacacgattactcaggacagaaagttagctagaaagaaggaattgactgagtgattttccttgctttgatttgacagaatacggaaagtatctcaaaaactaatcgtcaggacgtctacaaaatggccagggttttactgtccgaagaagacaagaagtttcaggtacttcttgacactcctgagaaagagtgcggatagtcgagggacgccacaccaagtatgtcacacccaagcatttggcggaacgaaggtgaataatcctcaatgttggctgatgtggaaattggtgggatcgataacgattgatgcaactagtgttccaa

SEQ ID NO: 598186 - DNA, 361 bp, Homo sapiens
gttctctacaatactacaaaattagccaggcgcagtggcgcacacctgtagtcccagctacttaggagattgaagcggaaggatcgcttaagcctgggaggcagaggatgcagtgttgagatcacaccactgcactccagcctgggcactctaaccactgcgcatagcaaggccctgtctcaaagaaacaaacaaagaaagttgaactcataaaagtagagtagaatagtggttaccaggaggtgggggtggggagatgttgatcaaaggatacaaaatttcagttaggaggaaaaagttcaagagatatattgtactatggtgactacagttaataacaatatattgtaatcttaaaaaa

SEQ ID NO: 598187 - DNA, 393 bp, Homo sapiens
cggaagggctgacgcgtggaggtgccgaccgggaccaacatcctggaactggcccacgatcatcacatcgagatggaaagcgcctgcggcggtgtcaaggcctgcaccacttgccactgcatcgtacgcaagggtttcgactcgcttgaagaagccgacgagctggaagaggacatgctggacaaggcttggggcctggaagcgcagtcgcgccttggctgccaggtggtcgtcgctgacgaagacctgaccatcgagatccccaagtattcgctcaaccacgctgccgaagcacggcactgaggatctgtacatgagtctgaaatgggttgatgtacttgagatcgcaatccagcttgcagaaagcaagccggtagtcgatccggagtcatc

SEQ ID NO: 598188 - DNA, 115 bp, Homo sapiens
agaaagagaccatttttaaattgagatggaccttagagaccttgagcttacttacgtacttcaattgccaccggtacttaggttttaccaccaaatgctgttaacattaatcatt

SEQ ID NO: 598189 - DNA, 404 bp, Homo sapiens
  misc_feature (118)..(118): n is a, c, g, or t
atacgcttccccacagtagcacgaggagaaaatgctggaggtctagagcaagcaggcgcttcccggggtccgagcaagcggatcttccctgagtctggagcgagcgtgccttccccgnaaaatggtctgcgtgaggtcacttcattttcttccttttgctcatctgtgtttgctaaaattccagccctgagaaatcagtggctcagagggtttgcatgtcttccttgtcaaacgtgtgtctgaaacaggctgggggtctgacggggcctgggttcaaatcctgactccggcacttcctgaccgcgtgacccccgatgagtggggtgaaaggtcccaccctttccaggctgcgtctcctcaccgtgaaatggggtgacaagctcccacctcactgtggggacggg

SEQ ID NO: 598190 - DNA, 263 bp, Homo sapiens
cctctcctctaggtggactactgttgtttttttaattattatggaatgggattttagaaaatagaagtacctttggtgtgtgttttagggaaggtgagaggaatctgctctttctctgaatactgttttgacccctggcaggaccttggaaggccaaaacattaacagtagacttctgttcactgagagttatgttatagaagataaaatggtttgtgtgtttattattgtatttgtgttgatataaattaaatggtaattta

SEQ ID NO: 598191 - DNA, 636 bp, Homo sapiens
  misc_feature (184)..(184): n is a, c, g, or t
tttgtggtttttcaccagctgccccacaccacacaaattttttggtgtcggcgcggggagagagagtttgtgttatagggtgccccctttccccacaatatatcgcgggtgttgtgtgcggggtggggcctccccccccacatgaggcggggggggcgctcttctttgggggggaatttttgantggagattttttctctaaaagaaggggggttggggtttttgtcccgggaaaagggggccccccccaaagagggttcccctttttttttttcccccccccaaaagggggggggtggggggccccatgggggttttgccaaaaaaaaaaagggcctttttttttggggggccccggggggttttgggttccaaataggaaaccccccccaaaaattccccctttgggggggggggccccccaaaaaggttttttttgggtttttttttccccccccggtttttttttttggggggggggggggcccccccccccccccttttgtggggggtttctaaattttttggggtttccgggggggcccccgggggggcaggtttttccttttccccccccccccccggggggggggggggggttgttttttttttttttatttaaatttttttccccca

SEQ ID NO: 598192 - DNA, 601 bp, Homo sapiens
  misc_feature (210)..(210): n is a, c, g, or t
  misc_feature (232)..(232): n is a, c, g, or t
  misc_feature (234)..(234): n is a, c, g, or t
gcgtcccctcctcgcctcgctcaactaccggctcaccccccactcggccccccattcccggcgttccgcccccccctcctgcggtcaccccaccccgcctaggggcagtccgggccccccccccgtgctgggtaccattccacccaacaacccttctgggggctgctctcccccccggcgccgcccaacggggagtttgtctctctcggntagagtggaaaggggggggccnangggccctcccaaacccccggaatttccttcccgcccctccaaaaattggggcccccttggggaccccccagttggggggggggcccccccctccccccccccagggttttggggttttgggggggggcccccccccctgaggggggaacccccccccccccagggtttttttccttggttttaaaccgccccccccccccccccccccccccccaggggggtttttaacggggcctctttgtttgggggacaaacccgggccccccccgggccccttaaacccccggggggttccccccctggggttgggctttttcagggccctttttggcccgaaaaaaaaaaaggaaacctttgctttttttta

SEQ ID NO: 598193 - DNA, 853 bp, Homo sapiens
taaaggagacatctggatataccccatattaaggacgagtggtactaccagatagaaacttctgaaattggaaattgcgaggccaaagccttaatctggactgcagagagtataacgcagacaattgccatcgctggacagtggcaccacgctgctgcgcctgccccagaaggtgttttgatgcggctggtggaagctgtggcccgcgcatctctgattccagaattctctgatggtattctggactggcgtcccaactggcgctgctggaacgaatatcggaaacaccttggcatcttactatccctaaacatctccatctacctgagacggacgcagaactccagccaggctcatctccgctatcacacatcctgcctcacagcttctacacttcagacccactgatggagcgcgaccgcgccctgcaccactctatgaactgtaaccgcattcgcggcatctccccatccacaccatgcgctggtgcatcggctgccacgcgctcgatgcgacgggctctctacgctcatcttcgcaccagagcccagaaccacgggtggcgcacggcagcgcagcccctgtgccagaaatcgcagactgctagacactgtctcgacattaccggagccttacctcacacagaagatgatagcccagccacatgctgtccccgatcagcctcagcagcgagacccacacgggaatagcgtcccatagcgctcagaagcgaaaggaagcaaacacataggactaaccacccgagcgatgcagaacggaacaggacgccacggacctcagccccaaacagcccccgaccaacacagaaatcatcccgcgcactaagacaaca

SEQ ID NO: 598194 - DNA, 241 bp, Homo sapiens
tcgctaaaaaataaagacaggtcctgctttgttgcccaggctggagtgcagtggtacgatcttggctcaccgcagcctccacctcccgggcccaagtgattctcccacctcagcctcccaagtagctgggattacaggtacaggtgaggaacaccatgcttggcccattgtaaccattttatctttttttttttttttttttttttttttttaaaaaaaaaaagcccccctggggccccag

SEQ ID NO: 598195 - DNA, 433 bp, Homo sapiens
tagaggaccccgaacatgtcgagtaccaaatataagtattagaacatttatataaataagcccgtatgtcctatagtatttaccaactactataaaattcagccattgactacctaattccaaatgcataagcttgaactattataattgtctaaagaaggatatttagagaaaaatatagctctaaaataaattaactgtaaatggatgggtttaaatgttcaagttattaatatttcaaaaatataaacttttggttatctaggtcaaatcagcatatcaagccaaccattactgagaccccactgtgctatactgttacatgtaacatgaaggataaaacagtataatacatagtccctacccttaaggagttatactataaataagtcaggcacggtggctcatgcctatatcccagcaccttagaagg

SEQ ID NO: 598196 - DNA, 106 bp, Homo sapiens
ccccgggcccttttaaaaaattttttttttttccccccagggaccttttttttttttgaaaaaaaaaggaaaaaaaaaaaaaattcctttttgggggggcccccca

SEQ ID NO: 598197 - DNA, 195 bp, Homo sapiens
tagccggcccgccaagttggcagtaactcagtgaggtcgaggaattgttggggggcattctatgttgttatgtttcatatcatgtacagattgttgtttctagaaccctctgaaatgcattagaagaccttaagagtcattctcagcctaaaatggcttggaacaaacagccagtatctccctaattagaactgg

SEQ ID NO: 598198 - DNA, 395 bp, Homo sapiens
agcggcggggagaccccccgagcccgcggcacaggcggcggcggcgctgagcgggctcgacagccgagcgagcggcggcccggtcctcctcgtccggcgccagagcccgcgcccgagcccggaacgtcgggcagccgagagccagcctcctcggtcgcggcaccggccgagccttcaatgaggggacgcgccggagaccaggggaggcacgaaaagccggaacgagaagttgggaatctcaaatgtagagcccatcgggaatgaacaagatggcgatgcagctgaagagcgtcaagtaggacgaggtcagatcagaacagagagagtgggacttagcagtacgacaaaatctcatgattgatgagataatggggtagattgggtatgcatcacca

SEQ ID NO: 598199 - DNA, 920 bp, Homo sapiens
  misc_feature (388)..(388): n is a, c, g, or t
agagcggaccccagagagccctgagcagcccaccgcggcgctggctagttaccatcacaccccgggaggacgccgcagctgccgagccggcccagtcaccatcaccgtaaccatgagcagcgaggccgagacccaggtgccggcacgaggagctgccccacggcggtacagagagcgtcagcgtcgcggccgaatacgtaagagcaggcggaccgacgcgttacagatgcatccatcctcgagtggttggtccccgaggctgtacgtcacattggcggggagccttgcctgtcgacgcggaaacccaaaaggcagaggggcgaccgaaaagcccgtggagcacgcgtaacaatggccacacgtgtacgcgacacggtgcattattggngccacactgtaaccccgtaagagttggtcgccccaatagcgaaacacgtggtatttgggtacccaaccctatgtatggttgccgattagctggtacaaatttatctccgcacggcgcaagtgttccactgtcggacactaccgacgcggatatttcggaacaacgacacgcggtggggtggttggcacacctgcacgtaagaaagagggacgcaaccaaggcgtgtgcagaacagtaggtaaaacaatcgctcaccaacggcgccgggcacaggagtgtcccccaccggacacaggccgcatctctaaacatgtgtcgcagcaggagccggtaaaaccaagtatactagaccggcttagttcgcaacgaccgagcaaggcagggtccgtgcgaaacgacccaaatgacacaggcacaggattctccccagaacatacgtcgacgaggtgcggggcacaaagacacggcaggggaaccggaaggacaggatcccgaaaagcgccaggggtcaccaaaaacgcgccggcccgca

SEQ ID NO: 598200 - DNA, 139 bp, Homo sapiens
tccgttgcgcgcgctatactgtgcgggaccgggcagtatcgaggagaagtgctggggggtgggcacagggcgatcgcctctgccagggggtcgagcggtgagggtggtgagaggactccgcccacgccgcagaccctca

SEQ ID NO: 598201 - DNA, 152 bp, Homo sapiens
atatcgtccgtgcgctatatgatcccttctgtaccgggatcatatagcgcacggacgatatccgtacaacgctaccccgtccgtcgccgtgacttcgcaaacgtgtcgaaggccaccgccaggacgatgatcaggccgatgatgatctgctg

SEQ ID NO: 598202 - DNA, 103 bp, Homo sapiens
tctagccatccttataggaaaaaggctcacagggcggcagtattctcaggcctagaggggtaaggagcaggaaggacagtccccctcccacatacaccaccag

SEQ ID NO: 598203 - DNA, 128 bp, Homo sapiens
ctttcccataaggttatgttttccaggccaggcatggaggatcacttaaggccaagagttcgagaccagcctggggaacttggctggacctccgtttctacgaaaataaaaataaaaaaattatccag

SEQ ID NO: 598204 - DNA, 698 bp, Homo sapiens
ttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagtcgtggaagaggcagaaaatggaagagacgcccctgctaacgggaatgctaatgaggaaaatggggagcaggaggctgacaatgaggtagacgaagaagaggacacaacgcgtcggggagcgaacgacggacgcgacgcgacagacagaacggtgactggtgacggaacgaggatggacgatgaccgactgccgcgacacgctgagtcagctacgggcaagcgggcagctgacagatgatgcaggatgacgatgtcgataccaagaagcagaagaccgacgacgcgatgactacacagcacacaaggaacaagttacactaacaacacaaaaggccgccgtgacctacccaccctccacttcccgactcagaatctaaacgtggacacctaacgagctagagagggccgacccgcccaccgagggcaacgccacccgcagatgacacgcgcactcacacaccaaaccaaaacactgagaaacgcaa

SEQ ID NO: 598205 - DNA, 179 bp, Homo sapiens
taattgggttgtcatttttccaaacaaaacaaaaccctggcccttttgggagaaactttttgtttccattccttaaggatgggggattgtctgggtccaaattgctttaaaaataatatttaatatttcctggaagctcatttttttggcatgagtctaatttaatttttggaagccca

SEQ ID NO: 598206 - DNA, 243 bp, Homo sapiens
tctgactcccgtcacgcccatgtcgaagcccccatcgcagggtcaatcgtactctgcagccgtactcttaaaactcggcggctatgtgtatcatacgccatcacactcattctcaaccccccgacccaacacctagcctcccccttacttgaagtatccctatgaggcatcattcatccacaagctcccatctgccgtctgcacaacacagacctcaacatctgcacatatgcatactcttcc

SEQ ID NO: 598207 - DNA, 259 bp, Homo sapiens
  misc_feature (57)..(57): n is a, c, g, or t
gaggtggcgcacgacctcttcggtgagcttgcgtcggtctcgtcgattacaagatgngaaaccattcaccgagcgtcactgctaaaccgcggcaggtacttcatcagcgcatggtgggggcggccatcgcgggaaatgagggcgtcaccgtccatgaagctgcacgccttgcccttgatgcgcggcgggcgaattcttgtctgcgcgcccggcaatacacctcgttgccgagcacttcgcggatggtcttgccgtacag

SEQ ID NO: 598208 - DNA, 220 bp, Homo sapiens
  misc_feature (106)..(106): n is a, c, g, or t
  misc_feature (121)..(121): n is a, c, g, or t
  misc_feature (193)..(193): n is a, c, g, or t
aaaaaacccaccagactaacagctttacttgctggccagggcttcaaaatgagacttccagtaccatcctagagaggccaaaacacaatggggaaaagcgagatgntagagagagctaggnttcttatatccttagagtgcagttccacctgcctaagtactgtgtgttgacaggttcatctctattcctttntgggccacagaccccaatttttataat

SEQ ID NO: 598209 - DNA, 771 bp, Homo sapiens
  misc_feature (452)..(452): n is a, c, g, or t
taaagggcgcccgtgtcatcacacaaaggaggcggagggagccaggtctgctctccttctggtcagaatagtttatgtgttctgcatgcgcacacctctcgtcacactactaggcgccgtcgataaacgccgtcacgtcgcatactcggcgcccccctcgagggttactcgcgcaccccactcttttctctttctctggggtgagctgtgcttgaagagtccactcctcacttcgcgggctgtcccaccgcacataatacgcgcgcagtcttataccaccccactccctcgctctgtgtggaacgcactcgcactcgctgcgctctcccccgccggtctctccggcggtgctcgctctctctttgtgtgcatgcccgcccgtgtgtggtctcctctcgcctgcgtcgtcatgtgcctgcagctctcactgcgtgtcgtgcgtatgccttccncgcgcgtcctcacgcgcacgagtgtcgtcgcgttcctctcctctcttgtggtatgtcttgcggctacctatatatgcattcatgcgatactatcaccatcatgcagacgcgcgcgcttaaacagcgagaaagcgacatatatctggtgagcggtctctctacccaggtgtgcggaaacctccactacaggggggtcgagtgagtgagtactgttctgtctgttcagctctctcctgttccttttcgggagtctcgagaagcacccccaaggtattctgatctccccttgagacaggaacgaacaaatgaacagacaaaa

SEQ ID NO: 598210 - DNA, 314 bp, Homo sapiens
ctttctcctgctgttactggcctggcaagcgccgatgttcgacgccattagctatctggtgcatggtcagggctgtgcgcctcactgctgggcgatgcgctaaccctgttgccacgatcaacgtctgatgtacgccatcggcgcgtttttcctctcgcacctgctgtacaccatctatttcgccagtcagatgacgctctctttcttctggcctctaccactggtgctgctggttctgggtgcgctgttactggcgattatctggacgcgcctggaagagtaccgttggcctatctgcacgtttatcggcatga

SEQ ID NO: 598211 - DNA, 162 bp, Homo sapiens
ggagcgggaagcccagagtgaaatctagcatctgccggctggtctgcccggccctaccttcctttcggtctgttctgcgcgtctgcgcgtggtcgtctgcaactctattatgcagacacgagaagaaatagaccaaaaaatcactctcaaccacagcttaac

SEQ ID NO: 598212 - DNA, 153 bp, Homo sapiens
  misc_feature (25)..(25): n is a, c, g, or t
  misc_feature (139)..(139): n is a, c, g, or t
tgagtagcacataggcagtcatgcnagctcataccaattcgcacatagacctacaaacaaaggaccacctttaggaccaacacaggctagagcacccctaggaaaggtgggcacagaaataaatgcaccagtcagtatngctagtaccgctga

SEQ ID NO: 598213 - DNA, 256 bp, Homo sapiens
ttatgtctggtaggtgtctgcgccgagtgacgtatccctccagcacgctgtcacttctatacaggaaatagggggcgatcgagtcatctcgctgcctactcgacaatcttgacacctgacttgccaggatgcacatatacatacgtagaccagtttcctcttggtaacttcagtaaagtcaaaacaacacgtacctcataccccatatattcatatataattgctcgtaagatagtatatcttgaagctgtacaca

SEQ ID NO: 598214 - DNA, 348 bp, Homo sapiens
ttagctatagcagaagcatgtcgggcgatcaacaggcacagtgttgccaaggaatagtgtactgcagtagtacccgaaagctaatatcgttgcctatcatgacagcatcatgaaccctgactatcatgtggaattatccgcacagattatactggtaatgcatgctttagctcacagaggtgcccaaaaccatgttaatagaagtgcgcctagtagcatgatgctcctcttattgccaagtggcacagctgggtatcttggccaagtacctactatcaacaaagggtgtgcaccgagtgttatgagttgtcatcctaagccgctcccagagacaccgtcgaatacgag

SEQ ID NO: 598215 - DNA, 192 bp, Homo sapiens
attgagcgcagtctctggccaatagcaagcaaggaactgaggcctttggtggaacagcctgccctagactttgcaatatgcatttacaatgaatctaagcccccttttaaataacagtgtataatttcacagataatgtgattataagaaaataatcttatttccttcctccagtccattttgttattgctg

SEQ ID NO: 598216 - DNA, 840 bp, Homo sapiens
ccgtgtgccgccgtccccacacaagtccgggggatttgttccgcccccccgtttaccgcctgatgttttcggcgctcccccttctccgctcgctgttggaattgcgctcgccgaaagcccccctggtggtggtcacccgccctccaccggtgctgcctttataggcacaatatgttttcgcccccgtttctatatattccactaggatagtccgcgcgaccacaacatgttcaaacaagagtattggtcaaacgtccacaagtcggtagaagcacacctttggttgcaaaaccgtttatagacgcacgcacacacccattccacacccgtgacaattggaccacggatttttaacaaaggccctgataggaggcccgccagtattccccacagggcataataataatcgtgaaaatcctttttattacggcagactcagtgagcatagtgatatggagaccgcaccaccccgggcaaggaggatagaaaatgtgccaccctctacttcttgtattataaaaaacgcgcctactacgcaacgctatggtgaaagttagactaaagtttatctcagtaagtagaatttttcgatgccccgttaacaccccccacttcttgccccgctaatttactcttggcagtcaatccacagactggttctattgtcttttagacacgggcgagatgcgcggtatcggtgccacccgcaaaccaaccttgtgttctatatatttgcggagccgcccccgggctcaatgtcaaatacaatgtaggtagtcgcgggcacgccactaacttcgagctcacccacatatgccccaatacaccgcgccacataac

SEQ ID NO: 598217 - DNA, 343 bp, Homo sapiens
atgtgcttgaacctgagaggtggaagtttcagtgggcgagattgtgctattgtactccagcctgggtgacagagggagactctgtctccaaaaaaaaaaaaaaaagggtaaagttgagtggttgagggggttattatgctcgggttgtcttgatttcaaaaaaagaaaatttttttttttggttggttggttttttttggaaaggggttgcttggttcccccggggtgtggaaagccgggtgggtgccatatcattagctcagtggcagcccttcacccccccaaactctacacgctgcgttaagtgcaggctgtggggtatctcctcaaaagtctcacccgt

SEQ ID NO: 598218 - DNA, 457 bp, Homo sapiens
ttttacatttacatagctctgtaaaccactgcccagatcaagatctagaacatttccagcatagtatgtctgtttttaatttacatcatatttattatgcagcttgtggggcaaattcactgctttgtgggtttactctgataagaatattaatcagtgtgcatttgaagaaatttaaattattttgaaatagtagaaacatcatcagaaggaatcttatttttggaattacatgggagcaaatagttttcatattgtgcccacaaacaattccttcttgctaatagaccttcttgtagcatgaggtaggagctctagctcttctgctggtagtccttcctggaggggttagtaagtttaataataatatatatctttgtaatgtgtggtgttttggttaaaacttttttttgccttaaaaattgttttgaaggaataagatggatttgtgaaaaaa

SEQ ID NO: 598219 - DNA, 1410 bp, Homo sapiens
atttaactcactgtacgtctatttgtttatttattgttggagtagagcgagagcaatggttccattctacagaaaaaaaaaaaaagagtctgatgcccaggtttcgttctcagtgattaaaagtgaagattttttagaaagtgtgagaccacggtctcacgtgaatattggctaacaacactgtgcaggcaaggctgtgggcaccaggtggctgtggcacttagtaactcccaaagggtggggggataacagaacgtgaaatatgagccactgtggccccggcctatacagtgtttatagctctcgttataacttgtggcaattcacaccacaaatgtgccttggccacgatatagaaaagaagtgtgtggcgtgtgccattgagattcacctctgtgtatcccgagcgccaaatatgtgggcatacaaatccacaataaattacccactcttggaaacagtgtgggctggtatatcaacggtggcactcccttttcacccatctgtgagagaaagcgcccgtgaacgtggattcaccccgagaaagttaccaaaagacgacggggggcccctcgtgaaaacaggttacaatggggggccggacatacctaggggaaaccgtggcatctccaacaaagggggaacacatcgacccgggggggagaaataaacccctaatgccgcggcgagaactaagaacagcaccaacacttacaaaaaaacccgtgtgtagcaacacaaaagaaggatccaattaaagtgggcaaacagggcggaaaaggacagaaacaagccacataagagggcacaaggagacgccaaccaaaacacaaaaaccagaaagccagagtaggacagagaaacaccacaaaagcagggaataaggggccacgtggacacccccacaaaaaagcgggcacaacatagggacacccacacggaagggacacaacacaaagggcgaaaaggagtgggagagacaaggaagcccttacgcaaagggaccacacacaacaacaacccacgttgatgtctggcaccaaggagaaataagcaatgaagctagtgaaaccatgtcggaaaaccccccgagaactacaagagtggtaccccaagaagagtgatacgagaggagcgacgtagaaacacacaccccaaaatgagccccgcgaggatgacgtagacacactagggaacaagagaaatgaaccaaacccgatggctgagactaacagccaatggcgaggagaggaaaccacataacaacagacatgatctcgcaacaacagcacgagccaacctccggggcagacaccaaaacaaaagaaccacgacagcgcattagacgcaaaagaggcgaatgacccaaaacgaaacagtaacgacagccagcaacatagagcagactgt

SEQ ID NO: 598220 - DNA, 540 bp, Homo sapiens
  misc_feature (52)..(52): n is a, c, g, or t
  misc_feature (167)..(167): n is a, c, g, or t
gtttgactattggtcaaatggactctaatactcaggtctcctgacccagttnttactgtcatttctattctacacagtatactctgctatatttatttctcttgcctttagcctcacatgacatcagtctcatttttctgtttcaatctgtatccatcttcctcttnctcttcctctcctgcccttctctacacttatttattgacttcttgatccagttatttaacattccataatgagctattgtgtgccaggcactgtgatgggcactggagatgcaattcatgagacagttaggcttttgcaaagttccctgtcccagggaagcctgcctgaggatggggcataacagcagctctttcctgggggaaagacatacactaatgacacatcttactctttccttcacacagaaaagcatgtcttgtcccttactctgctttcccaggcctcatcccatcctgcataaatcactgctgcatccaccaatctccctgctccagcgactgtatcatggtcaggttctggccatgcttcttc

SEQ ID NO: 598221 - DNA, 209 bp, Homo sapiens
cgtctgactggggcggttcacccctccttaggcaactggtggtccctccgctcccggggggagcagttgatgccgaacttagtgcggacacccgatcggcgtagcgcactacagcccagaactcctgggctcaagcgatcctcccacctcagcctcccgagtagctgggactacaggttgcctaaggagcgggagaaactgggggtgag

SEQ ID NO: 598222 - DNA, 218 bp, Homo sapiens
tgccacacatcataactatagtactggagggtgtggcctttatatctgtgtctcagttttccccgactccgtttcaaaaacaaaaaaacaaaaaaaaaccccagaaatcagatcaggggtagctttaagggaaaagctatacaggcaacatggtggggtgataaaaggtcctgtgtctggacagaggtgctggttacgtgggaattggattggtcaaa

SEQ ID NO: 598223 - DNA, 1833 bp, Homo sapiens
  misc_feature (308)..(308): n is a, c, g, or t
  misc_feature (729)..(729): n is a, c, g, or t
  misc_feature (1196)..(1196): n is a, c, g, or t
  misc_feature (1833)..(1833): n is a, c, g, or t
ggtccacaatcgagcgaagtcttcacagatggggacggccctgtcatagttcacaagaagcctgcggcacgcccgtcgtggagtgcatgcgcgtaggatccgcatgatgccatggtctaacgctggatccgtacccgatcttcggagaagctcaagacgcagcaatgtgaccaacgcgagagcggtggtggcatggcgttggatgcgcttggaggagtctggcacaatgcttgttcatgctctgtgcccgaagagaggtcactgtcccggacgtctcatgactacaggctgactagagattgcacccngtggttgagacagcgaagatagcagagaggatgatatgagtatcatagcaagaaatagtcaaccttgaacaactcgcattgggcggcgttggacgacagcaaacctgagttggtgtccacgcagtgagggggggtatcaggaacactgtgctccgatatagagttggctcttaggtatcattgaaagtctcctcaacttgaagaagacttggttggccttgacatttggcataggtgtgtgcccccctgggtggcttaatgatcaggtcgtccttggcaaaccgggcaccacgctgtgcaggagaatacactcggttggagggcccattccaatatttagcccccacgcgtgcgaaccccaaagtggttctagaccttgctactttcccctttttaccctatgggcaccccttggccaacnagtgttggttggccttggtatagagtgggctagcgggtttcaacccggtaagaaagcgtcaaatccttgacgtatttaggccgccgaccttttagctcctaccttttcttgtccggcattcttggtcgcttcgtgtccctcgagggtctcagtccaattcgcggttcgaattcgcggtggggtgcactccccaaggcacccggaccaggggcaggttgggggctctttcgtcttggattggctcaacagtcccttgggaggtcattttctttggaatgaatcctccggtttgctaggtccccttaatttcggccaggacttccaagttaactcaaaagttggcggtgcaagttatagccatatccctaagtcaaagggagaggcaaaaggacttgttgggcaattcccttcgcatttacccaactggaggggatgggcggacaggaactgggtacacggaggagggnaaaaagaacccccgaaggaaagagtagttttgttccctcgtgcagcggaggatgagaaccgtacaccggggtgggggacccccagtgaaaagtggggccaggttagagcatttctgagccctttttagcagcgagaagggaggacacacaggcgtaacggccgggcgcggggtcccaaggagggcataccccggtggggaatccctgccggcgaaagacggcgttggcggcgaacgtggcaagcgaagaagccgtcgaaccaacactgggcggtgcctcaagaaagattctctcaggagagcgagcaccatcagttacgggcgtgcactctaaacaaacactatgaagagaaggagaccccgcgcggcgtctattaaacaagcgcggcgcaaggacaggcagaacacaacgaacgaagcgcacagcataggcagcaacaagcgacacgaccttcttacatcgggagaaaccaggagccccatcgaaaaagcgagtcaattcatccctcgtccgcacagacagcatgacaatgaccaccctacatgtatataagcaagacatgaagcaagagcgatggagtacacataggagtatgtagaagcacgagtgactgaacgagtagacaaacgaacatccn

SEQ ID NO: 598224 - DNA, 487 bp, Homo sapiens
gaggaccacttcctctcctcccacctgggattataatttaacatgagatttggcacagacacagattctaaccatatataaactcaaccatacatttgataatgactattattactgatattttagtgttgacaaggcttaagcgtaaaattacttgcagtaatgtatctgaattcatctccaaataagggagaggagaatgtatattagtggtactgcctcttgcagagttggggtgtcatagaaggactagtcttagactcttggcaaaaagtctctgtaaaaatcaaatagaaatgaggaactgtctttattattattgatcttaagtgtctgctgtggtttcctaaaaaatctaaataaatgaataacaaaagttatgcacagaaaaagaactaaaaacaaacaaaaaagcatgactggcctagcatggtggctcgcatctgtaatcccagcactttgtgaggctgaggtgggaggagaggaa

SEQ ID NO: 598225 - DNA, 218 bp, Homo sapiens
ggccgaatttctaattacgggcgcgataaatgaatcatacctcagaagaatggccatgtgaccgagataaaaatgatctgctctgctgatcatgaagagatgagaccagcaggactggcattcaaacacctgtcgggggccagggacatctcacgctttcattctttcagaaaacattttttttcttttttttttaatttatttgtttggtctaattg

SEQ ID NO: 598226 - DNA, 887 bp, Homo sapiens
tgcactcttggcaagagcacacaacaaatgtcagataccaattttggcaaattagatttaatcttataaatgttttatcttactctttctgtacagatatatcaaatcacatgaaatatttaaagttggaacaattataattacctataaagctgtggaaaaacttggaagtttatattttgggaaaaacatttcacttttcatcagaagattatattattacatacacaatagcataactgaagggatgggattacgctgaaacgtggtgtcgggttccaaataacctttaacaaatcatgtatctctggggctcgtgatcgtgtcagagaaataatatatcaatatctaaaattataggggtagagatacatactatttctccatatgaatttgaagatatttagtgcttacaagactgctgaaagcaaatccagttgctcctgtgctagatggtagccagagaatttttatagtaatggaaggttaggccttaatctcttcatgtgcattttcatttctgtaaatcagattaagtcctttaatattattttacattaaaattggggtgtaatcggccattaaactttcacaaatgtacttttaacacggattaattactcatttagtcatttacacaataatattgcatactatctacatgggagaatttgaattataaggatatacgaatacgtgagaaagtataatgacttttacgcaaaaacgacgacaaccagaacattttggcggccgccccgaagttttaaactcgtgtgggccgccaagtggtagattgctaggtcaagaaccgtagaaggtgggtcacaaaaagcggcggcttaaccaagtggttggtaagaggaaagccgggggggaggcacaaa

SEQ ID NO: 598227 - DNA, 341 bp, Homo sapiens
cggttggggagtatggaatgtcacaccgatttctcactggctttagtctgttacttttcgtgctttaatgctgaactgtaattacagattcagagttatgagtgctcagctcctcagggctaattaattagtcggatttataagtatttggttctcagagatcaatgaccctcattggtcgccttaaagctcttagaaatccctttcctgatagctagttatcttgggaagcggtgggcttgggagagctgcttttgctttggtggctggttgagacgtacagcctgaacactctcaagcagcctggagaccatagtgccctctgatagtcgccagccgga

SEQ ID NO: 598228 - DNA, 437 bp, Homo sapiens
  misc_feature (350)..(350): n is a, c, g, or t
  misc_feature (361)..(361): n is a, c, g, or t
  misc_feature (389)..(389): n is a, c, g, or t
  misc_feature (392)..(392): n is a, c, g, or t
  misc_feature (394)..(394): n is a, c, g, or t
  misc_feature (397)..(397): n is a, c, g, or t
  misc_feature (411)..(411): n is a, c, g, or t
  misc_feature (414)..(414): n is a, c, g, or t
  misc_feature (416)..(416): n is a, c, g, or t
  misc_feature (419)..(419): n is a, c, g, or t
gctgtgatctttcattatacaaatttgtgccttatgttataggatttttctttttttaaaatttctcttttcctgagtcatcatgttaccaaggcagttgttttgaaaatgctttcttatcttcctaagtgggatcatttcttacaaatgtagacttttccacttagaaaagaaaaaaatctgttttcatttgttttcaaattatttttctttttaatggcagtttgattcccagtttgacagccatttggagctgctgaaggggaaaaagaaagaaaaaacccaacattttttcatgttcctgggtgaaataaatctgtttagtggaatattaaatgcccaaaatgttncgattaatttnggcaaactttagacaaatccaattgtcnttntnttncaaatatatgattncantnaangagaggaatttccaaaaa

SEQ ID NO: 598229 - DNA, 401 bp, Homo sapiens
  misc_feature (153)..(153): n is a, c, g, or t
  misc_feature (174)..(174): n is a, c, g, or t
gtcagctgcgtttccgcggatcgcgagttgaggagctcaagctttgggaaacatggtgtgcattcctgtgtatcgtcattccagttctggctctgggatctacaaaaaattcctggagccatatatataccctcgtggtttcccccttcggtnaagtcgtatattgcgcctaangaaaaggcattacaaggaattccaatggataccaaatcaaaggggcaaagggtaaacctttaaacggggtgcaggactttgaagtgggaatttagcccaatcaaaaggtgacccaacagagacacttctggtggcatccaagcggacaaggacctaacgtgaaacatttttcccctaaaaggtgacccccaattccatttttacacacacacttggggacccttgga

SEQ ID NO: 598230 - DNA, 306 bp, Homo sapiens
  misc_feature (63)..(63): n is a, c, g, or t
ctcagacccctgagtagctaggactacagacatacactactaagcctggctaatttctaactnttattttatttattttttcattgttttttgagacagagtctctctcaagttgcccaagctgctggagtgcagtggcgcaatctcggctcactgcaacctccctaggttcaagtgattctcctgccatcagcccctggagtagctgggattacaggtgcccaccaccatcccagctaattcttgtatttttttagcagagacagggtttcactatgatggccaagctagtctcaaactcctgac

SEQ ID NO: 598231 - DNA, 114 bp, Homo sapiens
tagaggatccccaagcagttaatacatgactcaccaagccacagacttgtcttccacaagcacgttcttaccttagccacgaaggcccaagccacaggtagtaaagggtggaac

SEQ ID NO: 598232 - DNA, 1415 bp, Homo sapiens
ccagaagtgcgacgttaactttgaacggtgcttgtctgtattcacctctgctaggtttacctctacaacgtaaaatctcagcagctatgctgactgaccactacagtaactagtctcttagagactctcgctatccaagttcccccctatcccccaggcttagtacactaccgctagacactacctttctcactctttactccaggtcatttcctagtaaacactggcatagcctgcactcttaaagactacctcccatcacccttccacgcaatcggcgaaccactcaactgccgaagttgagagccccccaatgcactcgccataacaatttacttacaactacccaccaaaccataacacaagccgtacgaccgtaacacactatcccgagctcccccatggccatatcaacaaccgtaacaaacatcaatttacctacccgttgcagttcccccacctaacttactctaccacacccgtcccaagtatatttctggcaccattaccccaaatcacacgcggccaaaacaccactacaactacggcgagtggctatacacccagtcccccatgtccaggcgggcaccgcgacaacaacggccaaagaccgaacgacggctgcgccacaactacagcagaccaacaacttccctctggcaaagacgaacacaccaacgacaaagctacgcaaacgtacacacgcacctagtgcgaaccagagcgacacgcccgtacccacgacgcactcaacgtgcggaccacactggctctgcgcagcccaccgcgacacgtgacgaaccccgactggcttctcgacgaccccaccaccacgcacgctccaaagctcacgtctaccacataatagtcaacagcgcacaacccatctcacaccacgcacaccgaggagcataaccccgaggggaccctccgcgcaacacgcaaggcagccacctacgctcacaccacaccaaccaaggacaagcttaagcaccacacacgactcccaacacggcaacgctcggcacaacccgccacccggaccgcgcagccaagataccgaaccccagcgctaaacaccgcctacacctaaaacccaaccctccgctgcgacacctacatgtgcgctcacacacgacatacggacacctaaacaaacctaatcgaaacaccccataccatgacctacaaaattgccgcccatagagacaaaactcaggtgacaacccaacgtccagcgaactacaagcatgacaacaacgacaaggccgacccagcggaaacgagacacaacgcgacaaaatcagcagatccacgcacacactccacccaacctagcggccgacacacagaacaacacacctccgccacaccacgaccaagccgcccaaacgacaccaccacaaaacacccac

SEQ ID NO: 598233 - DNA, 252 bp, Homo sapiens
ataaacctaccgatgataggatattgcatgtggtgtatgcatcggagcgtagtccgagtaacgtacggggacattccggataggccgagaaagtagtagtgggaagaaggtatagatttacgccgatgaatattataagtagaaatggattttggcgtaggtatggtctagggtgtagcctgagtaataaggggaaatcagtgaatgaagcctcactaatagataggcaaatacagctcctatagataagga

SEQ ID NO: 598234 - DNA, 231 bp, Homo sapiens
cttcaccagaccctggtaggcagaagcatggaagcaggcacgaagtatgaagcggcagtaagcaggaagactgagcagaatgcacgagaagccctcaccaatacccttgcagaagcatgaagcagtatgatgaacaagcatgaagaattccggtggatgatactacggatccggcgaatggctgatcgcatggatccaatgcaatcaatgtcccgggcataagcatgacag

SEQ ID NO: 598235 - DNA, 656 bp, Homo sapiens
  misc_feature (236)..(236): n is a, c, g, or t
ccctgtgaccccaccctggttagagagaatgccccccccaccgccttttccccaatgtgcccaccacatggtccacttaaatgctctatcttgggaaaataaaagagttgacttttagaattcctatgaagaggcaagctatcaaaaaagaaagaagggctgaagccttttgccccgcagaaccctggaactccactcttccactggagaaacgctctggctatagacactgcttncccaatgtagaagaggccctttatgtaaatacccgcccacaaggcagacaatctgtatatggagacaaaaacacttttctccaagaaaaagcgaggtttctctttgaccacttaatatatgagggccaatgcgcacttaaaaattggccctccacagcactggctgctacccacattgcacacaccacatgcacggccaatccacgggaaggacacacccacggctgggggcgcgcatgcctgtgtgaggtcctgtttttacctgtctaagctgccccaccggggcctactcacttattctgttcaccccctctcctcctgctcacgctgagacctgaaactatttgaaatggctttatgtccccgaagactttaatccctccaattcttgtataactttgaataaatggttaatgttca

SEQ ID NO: 598236 - DNA, 371 bp, Homo sapiens
  misc_feature (360)..(360): n is a, c, g, or t
ggagttcaagaccagcctggccaacataatgaaaccctgtctctactaaaaatacaaaaattagcttgggcatggtggtgcacacctgtaatcccagctacttgggagggtaaggcatgagaattgcttgaacctgggaggcggaggttgcagcgagccgagatcatgccactgcaccactgcactccagcctgtgtgacagaatgagactccatctcaaaaaaaattaaaattaaaatcaaaaaataaaataaaggccaggcacggtggctcacacaggagaatcacttgaacctgggaggcggaggttgcagtgatctgagatcacaccagtacactccagcctgggagattgtttgnctccgtctcaa

SEQ ID NO: 598237 - DNA, 388 bp, Homo sapiens
  misc_feature (7)..(7): n is a, c, g, or t
  misc_feature (19)..(19): n is a, c, g, or t
  misc_feature (58)..(58): n is a, c, g, or t
  misc_feature (320)..(320): n is a, c, g, or t
  misc_feature (331)..(331): n is a, c, g, or t
  misc_feature (339)..(339): n is a, c, g, or t
tcgggantggtcccaaccngggaaggccactcccccagggccccctagaactctggcncaaaggctctctgactgactccttccccagatcttcctcacttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactccgtcctgccntgcaggatccntccccacntgggttcaccgttccagaataaagctgtgcccatcggaaaaaaaaaaaa

SEQ ID NO: 598238 - DNA, 99 bp, Homo sapiens
tgctgaaattacaggtgtgagccactgtgcttggtaagaagttacttaatttttggtttttttttatggagatggcttttcgctcagttccctaggctc

SEQ ID NO: 598239 - DNA, 272 bp, Homo sapiens
ataaattaatgtcctctctggattggggggtgaattaccactctgttagttcctatgagagctggttgtacaaaagagcctggcacctccttcctcaccctcttgcttcctctcttgccatgtgatgtctgcatacactgccccctttcatctgccatgagtggaagcagcctgaggcccttaccagaagcagatgttgcaccatgattcttgtaaatcctacagaacactgagccaaataaacctctttctttattaataacccaaaataa

SEQ ID NO: 598240 - DNA, 246 bp, Homo sapiens
tgtgtagctccattggtttcagtgcagtacacaccccagcttggtcatgtgtaaagtgggtggtagagcaccagagggggaccccatcattttcttgatttacagtagtcagagagctctgttctatggggataggcctttcctatcctgcgcctctatgggtggtgacacgaagaagccactccatatatatacgctgctgcacattataactcaaactccaccatccacaacactcactgctcc

SEQ ID NO: 598241 - DNA, 415 bp, Homo sapiens
ggctgtgttcccggtggttgctgccgaaatgggcaagttcgtgaaacctggaaggtgggcttgcctgctgacgctactccgacgcaagctgcatcggaagaacattgatgatggcacctagatcgccctacagccatgctctggggctgaattgaccgtcccccgcaaagtgacagctgcatggcaagagaagatcgcagagatcaaagataaaatcttttggaaagtgataactacaatcacctaatgcccacaggactctgggatatcccttggcaaaactgcgcaataaggatgcttagagatctgcttaaacgcaggccgcggaggcaggcaagttgagagagatcaagacagcaagacaagtggtcttcagaaactgggttagatgcttgtttgatcattaaaatataag

SEQ ID NO: 598242 - DNA, 1295 bp, Homo sapiens
ggagaggacgcggtggcgggtccagctggggctatgcgaaggcacagattccccgtgcagagctcacgatcgagatgcccgcagcaggagtccgacgtcgatggacgtcctccgggtcactccacacgagcagtgagccaggagttaaaccttgggatgtgcccgtgatgttggaccacaaggagcttagaggtccgcagatccaactccttgaaaactgaaggaaagaagaatgcgcaggagaacactctgggaatactccattcaatgaaaactgagagactaacgtgtatacatagctgggccctctctacgaggtcctcgggcatcatccactgggtgtccgcatgcgcgtgggccggtctcttcttctccttttgcgatttgattggtctcgtgaccgtatttaatgtccgcgtgtgtcaactacaggtctcaacttccggtccatcgcccggtgtccaggaccggtgccagtgcggtctatcagggcggacaatcgctgaacagggacttaccgacatagccacgttggcctggcgtgcttaggtcgtaggttgaaacgtttgccttcggactgggtaggcacttgagtcattacaaagcacgggggaagcaggggaagtccaaatcgaatttgtttcggttatataagccattctaacttcagatcaagccaccccagagtaccgccaagtgaaagaggccatattttgtcgagggcggcagaatatacctttggttgattgggaagggcaaaccgcgactatatttgccaatccctttcgcaatagagaggccgtatttgggcgagcccttgtgatggctggcttccgtggttgagcctgaagcagcggcacagttcaaaggtgccctccttggggcggaccaaaggagccagtgatgtgggcccaacggcacccgtatcgaccaacatacagggtggggcgtactgctaggcgttgatgggcccccccagaagaaatcagacgggaagggacaagcttctgaacgtggcacacccgtgtcattggccctttgtaagtcccctggggcttgggtgccaaagatagccaccaggatactgcgagcaaatcaggcacgggcccaaagaggagggatcccaccacggagcgaccaacccccagtctgggaaaccaaagcaggcagacacgggattcacacctggacgcatcgggggacacccgagcccactggagggaccccgtcctgaataggaagcgcagcccctgaagggagcgaccaggggaacagcgcggcccacacaaacgccc

SEQ ID NO: 598243 - DNA, 158 bp, Homo sapiens
acctaacctgggctaatacaggaatagggctagctagtaagtctagcgcagtcacatttgacccgggctttggtggttatttctaaatttttgaggtgcttcgctatttcttgtgtgacctgatagttccctggaactttgggtctgtgtgtgacaca

SEQ ID NO: 598244 - DNA, 1101 bp, Homo sapiens
  misc_feature (379)..(379): n is a, c, g, or t
  misc_feature (695)..(695): n is a, c, g, or t
ggcttctgtgctacacaaccccatcatgggctgtcacagacaccatgaaccactcacatgctcatttgggtgaacgatggcacgccactcgactcgaatagtgcgaagaattcctagcatgttgtcctcttgccaggaggtatgctgttggcatggggatagcgagatcgagacgcttgtagccgttgttacccatgctcctcacaaggcatgccatggggccgagataatagcgcagacaaaagcagaccatctcagacgacatgactcgactatgttgaccaatatgatgcgaagacgcctgttcccgtaagactcctcgatctgcatgaatggcacgacccggacatactagattcgagccaataggtacatgtgntacaaatagtaccgttggtttgcggcctaggtctggctctgaagacaattgccacatttaggaaaggaatctactacacatcccggtggcggacaacctacgaagcggacccaatccactacaagtcctgtgtttctccggtcgttttaaacaggctacgatcatttaccaatggtcctggggaccctcctggaacacggttacgtcctaacataccgtccaaattcgagagccgcgcagcgcaaggagtgacctagctggaagtcaacctaacctagtgatttggctcgactagtgtttggttctccctggctgntgggcaagacgcgggactgattgatagacttctaagcgccttatcacattgaacaatctcccattgttttgccgtgaccatttgaacgtcgtcggtgggaaaagtctttggaccttttgcgcggaaaataggtctattgttaaacgcaacgcgaatttgggtccttggaacgtgtggcaccttgcggcctaggaaattcgaacggcgtctaattccagaattggccttagaccccaaaggggagtccttcgcgttcgagataccatactcattaatagttccccacttaaaccgaaaacgccactgcggaaccgaaaggccctcggtgaagtgccggttgtcttggggcccaaagggtttccccaaacgccgggcatgtggctttgctcccccccacagaactttc

SEQ ID NO: 598245 - DNA, 221 bp, Homo sapiens
taaaaaaaaaaaaaaagcaggggctgcccaaactttttgtttcatatttccctctctaaaaaaaaaaggatcctggtttttggataaaatttttcccagaatcccaaaaaaaaaaaaaccctagaattttatccacaagatcagtttacagggcccagtgggtttcttttccaactggcaatgtttaggttttaagccaataaagttcccgtttatgtgga

SEQ ID NO: 598246 - DNA, 442 bp, Homo sapiens
agtcatctcccctgtgcacagacagagaaatccattgtgcaaaaagtgcttccctggcagccgacctggagtccaccccagcctttcgccggtgctggggacatcagcgttctggctcccaggctggggagtggctccgaggatcggtcacggagcctcctgggtgtccgagctgcctcaagcgccccggggtcttttctgacttgatctgtgtttttgtcctgcggaggagtcgggagctgtgcctccatctgctgcagctctggggtgctgctgccctctctcacctgctagccttcggtgtcctggtccctcgtgttgcaagatttcatgccgtgtctgcagtttctggagagcactgagcgaggtgccacacgctgccatccgaactcaccacagacactcatgttttcatcggtctgctcttctgtcatctctcatt

SEQ ID NO: 598247 - DNA, 1414 bp, Homo sapiens
caggacccccagagggttgccagaagaagcaggcgtttttgttaacctcccgccccccgttcgatgatggcggttccttaaggatatccgaagcccctctggtggcgcgatattctgcgccccccaggggcacacctcttgaaggaggtgttaaaagagaagaaagatagacaaagggagggttttcccctgccttgcgcccccacagaaacccccttttgtaggaatcaatagcgccggagaggagatattttgcgcccagaaaccactgtgataatgatctccctaatgccccccctgtgtgaagaaaagagaaagtgtttgtgcccccccacaaaagaggatggcgttttcgggaaaaagggcccaaaggggagtgggaaaacctttgaatcgctgatggtgagaatgagccctatagccccccgtgggtctgcgccaaaggggaaatatatataggccccagagaatagtgcacccagggaacctgtggaaaatatgccgggaattgggccggcagagggattggcccccaagaataaaagactcgtgcccaaaacgtgtttcgtgaagaggtggaccctcgcccagggaaccccccccgcaattttggggcgcttgtttgttccacatacccagaaatattaccagacgaagggtttatacccacaataggggagtttgtagacccccccaaaagggtttctcacaaaagggttgttttctcacgccttttttgttttccccgctttctcgtcacacaaatctcttcacacatgtgaaaaccccttttgtgtgagaaagcctctcacaaacacagggcttttctgagattaacacacatctctttgaagagagatttgttagggagccccacaagatattttgccacatgtgggggtataccccccacacatctctggaagattccacgctataagatgagaacgtatattgtttaccacaaggcgcgtgtggtttaatggccacacaagatcacagtataagaaacgcgagaatttggctcttgaccacagagataacacgcctcttggagattggctcgcaattttctctgtgtataaataccgcgccacttacattctgccactgtgaaggagatttgaatgttcctgagagagattctaataactcggttggagaaaacgcgctttcacaaagaggccaaataacttccctgtggccccttccaaattgtctttctccacacgaaggtgtgaaatgaaagaaaaaagagccaccccacttttgtaagaaaggtggaagaatgctggccacacacagggaggaccacgagtccacacccgcttattaaaaaaattaactaaagtgtctaccctgattatttttctaaactggttggttaataaaccgtacccgctctccaaattta

SEQ ID NO: 598248 - DNA, 957 bp, Homo sapiens
  misc_feature (33)..(33): n is a, c, g, or t
  misc_feature (63)..(63): n is a, c, g, or t
  misc_feature (95)..(95): n is a, c, g, or t
  misc_feature (104)..(104): n is a, c, g, or t
  misc_feature (111)..(111): n is a, c, g, or t
  misc_feature (119)..(119): n is a, c, g, or t
  misc_feature (130)..(130): n is a, c, g, or t
  misc_feature (132)..(132): n is a, c, g, or t
  misc_feature (138)..(138): n is a, c, g, or t
  misc_feature (147)..(147): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (169)..(169): n is a, c, g, or t
  misc_feature (203)..(203): n is a, c, g, or t
  misc_feature (210)..(210): n is a, c, g, or t
  misc_feature (227)..(227): n is a, c, g, or t
  misc_feature (229)..(229): n is a, c, g, or t
  misc_feature (254)..(254): n is a, c, g, or t
  misc_feature (266)..(268): n is a, c, g, or t
  misc_feature (271)..(271): n is a, c, g, or t
  misc_feature (299)..(301): n is a, c, g, or t
  misc_feature (304)..(304): n is a, c, g, or t
  misc_feature (308)..(308): n is a, c, g, or t
  misc_feature (327)..(327): n is a, c, g, or t
  misc_feature (335)..(335): n is a, c, g, or t
  misc_feature (337)..(338): n is a, c, g, or t
  misc_feature (402)..(402): n is a, c, g, or t
  misc_feature (413)..(413): n is a, c, g, or t
  misc_feature (439)..(439): n is a, c, g, or t
  misc_feature (459)..(459): n is a, c, g, or t
  misc_feature (522)..(522): n is a, c, g, or t
  misc_feature (540)..(540): n is a, c, g, or t
  misc_feature (553)..(553): n is a, c, g, or t
  misc_feature (617)..(617): n is a, c, g, or t
  misc_feature (698)..(698): n is a, c, g, or t
  misc_feature (726)..(726): n is a, c, g, or t
  misc_feature (843)..(843): n is a, c, g, or t
  misc_feature (883)..(883): n is a, c, g, or t
  misc_feature (891)..(891): n is a, c, g, or t
  misc_feature (949)..(949): n is a, c, g, or t
aaaaaaatgtcatgacaaggggttcaaaaaaanagctaggggcccagtggttacaaaatatanccccaccccacaacaaacaggctaaaagaaancaacctggntggtttnaaaagagncgggcagaagncncccganccacctcanaaanananaaccacggccagcnccgccaaaaggagtagcggagacaagagaaaagncccagangccacccagggcccgangngctcctcgctcctcggacacaagtncacggaggtttnnnttnggaaaaggcgatgtggggccagctaagnnntgntgcncctgctgggctgggcagancagggctngnnagggcctccaggtccagccaaggtcctgacctacatgacgaccaggcccagccaaggtcctganctacataacgnagcaccgggtctttttctttttttgnttttttaaccgcagcctctntttgggccggtatttctccaggtaggttatctgcttgctgttgatggctccgcggcgcttctngcggatgaactggatggngttctcgtacttnatcccgctctcaataagggccagcgccacaaggactggagcccggcccaggcccgccacgcagncaacagccacgcagctgctggggggcctcacagaacttggccttcaccaggctcagccagttttccactaccttgccgggngggggcgcccatcgtcaaacggccagtncacaacggtgatgccatccttctccagcggcgttttgtcataggtcacttcacacacacgcaccacagtggtagccccgtacttcttcaggtcctcaatgaaggtgctgagcgtggngttggtggggttgtgggttatgaggaagcgcatgtttttntagctcanctccaccggggccgggcggttcatccgagccatggcgccttccgacgggcccggcagnaaaaaggg

SEQ ID NO: 598249 - DNA, 1021 bp, Homo sapiens
accaaggcatactgaacacattttttagcagctgggacaacaacagatatcagaaaacacctgccatttattaataacctaagcagcatctctataatactcctacctcccggcatttaaagtgtgggtgccaagtgcccaaagttgtgcatttccatgggacgagtcagaccatggaatcatacttcatgatcccacacaacaacaaagtgtccaaacagtgaggcccatgatccccaacatgcactcaatccaagagtttctacatcctgatggtggaacatcttataccaccaacgttttacctctgactatcaacactttggccttgtcaatagtacaccttgctcatctgtcaatgtggaagatgtctcaggagccatatcacagtctgtcacctgggagagactcccacgactactggcacagccgaaagaatccacggaagaacggaaaggaacgatgggacacaggaccacggcatgacaactactgaggacgcagactacctaagcaccacacatcaacagcgagccacctggccacctcaccatccagatcgcacacactggcgctacacatgagaacacaatccacatacaaacagacctgcaacctcgcacaccgaggtaccacgcagcctggacctgccacaaagatcaggtaccagacgcctcaacagacacacaccacacacctcgaccacaatgccaccggtccaccacgaccaccacggtgaccaccggcaaacaaccagagacacccaccaaaccataccaacacggacccaaacaacatggcaagtgcacacgcacaataaaaactaagcccagcaaacatcctccagatagggcgatcgtacacactacaagcactcaggcaacaccccgttatcacaaacgcgaccacccacccacacaccacgaacccgggtcacaaactacccaccacgacaacaccaaaaaagcgacctcaaccgcaagagcgaacacaaaggcccaaacaatacaacgcaaccaaa

SEQ ID NO: 598250 - DNA, 377 bp, Homo sapiens
tggacctcctaatttgcctaaatttgcctaattttgcctaaattttgcctaaatttgcgagtgatcttcctattaagtggagtcccatagagcagtagagaataaaattagaaaaaatggcccagccatggtggctcacacctgtaatcccagcactttaggaggctgaggcaggcagatcacttgaggttaggggttcaagaccagcctggcccaacatggtgaaaccttgtctctactaaaaatatgaaaattagctgggcatggtggcgcatgcctgtaatcccaactactcgggaggctgaggtgagagaagtgcttgagcctggagtgcagaggttgaagtgagctgagatcacgcaactccagcgtggatg

SEQ ID NO: 598251 - DNA, 246 bp, Homo sapiens
aaggtggaagcagccattatggatgaatggaaaaacaaaacaaacaaaacgtggtatatccatacaatgcaatattactcagccttaaaaaggaaggaaattctgatgcatgctacatagatgaactttgaggacattatactaagtgaaataagccagtcacagaaggacaaatattggatgattccacttacatgagcagtcaaacccacggagacagatggcgaatgaggagttactttgacg

SEQ ID NO: 598252 - DNA, 372 bp, Homo sapiens
  misc_feature (181)..(181): n is a, c, g, or t
gctgctggacagttcagttggcagtccccaaacgtaaggcgtaagagttaagaagaacggccaggcacagtggctcacacctgtgatctcaacactttgggaggccgagacgggctgatcacctgaggttgggagcttgagaacagcctgaccaacatggagaaaccctgtctctaaaaanaccaaaattagttgggcatggtggcgcgcacctgtagtcccagctactcaggaggctgaggcagaagaatcgctcgaaccccgcaggcggaggttgcagtgggttaagatcgagcaattgcaatccagcctgggcaacagagcgagactccatttcaaaaaaagaatcaataaaaatgttaaaagcacaaa

SEQ ID NO: 598253 - DNA, 207 bp, Homo sapiens
aaaaaccagaataagacacaaggcggatcgggaggaccaggatgagacacaacagtggcaagacgagaaagacaaagacatgggcagacgcaaacggagcgcagaagttgcaggcccataccacggagcgagaacaaaaacaacgcaagcatcgaacaggaaacgagcacgcgggcacaagaagaaacaagacccaagaatacacaa

SEQ ID NO: 598254 - DNA, 257 bp, Homo sapiens
tatatatagccaaatacaaggacgatagctggaatagacgagaatgctctagcagtcttgactagtactaagaaccagtcaagaatcataggagaagcctcgaacccatagactagtcactactaggaaataccttttagcatatagagtagtgtagtagactagggaacaaccagaaactctacaggccaaggtggtaacaaaggactggagagagaatatgtctagcaggaacaggcaagacatacacatataac

SEQ ID NO: 598255 - DNA, 229 bp, Homo sapiens
  misc_feature (219)..(219): n is a, c, g, or t
cagacagagtcttgctctgtcacccaggctggagtgcagtggcgcgatctcggctcactataagtctgcctcccaggttcacgccattctcctgcctcagcctcccgagcagctgggactacaggtgcccaacaccacgcttggctaattttttgtatttttagtagagatgtggctttcaccttccgccatgattgtgagccttcccagccacgtggnactgtaagtc

SEQ ID NO: 598256 - DNA, 154 bp, Homo sapiens
aaggagacacaggtagggagatggaggcccaaactggaacttcatttgtcttaccttggtgtcaccttgtatgtcgaactgcgaggattgcttgggccgaagggttgctctgcccgccgcgctaagctgtgagctgagcaaagccctgggctca

SEQ ID NO: 598257 - DNA, 212 bp, Homo sapiens
ggcttgatgtcactgaggaagggaccagcacgcctctaaggacagtaggaaaaacctaggcgggtgttagagcagggagtggggtcccaggagctgagggcccaggatcgacatgattctgaaggtgattgtcatgggtgccgggagcaggcggggacaccgtctaggcttcctaggggccgtcctgtgcctcggcggccacggtggggtac

SEQ ID NO: 598258 - DNA, 1282 bp, Homo sapiens
  misc_feature (334)..(334): n is a, c, g, or t
gcaataactggtcttcgtgcagacagacttggactgttgaggctgacatttggtacctctgcgcgtgtatgccacgatgctctatcagagcctcgtgcgcgaagcgtggtatggcgctcgcaaagatagatgcatagaagggcatcccacctccaattggcgtgccgtgttcatcgttccatagaattcctcagaagaaccttgtccacgacactagcgtagtcatgcgagtctaagtactcgctatgctcctattcagtgtgagtttcgagttgtgacagggctaggcattagtctatacgaagacctcgtcacttccgaagccccacattanctccagtgtatgactcctggaaaagccagccatggattgcaatgcgagcacggcatgaacaggcgcatagaaaaggagccatacgcgttacgctccacccggagcacgtactctacggacgcgcactaatagaagcgggcatgcgtgacgtttgaggagtggggcgatggtcgaaggtagtccagtactcctgtagtgcacgtcttgactattggaactggccagtagtgacggtagtgcaccaggtggtaagtcgcggaggcacgcctagtacgtaggcaacgggtttccccaccgctccttaacgctagtcacgcgactcgaaagtttcctagcagccagaaacacgactttacgaccagggtggggaacaggggcccctggccacgagattacaacctggacagacctgttgcagggcagtgctcggatctgaagtcacgcgcgaggcacgcaagtgctcgcccattggtggccctgctctcgaccggccgtgaggtcccgagcggcccgctctatccgggacagtagccctctaggaatgcagtaaaagccgatcgagagggccagggaggctggctggggcagcaggttggcgttgcgggcctgggtagagtaggtttgggggaaaaggaacacctggccctttccagggcgcatcggaggacgggcaagggaacgtttccctgggcaccaccccgattcggattccttccattggacttaagaggttagaatgtgggttcgcccacacctgtgggtccgtgaaaggcaaggatggttatgccaagcacgggggggacttcacgagcagaaagaccatataaggcaaaaggccagcccattagactttattacgcaactgtccagctgtggagcacgtctgcgaactatgggttgtgtaaactaagtaattacggaggtggcaactggcgacaacggaggtag

SEQ ID NO: 598259 - DNA, 1114 bp, Homo sapiens
atgacccaccaaatcacatgcctatcatatagtaaaacccagaccatgacccctaacaggggccctctcagacctcctaatgacctccggccatagccatgtgatttcacttccactccataacgcttcctcatactaggccatactacaccaacacactaaccatataccacatgatggcgcgatgtaacaacgagaaagcacattaccaaggccacacagacaaccacctgttcccaaacacggccttcgaatacgggcataatcctatattattacctcagcaaagtctaatacattcgacaggacttatactgaagactattaaccaatcacagacctagcgccccttacccaccccaaattaaggacgggccacctgtgtccccccaaaccagggccatacaccccccgcttacaattcccactacgaaagctccccactcgctaaaaccacactacgtaattacacctccgcacatcacggcagatactcaaagttccaccctctgacggctcaaccacaataaggcgtaaaatacgaacaaaacaaacccgcgaaaaccgaacgagtacacttccaaggccaattgggtttattacacacagatttacctgggaggcctcatacattctaccccactccctaacaaaggacctccaggacgctacatccggacggtccccccgtttccacaattctccggaaggagagtttacaagctcaaccaatatttatgggtagaccacagagcattcccaggagcctatcacacaggccaacaatcaacggggaggtcaaccatttatctctccacacaacttaggggactacatcccggccacactcaacacctctgaacctttataaattctccaaacggaataccactatagaggcgtttcgaaagacccgccgctgaacacactgggaacaaaaggggacacaacctgggaggccaaaaaccccggactggaacaccccaacaagcaaagcaggcaagcccccacacagccgagcagcaacaacaaaaaaccactcgggcccagcacccacccccaacacagcaacaccccataggccgaacacacaaaacaaaaccacgacaagaca

SEQ ID NO: 598260 - DNA, 81 bp, Homo sapiens
ctagaagattcagcaaagtacttttgtgctcttggggaactcattttgcctactgggggaccttacaccgataaactcact

SEQ ID NO: 598261 - DNA, 280 bp, Homo sapiens
aaaataaaaaacggactaaagacacccaaccgtaaacaacggaggactttgacaacaggctggtgaaccacttcgtggaggagttcaagagaaaacacaagaaggacataagccagaacaagcgagccatgaggcgactgcacaccactgcaagagggccaaggggaccctgtagtacagcactcaggacaacctgaagatcgactacccgcttgagggcatcgacttctatacgtccatcaccaaggtaagagcaaaggagctgtgtccgatctatccc

SEQ ID NO: 598262 - DNA, 818 bp, Homo sapiens
  misc_feature (37)..(37): n is a, c, g, or t
  misc_feature (69)..(70): n is a, c, g, or t
  misc_feature (220)..(220): n is a, c, g, or t
cagatggggtctcattatactgcccaaactggtcttnaactcctgggctgaggggatcctcctacctcnntctctcaaagcactgggattacaggtgtgagccaccatgtccagcctactttcttttcttaaaggacaatggattgcagcaattttattaactaggacattattatgaggattgccagagtataaatacagtcgggggagggagcttctnaagaccatctaccaaaaataccttaaaactactaatttcagtctataccctaaaactgacaaatattttttaaaattacctctaaattgcctccatgtttttatttggagattacaaaaatattaacatgtgtggtttttggaataaatattgactaataaaaaaacaatgatccgggccgcttccctttaaggaggggttaatttcatgatccctctctaactaacttccgtgatcatcgagacatcgggtgcggggaaacggtattaacctttcttagaggcggagaactgcggtgtatcaaaaaaaccgaggggaaatcccggggataaaacctgtaaagccgaaggagctacagagtgcctccggacccgtaaaaggcgcgggccgctcgggttgaggcatagaggcccggcgctcatgaagaaatacaacaagagagcgtgtcaaagaggacggggcatcaccatgttatgaataactaaccacagcaacgccgcctgagagacgtagttcaaatgtaaatggggaacgatggaagtaacacgtgacccgcataggggaagccaggggacgagcggaggttcataaagaatgt

SEQ ID NO: 598263 - DNA, 147 bp, Homo sapiens
  misc_feature (9)..(9): n is a, c, g, or t
ggtgcttantggtgagcgtcgagcgccctggaagtatacgcctgtgacctgccccaggaagcccaggccagccactgcaggtgggcctgtacccccaccccaggccaaagctctggaaccctgaaggccccagtctcccactcaata

SEQ ID NO: 598264 - DNA, 263 bp, Homo sapiens
aatccgggttcatgacatcacaggagctccaatataaggctccacagactaggctcatggacgagatgggaaggcacagggagaagggatcaccctacacccagatcccaggctgacatgctgactgtcctctcccctccagcctttagccttggcttttctagcctatttacctgcaggctgagccattctcttccctttccccagcatcactccccatggaagagccaatgttttccacccataatcctttctgaaccctg

SEQ ID NO: 598265 - DNA, 964 bp, Homo sapiens
gccggggcttgcgtcagcggtgtgccagaagcgggtggtgccaggctctgcgcaccgtggggttcggggccgggacgcctggcgggaggagggcaccggccggggtcccgaacgccggaggcggtgctcggacacgccggggctgcggagtgcatcacgcggcggtacaagcctcagctctgccgggcgccgaggcgttccgcgccgggacctgggttgggcagcctggtggccttatggcatcgggagcgcttcggcttggccctgcggggggagcgcatccggctttgaaccccggggtagtagccccggctggcaagggctgggccgcccgaagactcaccagggttatgggactcagggacaggagagaaattgaaaggccgagcgccagttcacatccaagaggggggaccacaacggcgaattaacataaacccggtgtcgaactgcaaaagcaaactactaggccggcctaataacccccacaagcaaacacttacaggtacccccgggtctatgtgacccactggtgcgtgccagacgcacccaatactctcaggtatggagggcacaccagaggactactagcacagggagatgttgcaccgtagcacagtgacggcgacgcgattaaaactatcggcgcccactgtaaggaatgtcttgtagcgacccctgcgccaccgttaattaccaccacggcaaatgacacccaagacgatgccgagcaccctacgctcttaaaccaaaaatcttcccaggtatggatgccaaagacacataagtgttcgggcccctcataattagagagcagaggtcacatggcgcagagacaccgtcgcttgtttgtcacacacagcgcggcacaacacgattgacgcttacttcccatggctacaactatgcagtacccagttacgaccactaaatcagggaaccggcgtactgcagcaacggtgtc

SEQ ID NO: 598266 - DNA, 419 bp, Homo sapiens
cctattaattgtcccccccccaagggggcaggtaacatgaattgcacttccctgcagctttaaagatgggtttagggtgaaacattgggccggccttaggggggtgatttttttatttcagaggtttggagacccctagtttgaaaaaggttattttgtttttttgtgagaatttagtaaacaaaaaaaaatttttgagtgaaaagcaagggattttttttgtaatcagggcatttgaaaattcaagccggcaaattcctaggggagggaagcaaaattaagttgtttttgtaaaaaaagaagagccttttttccagcaaaaatccctggggtaggcaaaagccctgattaaccctttccctttgggatgtttcccaaattattgatttgagaccagttgaaaaaaaggggccccctta

SEQ ID NO: 598267 - DNA, 244 bp, Homo sapiens
gttgctgctcgtgttgaatctagaaccgtagccagacatgggacttgaggacgagcaaaagatgcttaccgaatccggagatcctgaggaggaggaagaggaagaggaggatttagtggatcccctaacaacagtgagagagccattgcgagcgttggagaaatgtttaagccccggagcgctagagctttttattagctttttacctttgatcaaaaaagaagagatttcacgcggagctttt

SEQ ID NO: 598268 - DNA, 127 bp, Homo sapiens
atgtatttcttacagtattctcctctctttcacgtcccacatcttaaaagatgtctagtacggggggacttcctgaacatccttcaaacctgggccagactccatctcttctgtttaccacgctgtt

SEQ ID NO: 598269 - DNA, 2057 bp, Homo sapiens
aaaaaaaaaaacacaggcttgatgctcgctcccgtttctacaggaggttttgacggctggatgctgcagggcatcccctcgcctggaggaggttcacttgtggccaggttcccagcacacccacttgctcactggggccctggggacaccgccacactcgagcccatcctacggcctcaatccttaccagtccccaggccatggactgccacactgtaggtcttcaatcaaggtttagtggagtttcgaatgtacacacaccctgaaagacagcgaggccacctcagaaaacaacgcgcgcccagctggctcccctccgacagggcccacggctactgggtcggcctcctccggaccctgagcacagcctggtatgcgtgcgggctcggaatacggatctgagcagaagaaatgcgagtggagagcggttctgcgcaggaaagaggaattttgttggaaagcctgtcgacgttgctagaaaagaccacagcatctcacgaggggcgtgcgccgggaaaccgggagttgacggacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 598270 - DNA, 815 bp, Homo sapiens
cctaggctaggtacgaggcctggtgtttaatcggccgaggcgcgcgccctaccgaggcgcgggcgctgcagatggctcccagtcccaatgcctgaagcctgagcccgccccgagtgtcgcctgccccgcccgcctggctctctcgcctgtgtgatgcctgtctagatgggggaccacgaaagatgactaaggtatctcgcccgtgcaagaacaattggcaacggagcgccgtgagactcgtggcatgacactcacacgtagacggaggtggctatgacagcatcacaagatgtcagttggaagagtgtcttgcctggttaaatactaatcagcagacatgttgtgcacgggttattgatcccagattcaaaggcccagcgtagtatcccttgggcccctgttgtattggtggccttatagcgcgactcaacgcctacccgtcataccccatcccccagaagctgtggtccaacgttttgccagtgcgagctcttcagggggcttctcgcatccgtgctcgtgcgtatcgtgggctcatcctctgccttcccttgtggcctactgcgtattcctatgtgcggtgccaccgcacgtggacgacgccctttctggttgactaaccctttgtagccttggtggcatacgtttgctgtgccggtgcgtgagttgatccatcgacctgggcgtgccttcgtccctaccgtaccagtgacggcccaacgagctccgaggatcatggacgtccttcacggacacatggtgccccaccaaagccctggtgatccgcgccggttgcaggatgcgcggacgcctag

SEQ ID NO: 598271 - DNA, 164 bp, Homo sapiens
ctctagaggatcctccaactgctcacattatgggaagaaatgtcactaaattggacttggcttcctccatatagcacggaacaggtgaataaaagatatctttatgaagaattttgttgtgctattatcttagggttgatatcagagaccaatgatggcaggca

SEQ ID NO: 598272 - DNA, 1736 bp, Homo sapiens
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 598273 - DNA, 125 bp, Homo sapiens
gcataggaagcaggaggtaagaagtagggtcttggctgacaccatatgacgcactctcccctgaactctacacaacatatttggtgcctaggaagatggtagtggtgcagggtgtttatgatcat

SEQ ID NO: 598274 - DNA, 1661 bp, Homo sapiens
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 598275 - DNA, 1339 bp, Homo sapiens
gctgaaagaggctggcttggggccacggtgaactgcctcctcaccatccgtcctgcctccctggcgcccccaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 598276 - DNA, 4773 bp, Homo sapiens
  misc_feature (2853)..(2853): n is a, c, g, or t
  misc_feature (2991)..(2991): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 598277 - DNA, 411 bp, Homo sapiens
ttgagaatactaaataggggtcactttggccagagaattcatttctattttcagttccatgaatgtccactatattatgagcactgaacagaggggaggcttatcataaagttaatgagcttttagtttcacagccgcttactttcacaggcccttccaaggttctgtgtgtccttcgcagggatttaaggtatagctggatgcatggagagccacgccagccagagggtcaatctctacattctcggtctgtgtggaaggctggcaggtcgaacgtactctcaatttttgctgacctccagtgatgccctgcaacatgtggagcctccccaggtatctgaaatccaactctggcaccaaggagaaggtttggaatgagatgctccaccactctctgctcagggttctcca

SEQ ID NO: 598278 - DNA, 4880 bp, Homo sapiens
  misc_feature (2960)..(2960): n is a, c, g, or t
  misc_feature (3098)..(3098): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctcccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 598279 - DNA, 970 bp, Homo sapiens
gtggtttttttttgtttgggggcggcgtgctccgggggcagttttttgttgcctgcgatctgtcctttgtgttgttcgtggttgcgtgttctggtttggggtcgtgttggtatgcattgcttggttttttttgtttgctccgcgtgtgtggtggtgtgtgtcttcttttttctgttcgggtgtcggttggttttctatttttcttctggtggtgtgagatgtttgtgttggtgggtatcgttgcgtggttggttctcttttggcggttgttgggtggctgtgaggtcatcggcacttgcgtggttgttgtgttttttttagattccgctctctgttctcttggatcggtttgtctttctttgttgtgttacctgcagttcgtggtcttccctccgctcttcgttgtcttccctcggtgagtgtgttttttggcttgtgtggtcgatctgtgtgtaatgctcttttgtgtttctctctggtgcgggcgctgctgtttctgaactctgtttggtgtggtggtggttgtcttctcctcctggttggggggcgagtgggcggcctttgctttgtctcctccctcccgggctgtggcgctctgttcttctgccttgtcgtgcttgtcggtgtttgtcgccctcgcttcccctggtgttggtggtgaggctttgtgtttctgttgtggtggcctcccgtgattccttctctgtgtcgggggtgggcgttgcgtctcgggcgctgcctggcggggggtttattgacgtgtcgctgcttctggtgttccgccgccgtctttggtttgttgagtgctggcttggtttttttttttttttttttgttctctgtctcgccgtctccccgggttccggtccgggccccccccctaaatgacaaaaataaaataaaataccaaaataaaaacataatataatagtatatatcttcgaataaataaaaataaagaaaaatagaa

SEQ ID NO: 598280 - DNA, 217 bp, Homo sapiens
tgtgttaagatatgcagaatacggcttacataagtatagaaggcagtgactatagtactagagagctcaccatagtgccaaggcacattcagagcaagctacataaattaaacacacttaaattctaccaagacaccttaaaagatgggtacctaagtaatacattaatagtctataccacagataaagacaaactagagtgcactagagacaatta

SEQ ID NO: 598281 - DNA, 2748 bp, Homo sapiens
  misc_feature (2724)..(2724): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggctagtngcgctggggtggcgagctcgaatt

SEQ ID NO: 598282 - DNA, 958 bp, Homo sapiens
ggcgccggtggcgggactctggggaaaatggctgcgtctcgagtgggaacttatagaaatgctggcaattcaagaaaccaaaagtgtacagggctgagaggaaaaccaggtcctggaagtgtcaaatccacccgagatggggaataccaaagccactaagtgaaaatggggcactacacatcaaggggcaacacaacttccattccatggcaaatggcaagtttcagcaccacagcaaagtcaggagacgaggagcccagtgctatgcacgcacggcttacgacacagacccagcctcacaagggccagcaagcaacaagaatcacggcaaccaggcgtgtgtcaaaaccagagaacgacgggagacacacatcaaggtcgaataggacaaaacagcgaggcaaacaggggtgcataatccttcctcatggacaggaacataaatccacagtcatgccacaatacaggcaccagtgccacgggaacagggctgtaatggtggcaccaacatggaccgtggggtagacacagggggaacccaccgggaagaaccgcttcaccccaactggattgtgacgaggaattggcagaaaggtgggggtatcacatggcggtacaggacttaagccaagtcctttaccccactaacacgggcgggggcaacatggccaactgtaaccccagggcagaatgccacgtggccaggcagggcaaagaattgcccagacatgtcctggactccccacaacggattccacgggcgcggatacagagtgaccggtggcgcaacgtggaactaatgggtcaccccacacaaaacagctacataggtaggctgcaccacagacgggttgagacaaccaacacggggggcacttaaagacagagacacaccgaccgcgagtcacggtcagaagacgtagtgcccacgcgcacgcccgccaagcgcacagaccgc

SEQ ID NO: 598283 - DNA, 102 bp, Homo sapiens
gcctcggacagcgccatatactactgtgcgagacatgaaatccatggctgttttagttcctcctgcagagtggggtcctggttcgacccctggggtcaggga

SEQ ID NO: 598284 - DNA, 4698 bp, Homo sapiens
  misc_feature (2778)..(2778): n is a, c, g, or t
  misc_feature (2916)..(2916): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 598285 - DNA, 171 bp, Homo sapiens
cggctgaggcctctgtccctggatctgagttcccccatccatgacgagggtatgtgtaaacgagggatccttcacagatgcatgggggggagggatccccagctcctcagccccctggctctggccctacaagtatgtctctgggctggggagaggagcttctccctggcc

SEQ ID NO: 598286 - DNA, 4376 bp, Homo sapiens
  misc_feature (2456)..(2456): n is a, c, g, or t
  misc_feature (2594)..(2594): n is a, c, g, or t
gctgaaagaggctggcttggggccacggtgaactgcctcctcaccatccgtcctgcctccctggcgcccccaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctggggctgtgggggtgccaggagggggctggccagagcatggatgatgccattgaaggccatgatgtcccacacaatgatacggctaaccacaactgtccctggggccacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 598287 - DNA, 470 bp, Homo sapiens
tgcagcgtctaccccttctgcgttcactagtaacaccgtactccgcgtcgtgtcacagtcgtagagtgctttctaccgcggttactacattgtttacatgactgagatatcacttcccaaatttcagaatgaggaatctgaggtccaagagacatctgagctagtgagcagcagaggtaggatctgaaccctggaagccactgaccatccacatgggtgccttaatagaacccttctataataacagacgcagtgagcaaatccacagaagtctctcaaatgaaaaagctagacgatggaccgatagcaggcgcatcaggtaatcaggtccatgagggcaatatcctattaggcggtggccaattgctaaactgattcgcctcgtgcaaatgaggaccggtgaccgtctgagactccctagtgctctgcggactgggagcaattccaagacacgagcctctggtgaaggc

SEQ ID NO: 598288 - DNA, 261 bp, Homo sapiens
ggtttataaacagatgttagcatccaaggtgagcatgggaaacagcatttttccatctttcttccaggctgcatcacaatatgcctcatatggtcttgttcggtgagacccattctagcaggcgcacagcagtcacgggtttctgtggtggcacggcctcagtgcccgcaagtgcccccacgtggtccagtaagaagagtgcaatgagagtcggtttgggccagatagcttgtccccgtttatagtttatccgacctaatg

SEQ ID NO: 598289 - DNA, 4668 bp, Homo sapiens
  misc_feature (2748)..(2748): n is a, c, g, or t
  misc_feature (2886)..(2886): n is a, c, g, or t
gcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacgacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaagtacccagaagggattcggaagtatgactacaaccccagctttgccatccgtggcctccactatgacattcagaagagccttctgatgaagattgacgccttccactacgtgcagctggggacagcctacaggggcctccagcctgtgccagacgaggaggtgattgagctgtatgggggtacccagcacatcccactataccagatgagtggcttctatggcaagggtccctccattaagcagttcatggacatcttctcgctaccggagatggctctgctgtcctgtgtggtggactactttctgggccacagcctggagtttgaccaagcacatctctacaaggacgtgacggacgccatccgagacgtgcatgtgaagggcctcatgtaccagtggatcgagcaggacatggagaagtacatcctgagaggggatgagacgtttgctgtcctgagccgcctggtggcccatgggaaacagctgttcctcatcaccaacagtcctttcagcttcgtagacaaggggatgcggcacatggtgggtcccgattggcgccagctcttcgatgtggtcattgtccaggcagacaagcccagcttcttcactgaccggcgcaagcctttcagaaaactcgatgagaagggctcacttcagtgggaccggatcacccgcttggaaaagggcaagatctatcggcagggaaacctgtttgacttcttacgcttgacggaatggcgtggcccccgcgtgctctacttcggggaccacctctatagtgatctggcggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcagacctatcaggacgcggagtcgaggcaggtgctggctgcctggatgaaagagcggcaggagctgaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctgtgcatgcttctgctttcagccccagcctcgtcacttgactgtgaggatcctctgggtgtcagggaagtcctcctccagcagtgagtcatcgaagggttcacaaaaggtgtcgctgccaaagacagggttggggacagagaccagggtggggttggtcccttcttgccacggtgagaagtcgtcatcagcatcatcttccgcctggaaggcagagaagccaaagcccatgggcttgcctcgggcacggaggtagagagctccggccaccaagccaagcagtgctccagcggcaagcacagcccccacgcctgccgccacaggtggggcttcaggcgccagcactgcctgcacaggggcccaggaactgttgtcagggcctgcgtcactgatgatgaggctgaggcctgagtgggccggaagcaacttcccctggctggcgttggcacttaggagggtggcgttggaggcatgcagctccaagtctgggccactcagcgtcatgttgtccacaaagccttcattgacagggacgaagagtgtcttatacgtgagctcatcatccaggaagtccaggaagtcgagaccccgctgggtggcattggcatagcccaatagcatcccatagaaggtggagaagttggcagtggcagccagcacatccagcagcttcccattgcacgtgctgatcccgtcacccacgaagccatttcggcatcggcaggccacatcttgcacacggaagcagtaggcatcccagcgttctgagaggttcttgcgggcacccaggctgactatgcccacccgaccattgccacagtccgccacagggaaaaccacagggtgggcagtggagccattggccagccagcccatgaggcacaggtggaagcccagctgctgggcagcagagagctgagggaatgaagcaaggacggctccctgtgcttcgcatgccgcctcagcctccgaaaagttcagaccataagggccgctggtggcctggaggtggaanacgccagcccgtttctcctggaagtgcaggtcagtgcacatggcatctgagtgcaagggcggtggctggcccaagcagcggtccacaggtggttccgactcctccagacactgcagtccatcgcctacgtagcctgcntggcactcacagcgccgtgtgttcaggccggtgctcaagcagttggcgtgctcgctgcagcccccgcggtggccatctgtgcaggggttgcgggcccggcagctccagccatcaccctcgtagtcgggcaggcaggtacaagtgaccattgttcctacctggctacagttggcgtgctcactgcagccaccatgcccgtcctggcacaggtctgccactgtacacacgcggccatccccttcatagcccaggctgcactcacagctgttgcctgcacggcacacagcctcgggtgcacagggtggggtacacacaggctgcagctccagttgcacctcacagcgtggcccagtccagccttcatcacagaagcaggagccagagcccccaaggccctcatcacagcggccatgcacagtgcagcggcaggcttgacaatggggcccaaaggcaccaggagcacagagttcacaggctgtcccagcaaaacctgaacggcacagacactgcccactgccactcatgccgtccatgcacacgccacggtcactacaagggctgctgggccgccagggcaagcttgcactcactgccatagtgaccagggcagcagctgggcttccaggtggtggtgacacaattgcggtggcagcccctgcccaggccttggggcctaccccaaaggctggggtggacccagacgctgcgtaatcccaaagagtgcagcggaggggacgtccagaacttcgggtagaagcgccagcaggcctcagggctgccctgctcctgtgacccctcaggacagggtggctccagcccacagatgctgcaggtgttcagtcgcaggggccgggtctcaaagtggtcacagcgagcaccaaggccaggtggctccagcagctggtcgatgccataggccaggccaccctcaaagggcaagtgccgctgcacaatgcgagcatcatcctcacccaccatgagctcaccgggccgcgttcggctgcaggagaaagagatgggggtcccatgcatggttcgaagtgggcccaggttgggcaggtcagatgccaaggcctcgacattgcgaatcatgtggccccgcagaatggctgctagcttgtcacggtggtcctcatggtacagccaggcctggcgatccggaggcagagctcgaaaggcggcgtctgtgggccacagcattgtgaagggcctatgggatgcctctcgaagcaggggcaggaggccggccaccttcaggaggccgctgaagatcttgtaaccgaagccctgggcggcggcggtgacatttctcctcgggatgggagcatcatcaggctcccagtgcagcgcctcggggggcagcaggacacggtcaatgaagtgcaggatgccgttcacggcctcatggtcgctgctcaccacgcgcgcgaagtcattgaggtatatgctgccctccctctcgctgaagcgcagtgggtgccctgagagggccgtggcgtacccctgctccagcaggtcctcgctccgcagccgccgacagccaaccacgtggtagcgaaacaccagctggcgatgcgcacgaatccgggccagctcatcctgcgacaggttgctcattagatctgcgtgcggcacgaagatggtgaaaggcccatcgcccttgagctccttatattccaggaggcggaggctgaagaatgaggcatgcttatccctcaggagctccaggccgactcgggcacggcaggtgagccgtcccccacgtgtgggctggttacagtc

SEQ ID NO: 598290 - DNA, 621 bp, Homo sapiens
  misc_feature (21)..(21): n is a, c, g, or t
  misc_feature (107)..(107): n is a, c, g, or t
  misc_feature (109)..(109): n is a, c, g, or t
  misc_feature (112)..(112): n is a, c, g, or t
  misc_feature (115)..(116): n is a, c, g, or t
  misc_feature (119)..(119): n is a, c, g, or t
  misc_feature (122)..(122): n is a, c, g, or t
  misc_feature (126)..(126): n is a, c, g, or t
  misc_feature (137)..(137): n is a, c, g, or t
  misc_feature (142)..(142): n is a, c, g, or t
  misc_feature (145)..(145): n is a, c, g, or t
  misc_feature (149)..(149): n is a, c, g, or t
  misc_feature (151)..(151): n is a, c, g, or t
  misc_feature (154)..(155): n is a, c, g, or t
  misc_feature (161)..(161): n is a, c, g, or t
  misc_feature (170)..(170): n is a, c, g, or t
  misc_feature (173)..(173): n is a, c, g, or t
  misc_feature (176)..(176): n is a, c, g, or t
  misc_feature (182)..(182): n is a, c, g, or t
  misc_feature (184)..(185): n is a, c, g, or t
  misc_feature (188)..(189): n is a, c, g, or t
  misc_feature (207)..(207): n is a, c, g, or t
  misc_feature (223)..(223): n is a, c, g, or t
  misc_feature (236)..(236): n is a, c, g, or t
  misc_feature (266)..(266): n is a, c, g, or t
  misc_feature (289)..(289): n is a, c, g, or t
  misc_feature (326)..(326): n is a, c, g, or t
  misc_feature (344)..(344): n is a, c, g, or t
  misc_feature (446)..(446): n is a, c, g, or t
  misc_feature (450)..(450): n is a, c, g, or t
  misc_feature (473)..(473): n is a, c, g, or t
  misc_feature (509)..(509): n is a, c, g, or t
  misc_feature (602)..(602): n is a, c, g, or t
ataatgtaagaaaaaaaaganttaaaaatacaattctatcccagaaatggatccgttatctgcacagccattgaagaaaaaaaaaaaaattcatgcaaactgaaacnangcnttnntgnagngacngagtgggagangcggngangccngnggnntatatnagcggcgcnganttnacaacngnntgnnagcgagcgagaaaggagnacccaaacgttcgacnggtttaatggcgngggaacacagttttgcatatgggtatgaanaaggtttgcgaactcctgaggangggcccatatgaaacaaacacattgaacacaccactnactgacatgcccctcccncccacatcaggtttgttagggtatttttttacttgcttggcaacaaataaatacatgggtgaccattataaaatcaaaattataatttgatatgtgcccaangaangaaatagcaaatatctcaagctntaaagttacttttggtcatttatattaatttataantgctgaaatgcatcaccatgtagagaagagactaggttacacaatttatcagatttgttctcttagccatgacgacagttttaccaagtatcnaaaaaataataataaaaga

SEQ ID NO: 598291 - DNA, 725 bp, Homo sapiens
  misc_feature (5)..(5): n is a, c, g, or t
  misc_feature (83)..(83): n is a, c, g, or t
  misc_feature (86)..(86): n is a, c, g, or t
  misc_feature (89)..(89): n is a, c, g, or t
  misc_feature (93)..(93): n is a, c, g, or t
  misc_feature (119)..(119): n is a, c, g, or t
  misc_feature (121)..(121): n is a, c, g, or t
  misc_feature (124)..(124): n is a, c, g, or t
  misc_feature (128)..(128): n is a, c, g, or t
  misc_feature (184)..(184): n is a, c, g, or t
  misc_feature (205)..(205): n is a, c, g, or t
  misc_feature (254)..(255): n is a, c, g, or t
  misc_feature (258)..(258): n is a, c, g, or t
  misc_feature (261)..(262): n is a, c, g, or t
  misc_feature (266)..(267): n is a, c, g, or t
  misc_feature (273)..(273): n is a, c, g, or t
  misc_feature (305)..(305): n is a, c, g, or t
  misc_feature (307)..(307): n is a, c, g, or t
  misc_feature (424)..(424): n is a, c, g, or t
  misc_feature (436)..(436): n is a, c, g, or t
  misc_feature (516)..(516): n is a, c, g, or t
  misc_feature (518)..(518): n is a, c, g, or t
  misc_feature (522)..(522): n is a, c, g, or t
  misc_feature (526)..(526): n is a, c, g, or t
  misc_feature (565)..(565): n is a, c, g, or t
  misc_feature (567)..(568): n is a, c, g, or t
  misc_feature (642)..(642): n is a, c, g, or t
  misc_feature (662)..(662): n is a, c, g, or t
  misc_feature (700)..(700): n is a, c, g, or t
ggggngggacatctggaaaaaaagcagcctgacagtccagctgtttgcaaactcatagcacatcctccagttacatggcaganganggngggngggagggccaaaaagaaaagggagangnggnaganaaataacttaaataaacacacacacaaagaaaagagaaggcaacatgacgtgagcnggtgatccatgaaggcagggngggaggggaaccgttttacctgtgctgaaccaagggaagaatgcggagnnggnggnngggnnaggggnaaaaaaaatcagaagaaacactgggggcagangntggtggggacacggagacaactttatacaacttgagacgaggcggcccggccggcgtgtcctcagtgcggtgtggcggcggaggatctggtgctggtggtgctggcacttcagggtngggggccgaggncgggcacagtctctaagcagctcccccaccccaaacacggaggccccaaggggctgggaacaagagtctgtggcgaacangnttangcancgggcggttggcggcttgctgggtgcccccgccgcagcnanngggctggacggcctgtcttctttccactggccccccggcatgggatgggccagggcgccgggtcgggtacggantgcaagctcgaaagagaganagagaaaacactgagacagcattagtggagtgaaaggnggacacagatgagcctgcagaccat

SEQ ID NO: 598292 - DNA, 85 bp, Homo sapiens
gaaggaatcaggcgggtaaacacagattgagtgtctgaccacaagacaaaagaagagcagacagattcccttctgtcgtcttctc

SEQ ID NO: 598293 - DNA, 775 bp, Homo sapiens
  misc_feature (662)..(662): n is a, c, g, or t
gccgccgggccggcgcactggtggtcacctgctgagcctggaggtggcggtcgcatgtgaagcctggtggcgcgtgcaaaacctgtgctggctgcctgggccttctgggcctcctgggccagaagctggcgctggtgtgtgcggcgcgcaggtggtggagaaagcaggcagccgccgtggggcctcctggacgcgtctggcggagggtggcttcgtcccgctggatgtcaggcttcaggctttcaccagttctcaggatgcccatagggatgggtgaagcctgcccttggcctgtggtgctttccagtggccgtcatctcatatagggccccacagtggcattaggatgcacctctcggcggtgtacaacgccctcctggtgtcggtgctggaagctggtcctgtggaagcattgtgcggcttgctgttgagcatgcagccacactggcagcgaggaagctggccctcagccgaaaggccaacagaggccagccccagcactgaaggatcgaatagccgaaagggcacttgcagatcctgattggagggcgtggaacacaacattggtgttgcacggggcccggcacgcaacacaagaccggcatctagccggcttcaagtggctactgcaaacttccaacggaggcttgaggatgttcaancatatctcccattgggcaaacaacctcatgtcatggcttgccaagcttggggctacccggaggacttccaagaccagccctagtcgacctatacaccggtggaggaccacaaa

SEQ ID NO: 598294 - DNA, 900 bp, Homo sapiens
catccgcccactccaaacacttcgagctcccatccgagcccacgcatctcctctcaaaccccttcttcgcttacccctcaacactcttctctcctctttcctgtcaatacccatactgcatcatccgggtcacaccttctcgactgcttctacgtgtccctccttacaccctgccctgatgcttcgcagctgaactttctctgagctgtaacagcctgaccgcaacaaacgagaggatcgagaccatccgctccagattatccggctcctccatgcgttgcctctcggctcctgctccggttttccatgccttatggaactcctcgatccgccagcgatgggtataaatgtcgatgacgcgcaaggcttgggctagcgactcgaccggttcgctggtcagcaacaaccatttcaacggggtctcacccttgggcgggttaatctcctcggccagcaccgcgttgagcgtgatattcccctgttttagcgtgatgcgcccactgcgcaggctcaagctcgccttgcgggctggtcgatttttacgtttaccgcgtttatccaccacgcccttttgcggaatgctgatctgatagccacccaactccggttggttcttcagatggtcgtacagatacaacccagactctacgtccttgcgtgggtgcttggagcgcaccacgaagcgctcgttatgcgccagtttgtcctgcagataagcatgaatatcggcttcgcggtcacagaccgcaatcacgttgctcatcatgctgcccatgcgtaaccggctagttgcggccgctgccagccatttgccactctccttttcatccgcatcggcagggtcatccgggcgcatccaccactcctgatgcagtaatcctacggtgcggaatgtggtgg

SEQ ID NO: 598295 - DNA, 102 bp, Homo sapiens
gcaggttaagggctaccctctgcaaaattaaaattaaaaaaattagccagtcatggtggcacatgcttgtagttccagctactcaggaggccaagatgaaat

SEQ ID NO: 598296 - DNA, 1471 bp, Homo sapiens
gggctgtgaaaagaaagcctcagaacgttcgctcgactgcgtccccagacctggggcctgagccctccgctgactgccacccgggcacatggtgggcctgcacgcagccacgacgtaccgacatgtacccacggtggacaccctgacatggggctagatacctgacatgctacctgggacagtagctaggcaccacgaggtaggacgacctacacactgacgaactacctagagaacccacctgtgtgatgctaggtactagacatacccagcacgtgggcataaaacatgcacagaggtacacagacatacgtaccatagccttgggatgcacatgctagagattacaaccacatacgacaagccatgaccccacactccatacgccacaacaggaaccgtgacagactcacaagccttgacagctatattgagcacacaacaagcgcgcaaacgaccagggacggaaccttgatagaccagcctgatgtgactcgaccaatacggagaattggacacaactggcaatgaacatgaccgcgcaagagaagtacctggtacctcggcagggtgttagcagacgtataatacttggtaccttgcccacagcttggaacccgccgcccataggacaccgtaaataggtacgccgtaccacgaggtattaaggcaagtaatactttggtgagcaaaaaacttaggagagcacctacaacacaaccagagacggtgtttgtgacagggtataaataacacgcctataccacaacgaccaactcatataggtagggtatatgaaccccactaaggaaagaccaagggggccagttaagtagaagggatagaaccctggttcaaacaccaagcccttaggacgccaccaagaaggagagccccagtgcacacatagaattcgagggtgaaacacaccgaaaagaaaccagtaacaccgatgagtcacacatccagggacacttcatccgccatagtggattggcaccatgacacacttggatagaacaggcaaacgagccagcaaggggacatttagcaacgggtgatacaccacacaaaggaccacgaattggacgagtttgaaaggcattccaactggggcaaggacccttggatgggaagcaaccccaacaagaacaaagtcaagcccggactgaggagacaacagcccatggggaaagtgggaccacaaaaccaacggagttgtggacaatggattacaggcgaaacgaccgaccagatgtgtgtgaagacaaggcgaagatcattaagcgcgaggagatgacgcgagggaagtcccaggacatgacgacacaggcagagttaccgggacacaaattgggagaaaaccggacacagggaaagggcagtatggaggccagcaagagtagcacacggattagcaaaggaggaccagagatacccatagacgaagttccagccggagggaagcaac

SEQ ID NO: 598297 - DNA, 100 bp, Homo sapiens
cagatgaaggaacatctcatatcgccttccaacatctcatatctccttccaacatctcatcccgcccccccccgtcatgagatgtgggaaggcctaccaa

SEQ ID NO: 598298 - DNA, 256 bp, Homo sapiens
tgctatgtaagctaaagacaaggcaccctgagcacaactgcctgtgggtgaaagatgattagcacatgatggtttgcagggacgttcctagttggttctcatctctgatccacatgccctttcgcaagtactgttactccaggcaataacccagaagtccaccgtcatgatcatgctgagctctcctgactcaccccaaaaacaatcacccgtaaggctaaagacaaggcaccacgtttttaccacagtacggggt

SEQ ID NO: 598299 - DNA, 197 bp, Homo sapiens
cggtgtctgtgtgtgtatgctgtgtgtgtgcgtgtgtggtgtgtgtgcagggtatatgtggcatgtgcatatgtgtatgtggtctcgtgttgtgtgcatatatgtgtggtgtgtgtgtgtgtgtgtgtgtggagagacataaggtctcctatattttttctcaggctggtctcgtaattcctgtagttcaaggtgat

SEQ ID NO: 598300 - DNA, 896 bp, Homo sapiens
taaggttttgagggggaatgctggaaatggtaaggggtatggaaacatgtcatataagtaatgctagggtgagtggtaggaagtttttcataggaggtgtatgagtgggtcgtacggaatcgggggtatgctgtcgaattcataaaaacagggaggttagaagtagggtctgggggacaaaatatgtggtgtagagttcaggggagagtgcgtcatatgtggttcctaggaagatggtaggggtgagggtgtttattataataatgttggtgtatcggctattgaagaatagggcgaaggggcctgcggagtatcgatgtggaagccttgagactagttcgaatccccttcggacaaggccgaagggggtaccgggagggtctcggctaggggggagataaactcacatgcagggccaagggtcagtgatggcaggagctaactccagaggggtactacagccgcgaaaggctggagacgctcacaaggaagcccactcataacaccagacgaaacaccacacgccggcaacgccagacacccacagcacacccggatgaggccacaaagccacacaggacgacgcaacaagaggacaacatgaaatacacagacacacccccagacacaaagacacacacacaaaccgccgcaggccacaactggcgccaaacataaaccacgcaaaccccaagcaagaacactcaccacacagccggccacgcagaaacgcccccaacaacccacacacgaccaccacccaccccaccagccgccgcccagccacccaccacagccacaacaacacaccgagacacgaccctaccccaccagccacgcgcacaacaagcacaccaaccaaaaaaacacaaggacccatggccagcgacggatcc

SEQ ID NO: 598301 - DNA, 222 bp, Homo sapiens
gaattcggcacgaggaaaaaaaaaaattcaaagtttttgggagtaagaggtagagttccagcatcataagattacatctggcaaacacctgaaatccgaaagcgatgcaccaggacttccaaggcatcatatatattactaaataactttggtaaaatatagtactggccaggcacagtggctcatgcctgtaatttcagcacttgaggaggccagaccagg

SEQ ID NO: 598302 - DNA, 143 bp, Homo sapiens
gcgcttatgtcagcattcagcagcgcgagtatagcatcatcctctactattttttaaccaaatcaaaaccactatgtatctgttcccaagcttttctccgacccctaacaacccctcctaatactaactacctgactcctaca

SEQ ID NO: 598303 - DNA, 720 bp, Homo sapiens
ccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgcaatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaataccacaaata

SEQ ID NO: 598304 - DNA, 375 bp, Homo sapiens
tctctggtacctgaacattctgtgtccaagggtcatggttctcagccaccctccagtctttttctggtgcctgtgttatattagttgtctgggaagtgacccatctcaaggcatgtttagtgaacattagcacgttgttcctttcctcccagaggacagcctcagtgatggaggtggagcctcttaagggagcagatggatgccctggggctgagaggaagctggtcctacccttcatttgcaaagctaaccccttaggacatgcagattgtcttcacccaactccagcgtctgttccttggagacacattgctggtcagccagttggatgctgatattgagaagaaaaaacagaaatgatttctgacatctgga

SEQ ID NO: 598305 - DNA, 305 bp, Homo sapiens
ccttttttgggcccccccgggggggggggcccccctcccctcccccccccaaaatggggttccagggggtttttcaaaaaattcccaaggtttttgggggcccccccccccgggcccgggccccgggttttttttccttaaaagggggccccccggggttaccttgggaccccccccgccttttgggggggcccccccccctttccccttttcccggggcgggggccttagggggggacccctccccggtttttttcccctttttttggggttgtttccccgggttttaattttttaatgttgga

SEQ ID NO: 598306 - DNA, 600 bp, Homo sapiens
  misc_feature (294)..(294): n is a, c, g, or t
ggactcggtgaggaactcgggggatcggagaggggctcgtgtgctgggcgacagtgacacactcagcagcccggcggagccgcgttcggtaccgtctgaagggcagccggggctgggggaccgacagctctcaggtgtcggtttttctgtggctagcggatgtttggcaccatttcacagggcacacagggcagacgggacctagatgacgacagatctgcgtgtttgggctctgtttgaaacagacctcagccagagtcttgaagagcagaacccggagtgttgaagtcacanagagatcaacatccctacggtgtgaaatcctgaaaacggcaaatcccaaaggacgaaacgcccgaaaatgatgtcatcctttaagtgttttcttcttttttcttttctttttcttttctttctcttttttttttttttttttggagtcaggatctcgctctgtcgcccaggctgcagtgcagttgccgctatcgtggctcactgcagcctcagcctcctgggctcgagtggtcctcccaccagagcctcccacactgctgggattacaggcaccaaccaccatgtccggcccattgtggtccattg

SEQ ID NO: 598307 - DNA, 317 bp, Homo sapiens
ctggcggcggcggcggctggcgtgctggcggcagcagcgcggccctttaaactgcctgcggcgcccacagtactcagcttggtcctcttttgtgcgtcctcgtagcgtgccgtttgtcccagctcgcacgttgttctcggccggccaagttgccgtaggcattaatgactagcccaaatcatgtagtaggcgtccagcttatgttacgatcgtaaatgctgatatactccgttcatgctaaggccatatcttgatcgcatacgactacgagggagcctgaaggatgagggccgaatgctaatgcttcagatgaccga

SEQ ID NO: 598308 - DNA, 947 bp, Homo sapiens
  misc_feature (504)..(504): n is a, c, g, or t
gaggaaactgaggtcctcagaatggtgggcacaggtttggtggctgagacggtgtggtggatgcgctgccgtattgtgatcaagtgttatgacagcccctgctgtgcgggaaagggtcgagcgtgggtggaggtaggaaactcgcagtatacggagctcataaagaactaacgtgagctaacgtgacgagccccgggatatattcctggcctctgttgaaaactgcacatcagtgagcacgctgactttgtgaacagattggctggctcggacaaaccaatgtgaatgtgctcacgtatggaaaagcgataattgaggcttccgaggcccccttccttctgttcaacaacaatttgactatttactgccgtggccacgactggttgtcaacccaacttctaatggcgccccagataaggagccatcaagggccacgttaagacatgtgaagacatcttggaatcctaatgtgtccacaggccatggattgttaatggctctggnaaaagttcataccaactgaacaatcctagttcattatgacttgacacaccgcaacagaagggaaccttccagagggtcacgacaaccttatacaaggattttaaacctgccaggaagaaaggacacatagcaactcaacaggctgatcctaactgtgcgcagaacatggcgcccaaatggtgggtatctcctggctcaagtacgacattatgagattgcacggactattgtccagctaagaaatgaactctatcaaattaagcagcacttggggggaacaaggaaacctccggagacttctgaaagaattaggcggttgaaaaaagtgcgttcacaaagctcgacttcaaggacgtgaggaacgcttccaacatgtgcgtgtgacccacacgcggggggggacttgttcaccaaaagtctgggggttcaaaactgtccaggct

SEQ ID NO: 598309 - DNA, 361 bp, Homo sapiens
gagaagaagctacaaggaagtactatcaagagatcacatgaaatcaatcaaagggagaacttgaagaacagagaccagaaagagtaacaccttttatgacaggagctgcagaacaaatcaagcacatccttgcttaaattacaaagaactaccagtatctttatgtggtgaaaacatgtaatccatgatggcatgtgttgctcgtattggcactacctgtgacggatggatgtgacccacatatatgtattttcatttaagggatgtgtttagaacatggacaaaatgttaacaaagtgtggcaatatattttgtgatctatcaccttgtcatcataactggtcttcttttcatatttccg

SEQ ID NO: 598310 - DNA, 96 bp, Homo sapiens
  misc_feature (92)..(92): n is a, c, g, or t
ggaaaaattttttaattttttttttcccaaaaggggcaaactttttgggaaacttttttttaaaaaaaaccttttttttcggggggtggggnccca

SEQ ID NO: 598311 - DNA, 334 bp, Homo sapiens
  misc_feature (245)..(245): n is a, c, g, or t
  misc_feature (275)..(275): n is a, c, g, or t
  misc_feature (332)..(332): n is a, c, g, or t
tgcaactgaaccagaggcatcatacaagacagagacatcgaagtgcaaggagacacaggagcctttcatcaaagacagtactatgaagaaatctgaacaacctaccacaacctttaactgtcttaggaaatcaaagcgaagagttcagcaataggcctcacaggaacaggccgttacttatgagcaatggcaaaaagtcacaagaaaaagtttgtttcatggaactgcaaacaaaaacttttagntatctcgctctttagaaaccctttcttctncatttttacctggtcttttctcctgagccaattagcatatttcattcccactttccncc

SEQ ID NO: 598312 - DNA, 219 bp, Homo sapiens
ttcctgcgctatccggaatgcccctacgtaactcggactatcccgatgcatagcagccacatgaaacatcctatcatctgtaggctcactatcatttctctaacagcagttatattcataattttcatgatttgagaagccttcgcttcgtagacagaaaagtcctaatagtagaagaaccctccataaacctggagtgactatatggatgccccccac

SEQ ID NO: 598313 - DNA, 178 bp, Homo sapiens
tctggactgagcctccgatggattctgaactggaatactgcagctaacccttccacgactagaaccttaggcataggggagttttagatggactaattttattaaaggatagtattttttttttttttttttttttattttttttttttatttttttttttttttttttttacaccaa

SEQ ID NO: 598314 - DNA, 343 bp, Homo sapiens
aactttctgaaaactgaaactcgcgttcgcttgtagataacaaaactgggtgaaatcagttgcaaccaatatagccaactagagttcactctgaaggagcgtcatcacagcctgaattgccaccacatgcttcatattaactcctcccaaatttgaacatgggacccatgaggagtcatgaagagataactgggtactgccaaggactttctagacctcccctttccttccaccaatcacctagtaatcccagaatctacccgctaaacctgttctaataaaattactgcaccaggagacagatttgggcttgactcctgtgagtcaactggcaatcaagctt

SEQ ID NO: 598315 - DNA, 782 bp, Homo sapiens
agctcgtgtccatgtccgtgcgcgagctgaaccgccacctgcggggcttcaccaaggacgaggtgatccgcctgaagcagaagcggcggaccctgaagaaccggggctacgcccagtcttgcaggtataaacgcgtccagcagaagcaccacctggagaatgagaagacgcagctcattcagcaggtggagcagcttaagcaggaggtgtcccggctggcccgcgagagagacgcctacaaggtcaagtgcgagaaactcgccaactccggcttcagggaggcgggctccaccagcgacagcccctcctctcccgagttctttctgtgagtcgtggccggtcctggcccccgcccttgccccggcccggactccctgtcccacgtccctagtcccagactaccccggaccctgtccctgccgcggccccagccttgacctgtttgacttgagcgagagggatgaagggcgctcgggccgtgggcgactgtcgggtgctcggtcgggcaggggaccttggcttaggcgagagtatctcacgccatcgcccgctcctagactcgagcatagccggacagagagacgagatggttgcaagtccctgtatacacttcttccaggctgaatgtcctctaagcttattctcgagaaatcaccacaggcctctgtaaacacccagcctctctagaactttccacgttaaaccaggacaatttgcttcacttccctgataatactccgtcgcatataatattactacggtctaatggtcagcgcccttct

SEQ ID NO: 598316 - DNA, 149 bp, Homo sapiens
atatagaattcaacatgtccccttgagtggcggagagcatgattctgactatgaccctatctcgctgactgttgccctgcatggagtcatacagccgatcagaaaaatacaagggctcgttatgaatgcactgaaccatgctcaagaaa

SEQ ID NO: 598317 - DNA, 338 bp, Homo sapiens
  misc_feature (27)..(27): n is a, c, g, or t
  misc_feature (151)..(151): n is a, c, g, or t
  misc_feature (156)..(157): n is a, c, g, or t
  misc_feature (183)..(183): n is a, c, g, or t
  misc_feature (191)..(192): n is a, c, g, or t
  misc_feature (253)..(253): n is a, c, g, or t
  misc_feature (326)..(327): n is a, c, g, or t
tcctggcccagccgagcttgcttcccncaaatcccgtaatcctgtgaccttattcccccaaagaagcggcctcccggcgaaggagcgccctggcggagaaccgactcgaacggctcccacagccgggcgttagggaggaaaggccacttcnttcanncctccaccatgagcctggacatccangagcctgnngacatccagtgtgaggagctgagcgacgctagcatgggccgagctcctccctctgctccangcagtgccaagtggtcaggctgacacggcctcacggcaagccacggctgccacaggggacatcccagctctgnncacttcgcaag

SEQ ID NO: 598318 - DNA, 109 bp, Homo sapiens
tgaggatctgatcgagctgatagcctccagattataaagtaatggtcagctagccaaaaatctgtgcacaggctgccttgtattgggagacattgacacatcagagaga

SEQ ID NO: 598319 - DNA, 201 bp, Homo sapiens
gcaccgtgaagcactggagatactggacatagcagatttgtcaagctcatttttcccaccaccagtgcctgagcacgacctcatttgccttggtcaatgaagcccaaggaagcattgcactttggcttacgctttaagttttgtatgtagatatgtatcccatgtcttctaacaataaagtgctggcctcgatggcctcaa

SEQ ID NO: 598320 - DNA, 295 bp, Homo sapiens
atagatggttccctgtgtgtggttgtgacatgctttcccccccacctcctttcccctctttctggggctcttgctcttcccccacagcactaggggtacagatgcacaccactgtacctagtgtttatgtgattcacacaagcccagggactcaaactcaggcctcctgcttatacagcaagcaccacggccactgcctcatctcctaagcccccccccccctgatcttctactgaagccccttccttgggaagggaaaattgttcagaaagtcgacgcggccgcgagtttagta

SEQ ID NO: 598321 - DNA, 427 bp, Homo sapiens
cagtactgacatttcagatttacttcatcacttgatgctgtgagctagtggtgagtctctatggaatccccatttgttcatcgatctcctgatactgaaccatcctgcactgctcattctgtcttactgcaccctcctcagctctgcaggatgaggtctttaatctatgccatagggtgtgctgcttacctagtgattgcatttgtcccgagatcatagacttcaggatgattattaacccctgtgtgtttttgttcctcatatagtgccctgcccccagacatttgctgaccagacgtttggcatgttcagctggaccatccccattgctgttgccctgtcctgctttgggggcctcaatgcatccatctttgcttcatcaaggttgttcttcgtgggctcccgggagggccacctaccggacctt

SEQ ID NO: 598322 - DNA, 280 bp, Homo sapiens
  misc_feature (63)..(63): n is a, c, g, or t
  misc_feature (141)..(141): n is a, c, g, or t
  misc_feature (159)..(159): n is a, c, g, or t
  misc_feature (230)..(230): n is a, c, g, or t
  misc_feature (252)..(252): n is a, c, g, or t
gaatggctcaaaccctgtaatccccagcaatttgggaggctgaagcgggaggatcacttgagncccaggagtttgagaccagccctgggcaacacggtgagacacccacctcctacataaaaatgtgaaaattagcccagntgtggtggcacacactgnggtcccaccttctcaggaggccgaggtgggaggatcgcttgagcctaacagtttgaggttacagagagccntgatcacgccactgcccccaancctgggcaacagcaagatcctgtctcta

SEQ ID NO: 598323 - DNA, 134 bp, Homo sapiens
atgagcgctaggaaatgtccaactcacgtggaagacgtacgtcaataaggaaatacaacacatgctgtcaatcggggtgaaacagcataaagactctcatagaaaaaacaaagcgagagagcgcaaggatactg

SEQ ID NO: 598324 - DNA, 921 bp, Homo sapiens
ggatccctcgttgactcatagatatacatagtcaatcatccttgctgaaaatgtcatcctgaagacaatatacataggtatattttatacacagtttggttgatttaattcacgtaccatacagttcaagccatttaccatgtgcatttccatgggcttctctagatatagttcgaacaatcgtgtcatgccatcactacagtcaatgtaatgaatattccatttggcccgggctggtgcgctgtcggctcatgcctgaccagtcccagcgatccgggaggctgaggagggaggatcactctgaggtcaggaatttctagagcagtacgggcctgcctggttgaaatcctgtctcttactcattacatcgagtcaccttacaagtgttcaccccgggtgtccatgggacattgccgggtaagtcccagcatcatctgggaaggctggagggcagcgagatgttgcttgattatccgcggaggctcgtagcgttcgacatgtagagggtcaagactttgtggctctgtcatcttccagcctgggtttgatccgtgatgaggactcttggctgtggacttaaaagacaaaggcaagtgcctatttcattgctcctaaaaacttaatttgcaccccttggatgagtattcgccagcgatactgcactactcctgaccataggcggtcataattctactttcttgttttataggatctgcttcgtctggacattttgtctattaaatccgcggcggagggtatagttctcggccctaaaatggtcgcatgtacacagtaatggttcggcccgtttcgagagacgcccggtgccatttgccatggggcgtagattaaacaaatggcgacaccaaaagagaccaacgatacagacaacgcgacagccgaaaggaagagagagactca

SEQ ID NO: 598325 - DNA, 122 bp, Homo sapiens
cgtctagaggatcccgatgtttcctgatcgcctgtatcgctcttggaaattaatctgaaaatctgtctcccttgtacacaagtgagacagattttcagattaattttcaagagcgattgaca

SEQ ID NO: 598326 - DNA, 1105 bp, Homo sapiens
  misc_feature (1052)..(1052): n is a, c, g, or t
  misc_feature (1086)..(1086): n is a, c, g, or t
aagaatgtggcaaaggctttagtatattctcaacccttactaaacataagataattcatactggagagaaaccctacaaatgcaatgaatgtggtaaagcctttaactggtcctcaaaccttactaaacataagataattcatactggagagaaaccctacaaatgtgaagaatgtggcaaagcttttaaccggtcctcaacccttactagacataagataattcatactggagagaaaccctacaaatgtgaagaatgtggcaaagcctttaaactggtcctcaactcttactaaacataagagaattcatactgaaagagaaaccctacaaatgtgaagaatgtggcaaagcctttagtgtattctcaatccttactaaacataagataattcatactggagaaaaaccttacaaatgtgacgaatgtggcaaagcctttaaccagttctcaacccttactgaacataagataattcatactggagagaaaccctacaaatgtgatgaatgtggcaaagcctttaactggtcctcaactcttactaaacataagagaattcatactggagagaaaccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtgtgacaaatgtgacaaaacatttaattaattctcataccttattgcacaggaaagcatttatacttgagaaaaattgtataaagaatggaaaagtcattaatatctgctcatatcttaacatcagcgagttggtatttaataaaagcattatcaatgaaattactggcaaaagatctttcagaccatataagcctgcaaagtgcaccagagtnttattttggaagaggaacatttaaagtccaaganggttgtagtacctttggtt

SEQ ID NO: 598327 - DNA, 1168 bp, Homo sapiens
  misc_feature (1115)..(1115): n is a, c, g, or t
  misc_feature (1149)..(1149): n is a, c, g, or t
accgatccacagaccttactacacataagatagttcatactggagagaaaccatacaaatgtgaagaatgtggcaaagcctttaaccagtcctcacaccttactacacataagataattcatacaggagagaaaccctacaaatgtgaagaatgtggcaaagcctttaaccggtcctcaaaccttactaaacataagataattcatactggagagaaaccctacaaatgtgaagaatgtggcaaagcttttaaccggtcctcaacccttactagacataagataattcatactggagagaaaccctacaaatgtgaagaatgtggcaaagcctttaaactggtcctcaactcttactaaacataagagaattcatactgaaagagaaaccctacaaatgtgaagaatgtggcaaagcctttagtgtattctcaatccttactaaacataagataattcatactggagaaaaaccttacaaatgtgacgaatgtggcaaagcctttaaccagttctcaacccttactgaacataagataattcatactggagagaaaccctacaaatgtgatgaatgtggcaaagcctttaactggtcctcaactcttactaaacataagagaattcatactggagagaaaccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtgtgacaaatgtgacaaaacatttaattaattctcataccttattgcacaggaaagcatttatacttgagaaaaattgtataaagaatggaaaagtcattaatatctgctcatatcttaacatcagcgagttggtatttaataaaagcattatcaatgaaattactggcaaaagatctttcagaccatataagcctgcaaagtgcaccagagtnttattttggaagaggaacatttaaagtccaaganggttgtagtacctttggtt

SEQ ID NO: 598328 - DNA, 193 bp, Homo sapiens
  misc_feature (80)..(80): n is a, c, g, or t
agtgacaggccaaaggtgcctttaaaattaattgatacccaattggtgccaagacaatatcctcctatccagcattgaancataagccggcaagtctccaggttaaaggtttgtatcctccagcaatgccagactgtgtcagacatctctgcaattcatcagcatctatctgcccatcctgtccagctacatg

SEQ ID NO: 598329 - DNA, 211 bp, Homo sapiens
acctgggtgactcgccaatcaaaaacagtacatcacatacactagaaatacttcataccccaactaaacatacaaatctgcttacgagatttgctgaaattgtctcaattttggctatcaatattcatttggttttcctcaccattcgtgttatataaaaaacccacaaacttgccttctactatttctccaggacttggctagtcgccca

SEQ ID NO: 598330 - DNA, 661 bp, Homo sapiens
  misc_feature (252)..(252): n is a, c, g, or t
  misc_feature (620)..(620): n is a, c, g, or t
cataaggttctttgaaaatgacactgaaagatatgaaaatgtggaaatgagattttcagttaaaaggctgtaaaagtgtggatgaatgtaagttgcacaagggaggttataatggactaaccaatgtttaccaactatgcagagcaaaatgtttcaatgtgataaatatgtgaaagtctttaataaattttcacattcagatagacataagataaaacatatggaaataaacctttcaaatgtaaagaatgnggcagatcattttgcatgctttcacacctaactcgacatgaaagaaattataccaaggtgaatttctgcaaatgtgaagaatgtgaaaaagctgttaaccaatcttcaaagcttactaaacataaaagaatttatacttgtgagaaactctacaaatgtcaagaatgtgacagaacttttaaccaattctcaaaccttactgaatataaaaaagattatgctcgagagaaaccatacaaatgtgaagaatgtggcaaagcctttaaccagtcctcacaccttactacacataagataattcatacaggagagaaaccctacaaatgtgaagaatgtggcaaagcctttaaccagttctcaaatcttantacacataaaaaaattcatactgaagtgtcacggtccgaca

SEQ ID NO: 598331 - DNA, 931 bp, Homo sapiens
ggacgcgtgggtcgatccacgcgtcggagtaatcaccacccaacacttgactaatctaaactaacctcaaaataaatgatagccatacacaacactaaaggacagaacctgatctcttatactagtatccttaatcatttttattgccacaatctaacctcctcggactcctgcctcactcatttactaccaaccactccaactatctataaaccttagccatggccatccccgttatgaacgggcgcaggtgattataggctttcgcttctaagattatgaatgtcctaggccacttcttaccacagaaggcacacacgtagctagtcccttatccccatactagttattatcggaaaccatcaggctactcattcaagccaaatagccctggcgtacgcctaaccgctaacattactgcaggccaggcatactgcaatgcgacctaatgggaagcgccagcctagcaatatcaaccattaagccttccctctacacttatcatcttcacaatttctaattgctactgactatcctagaaatcgctgtcgccttagatccaaggctacgttttgagaattctagtaagcctctagctgcacgacaacacagtataaaaagtagaagtaagccagaacagcaggtcgcaagccgagcaaggccgaacaggaacacatggagcgcggcggtaacgccatacgactaggcccccgagcaggcggcagcatatcatcgacccatcgggatagcaaaaagaggcgcacctaacaggcgagtactaaccgaaagcaacagggcacacattagacaacgtggcggcgacaggacacagcgacggcccctcacaaagacaccctctgggcggcaacaggcaccccccagaagacaagccgggtccaagcatacaggcaggggcaccccaattgggcaa

SEQ ID NO: 598332 - DNA, 111 bp, Homo sapiens
ggtactggaggatctctagagttgaccaggctctacgatatttggaggtcagcacggtgctcacgtgtcgacggaacttgtcacggacggcatgcaccgcagtggtgaata

SEQ ID NO: 598333 - DNA, 338 bp, Homo sapiens
agctgatcagagtgctagaacagagcagacattttgtaatgaggcctgagataaacactatccacctcgacacgcgacagggtcaactcctgtcagagatgtgtatccttataggtgaaaatgacacatttggagctgagaccaagaagaattgtgacctgaacgagaacattgagaaaggagtattgcatcgagcttttagaggcttcttatatcaacaccgtggtttacgaatacctggtggagacatccattaagcaatccagacgagcttgaggaaagggacgcccttggagtgaggcgagcagcacagagaccgctggctgagctggttcccg

SEQ ID NO: 598334 - DNA, 919 bp, Homo sapiens
ttccctttgtctgatgctctgtgtattgctcttgtgaatcagagtgtggaggaaaagttgagttgtatgagtggcggatgttggtagtgccggacttcgcatgtttcaaggtgttctggggtctcgcttaattgaatgtggaaagtagcaccactgtgaggggtacaagtgccgactcctgaatttgcccatggtgtgctgactgcaagggctggccagcgccagggagaatgggcccaggggaagcaaagacctcttccctctgtgcagtttctgtcccacttaactgagcatcaactggtaggcgtacatctaccccaaagtagatgttagaaaacgcctgaagattggatgaaaccatggattttctaaaagtcctattgtttcccaaaagcagggcgcctcctgcgagccacatcctttgccttccgtcgcttctgaaacacataccgacaggcccaagcgcgtgctggccacagcccgaagctcttagggagaagtatgaatgcgtgtgtctaaccttcagacgacaaaccatatttaaacgtttttaacatagatatatatcgtattgaaggctaaatggccttttaaaatgcttcaagcttgggacaattgacggtggggacagtaataggtggctattaaccaacggaataagttgtacagctacgtgatgctggcaaagaagacgccaagtgtcggccccggcacgattctggggagctgagggccgtcggcctgtctcttggaggggatctcactgtcaagaggggcggcaggacgggccctccccaacgagcgggaacaaaggaggggggacacacaccccaaaaacaatcgcaacagcggggggggagggagaccacacacgaggaacgacgcggcgcaacacaccgagcacacggaagcacaagag

SEQ ID NO: 598335 - DNA, 382 bp, Homo sapiens
aacaagggcgcgacgaacgtgttcgaggcgcgtgcacccttgaagcaatagagatagaccggcgtgtccggagtgatgccgacggttgcgcattcggcgagaatttcttccgacgacttgaagcgcgggccctcgggggtcggcttcatcatgcggtaccattcgagccagaccgcgccgggaatgcggcccttgcgcgggcagaaatccttgccgtaaggcgatgagctttctccgatccattcgtccacgtcgcggacatcgagaagcgcgatattcggcttgccgagcgcggcgagcatggtcttggcgtcgataatgatgtcggccgcttctggcacgaccgggaatgccttaggggcaggcgtaggcacttcggtgg

SEQ ID NO: 598336 - DNA, 153 bp, Homo sapiens
aggcaggctgtattgtcccatgagcaccagtgctctggatacggctggaagcactgtacccagagcaccagtgtacggcagacacattggagcactgtacccagagcaacagtgtacagcagatgcagggagcactgtccccagagcaccagt

SEQ ID NO: 598337 - DNA, 121 bp, Homo sapiens
cgcggaccccacagcattttaatcacacaaatctgatcaaaaacaaaaaaattttaacctttgtcactgagtgtaacctaaggcaacgttacttaactgctataagatgggtagtcacaga

SEQ ID NO: 598338 - DNA, 88 bp, Homo sapiens
aaaataaacccccaaggccaaaaaaaaaaattagggtgactttcccggtgtggcaatatagggaggccccgttttcccgaaaaaggga

SEQ ID NO: 598339 - DNA, 292 bp, Homo sapiens
tctctgagatccccagccatcaggacacaggcctaaactggaacaatcacgattacctaatttccagctctactgctttttttatcacattggaaagtctctcagatttttttatattttaacttataatttttgactttttttgtttagacagagtcccactctgttgcccaggcaagagtgcagtgttacaatcccagctcactgcaatcttccgcctcccatgtttaagctattctcttgcctcagcttccctaattgcttggattacaggcacacaccaccattccca

SEQ ID NO: 598340 - DNA, 308 bp, Homo sapiens
  misc_feature (2)..(2): n is a, c, g, or t
  misc_feature (15)..(15): n is a, c, g, or t
  misc_feature (19)..(19): n is a, c, g, or t
  misc_feature (23)..(23): n is a, c, g, or t
  misc_feature (33)..(33): n is a, c, g, or t
  misc_feature (285)..(285): n is a, c, g, or t
antttcggcacagantctntacnatcaaaatcnccataggacaaagtattgttggagtactaaaatttgcaaccttgtttactttaaaaggttgccactttcagtgcagaatactaccggcatcttgttactgcaatagttggaaataaaatgtgaaaattagcaaaaccatgcatggtttttttgggttctaaatttaagatgtaatatttcctataaaagggtgaaagcagttttctttctctataacctcaatcaccagtttagtgagagcctttcttggcngggcagggaggcagtgtcacccg

SEQ ID NO: 598341 - DNA, 874 bp, Homo sapiens
  misc_feature (32)..(32): n is a, c, g, or t
  misc_feature (64)..(64): n is a, c, g, or t
  misc_feature (116)..(116): n is a, c, g, or t
  misc_feature (133)..(133): n is a, c, g, or t
  misc_feature (166)..(166): n is a, c, g, or t
  misc_feature (181)..(181): n is a, c, g, or t
  misc_feature (191)..(191): n is a, c, g, or t
  misc_feature (207)..(207): n is a, c, g, or t
  misc_feature (218)..(218): n is a, c, g, or t
  misc_feature (220)..(220): n is a, c, g, or t
  misc_feature (232)..(232): n is a, c, g, or t
  misc_feature (272)..(272): n is a, c, g, or t
  misc_feature (276)..(277): n is a, c, g, or t
  misc_feature (282)..(282): n is a, c, g, or t
  misc_feature (310)..(310): n is a, c, g, or t
  misc_feature (410)..(410): n is a, c, g, or t
  misc_feature (444)..(444): n is a, c, g, or t
  misc_feature (447)..(447): n is a, c, g, or t
  misc_feature (507)..(507): n is a, c, g, or t
  misc_feature (528)..(528): n is a, c, g, or t
  misc_feature (530)..(530): n is a, c, g, or t
  misc_feature (565)..(565): n is a, c, g, or t
  misc_feature (574)..(574): n is a, c, g, or t
  misc_feature (587)..(587): n is a, c, g, or t
  misc_feature (592)..(592): n is a, c, g, or t
  misc_feature (603)..(603): n is a, c, g, or t
  misc_feature (610)..(610): n is a, c, g, or t
  misc_feature (612)..(612): n is a, c, g, or t
  misc_feature (617)..(617): n is a, c, g, or t
  misc_feature (634)..(635): n is a, c, g, or t
  misc_feature (642)..(642): n is a, c, g, or t
  misc_feature (645)..(645): n is a, c, g, or t
  misc_feature (653)..(653): n is a, c, g, or t
  misc_feature (669)..(669): n is a, c, g, or t
  misc_feature (675)..(675): n is a, c, g, or t
  misc_feature (681)..(681): n is a, c, g, or t
  misc_feature (695)..(695): n is a, c, g, or t
  misc_feature (698)..(698): n is a, c, g, or t
  misc_feature (707)..(707): n is a, c, g, or t
  misc_feature (713)..(713): n is a, c, g, or t
  misc_feature (716)..(716): n is a, c, g, or t
  misc_feature (719)..(719): n is a, c, g, or t
  misc_feature (723)..(723): n is a, c, g, or t
  misc_feature (736)..(736): n is a, c, g, or t
  misc_feature (740)..(740): n is a, c, g, or t
  misc_feature (746)..(747): n is a, c, g, or t
  misc_feature (760)..(760): n is a, c, g, or t
  misc_feature (764)..(765): n is a, c, g, or t
  misc_feature (775)..(776): n is a, c, g, or t
  misc_feature (825)..(825): n is a, c, g, or t
ggtcaaggaatgaaaatttaactaaaaaatangattaaaaaagcagttggtttttttagtagtnctctggtaatcagacgcacatacacacatacacaaaaatttatagagtactntgaatataggatttccnccataatcttgcatctgctatattttgtaaacngtataaactggacanggccaaattngagatgtctgataaantcttataaagnanttgggaactatnaactggatttccaaaggatcaattttaaactataaaaaanaaannattanataataaaaagcaaaaagagaattaaanagaaaaactttggaaaaaaaataaaaagtgttaactcattttctatacttatttcaaatatgaataagaaaaaaagttaaaagtagtaatgtttacactnaaaaaaaaaaaaaaaataaacataaatgggtggnttngggggggggggggaaagctatacagtattattgcactccatgaaatgtgtctgtaatttnaaaattatggagagggactgnanacactatctttgctattgaaggttttaccaagaangtaacaaanagacctgtcccanagaanacctatgtgtnctgtctntnaactnacttgtctgttctttcnntataccnagnccttgcanaaatgttcaagtgtangactgnctcctngcctaatgtatccnctnttaatgtcnaaaaanagnttnttcnagtgtctgtatanggtnggatgnntatgtatcgtaanggtnnttgagaattnnaaaatcccataatacaacaattgtagcattccatattcaattgttcaangaaatttgtaacaaagataggttgcaatgggatgggagggtggaaccag

SEQ ID NO: 598342 - DNA, 790 bp, Homo sapiens
  misc_feature (28)..(28): n is a, c, g, or t
  misc_feature (374)..(374): n is a, c, g, or t
  misc_feature (381)..(381): n is a, c, g, or t
  misc_feature (432)..(432): n is a, c, g, or t
  misc_feature (513)..(514): n is a, c, g, or t
tccatttaaccttgcgagtgtgcacggnaaacaaacatccctctttcccccaatctcaattcctttctccgccttattagtttcttgatatgcgtctttccttttttagagacatgaatgttcgtacattgacttcttacttaattatgtcttactcctacatatttccttcctgagggcgtcttcatttaaaaaacgtcaaatcgcactggccgcgctggctcacgctctaatcccagcactttgagacccctaggcacgcgcatcacattgtcacgacttccagaccatccctcccaacatggtgaaacccagtctttactaataatacaaaaaacttatcctggagtgactatgcatgcctgtaatcccanccactcngggaagctcaggcatgagaatcacttgaacccctgaaggcggatgttacantcacccgatatcggaccgctgcactccatccctggcgacagagccagactctgtctaaaaataccccaaatgaaataaagnntcttttcgacccccctcgcccattcaactttaaactcaaccaattttttccttgctcccccatttcagctcacttttccaattcccctatatgagtcctattcaatccactgcccgccttttacaccttggaactggaaaaccctgctttcccaattaatccctttcaaaattcccctttgccagttgcaatttataaaaagcccccccatccctcttccacatttcccacctaatgccaatgtgccacccatttttttttaccgtatttttttcc

SEQ ID NO: 598343 - DNA, 150 bp, Homo sapiens
gaacgttgcataaaattaacacgtgcaactgaagacagtcacacatctcctctaaatatttaatatccttattatccaactttaatctgatacaaccatgaaaaaacgattagaaacaaaaactataaccgaacaatatatttaatttta

SEQ ID NO: 598344 - DNA, 413 bp, Homo sapiens
ggttgccggcattccaaaaaggtggcccggccatgggcatttttttggatccagaaggcggaacaagtccccggagtcccttcaggccaacgtgcaacggtttaaggaggcccgctccaaaattatcctttttcccaggaagccctcggcccccaaaaagggaaacagttttttttaaaaatttaaattggccccccagctggccggaccggttatgcccgtccggaacgtttataaaaaggaaaaagctcgggtcttccctgaggaaaaaaaaaattttaaagccttcgctagtttccgtatggcccgggccaacgcccggttttttgggaaacgggcaaaaaaaaccaaggaaaccccagaacaggatttttaaaaaaaaaaataaagccctcctgggggcttggaatcca

SEQ ID NO: 598345 - DNA, 449 bp, Homo sapiens
ggtacctggcgaatcgccacacgcagaatagtacccgcattcccaggtcctgaatcctggatagtacagcgataagttcagggttgagggcgttttcaccccataagacagagaacgaagtatccaccatgaacgaaatagcaataataccttgcggggttacggaatccgccatagccgccaagacttcatcggtcacgacacgcataaagacacggcgaccttcctcaggtgtaggggtaccgtgcgcttgttccataagttcagcaatatcggggtgacgctcataggcgctttccgtaacgtatacggcgtctaacaccggtgattgcagatgagctttcagcgcctcacgcacagcttggggtccttcgaccatgaactgttttttcttggtacgaccacgacgagtgcatagtttggcgatgtcacgtacacgatcagcatcc

SEQ ID NO: 598346 - DNA, 978 bp, Homo sapiens
gatcacctatggcggatggaccctgttacactgtatcctgaacactggagggccttcagacgagctctcatacgctgctctagtactagcggggctctatggtccgggtgtgtcgtccgcaccacccctacgttccagttttgggggcaaaccatagcagcactcccgttaatttctccgctaaattttcctgcgcggcaaggatccgcagcattttgatggtgtgatgatggaattcgtgtgtgtttgagaacaacggccagttgccttacgtatgtgagcaatgaggagctgcggggaagtacttccagaggcagcacgcccaggctggtgcagtgggctgagcttatgctgagttccagactatagtgacccccaggccagtacccttggtgttccccacccttggtgccatcagtgcgaaccacgaaagaacacagagccatctgaggaactgcacatatgcgacgcgaacgttgaggtcgccatttcttgggcgacttgactaggattgctttcactatgaaagaaacgaccgtacctatttctggttgggcgcatcggagtgcactgtttggactgatcgatcaacgaggtctgtcgtgcatcccctgtgtgatggctcttattcgagcagtgattcctatgatgctctctcttattccatttggatgcgcctttcccagatatgcaagctgtgtgagtccctctagccctggtgtttaagccatttccccagggtgcactggagcagttcctttgtgaggcagaacagcttggaccaccttggatgttggaaggaaccgaattggcgatcccacgctattgggatcgccctttacacattcggattatggcaatgaaaccattcctaaagtctacttagaggtagcacccgcaagagtttgcaacactagaaaacgggatccaaggggaggtgaaccgcaactcctaaaaagcccccactggtttggaccc

SEQ ID NO: 598347 - DNA, 370 bp, Homo sapiens
gttttttaaaaggggataagttttgtcagtagggggccccaaacaggcattataggaggaaaggggccccctttggggtttttgttggttgggtttttgcctttggaccccccagggaatggggtttccccagcccccagttcttgaagcaccagggggttagaaggggcccttggccccctccagccctcaaaagttgggtaggaaaaacagggcctcccttgagggccccttttggggaaaaaggttccccggccccccaaagggatttccagtcaattaaaaggctttttaccagggaagccctctttattccggttccttgttaaagccgggaattttttaaattaaactttcccggttcaggtta

SEQ ID NO: 598348 - DNA, 187 bp, Homo sapiens
cgctagttggaaagataacgttgttgtccgaggctctgcccaagctggcttcctgctgactgacgacgacgccctggtcttcgatggggattcttgtggccaagctcaaggcaggagccgacgacatccagcatgccgctgttgaggtgctcaagggacttgatgatttctccgctgacgctatcca

SEQ ID NO: 598349 - DNA, 265 bp, Homo sapiens
gtacttgaacagagatgctctaaggaagctgactagagcagctgtgagaagagatgatttgagagaaagctctacatattgttgacagcttttagaggagatattacagaagagtctaatggagtttgggaggtcatacactgctcactacagtaatgtcgtggatgaacgttctattgtcaaactctttggtatcctttatgtcagagaagctgggaattgtacaaacagaatataaatttctacaaaccaataagctatatat

SEQ ID NO: 598350 - DNA, 222 bp, Homo sapiens
  misc_feature (115)..(115): n is a, c, g, or t
gggggggtgggagggaggaggaggtggaggggggggggaaactaccgcgtgatgagcccctgttgatgaacacagtcatctttctggggggtcctagacctggcattgggaacanaaaatgggggggggggggggtacgcttaaagaaaaatctcatattattgagatgaatattttatttgataaattgagctacagagtaaagtacttttaacaaaccat

SEQ ID NO: 598351 - DNA, 138 bp, Homo sapiens
atgtgtctacgtctatccactgtaaatatatggtgtgctcacacgatagaaccctaggaacgccaattgagtatcatacgctgagacctgttgctatgtatccaaatggttctttttttccggagtgctacacggcta

SEQ ID NO: 598352 - DNA, 146 bp, Homo sapiens
  misc_feature (3)..(3): n is a, c, g, or t
acntagagtatcccccgatgtcgctgccgatgacccaggcgcgaaggcacaggtggttccggaacatgaagtgccgcttcaggtgtactatatagtacttcatctccgcgccacgaggacgctgggacgtcggggtaccgagctcg

SEQ ID NO: 598353 - DNA, 236 bp, Homo sapiens
ctgggctcgaactcctgacctcaggtgatctgcctgcctggcctcccaaagtgtgggattacaggcgtgagccactatgcccggccacttcttgaattttcaaaaaaagactttaagtagatcaacaacaaacccagcaatttgtccacttctccttggcagtagatcataaccctggagtcttgatttatttatttttttttaaagatatttaaggttaaatttaccataaactg

SEQ ID NO: 598354 - DNA, 187 bp, Homo sapiens
acagaaagttataaattttttgaaattcgcctgttatttaaaccactttcctgaagtctgaccctccttgtagctggcacagctttatcaggtcaattggcaacctgggtgaggcgcctctggatattagtgaacgtaaacgacggtggtgatcgaaagaccaagtctgaaggccatatactccagc

SEQ ID NO: 598355 - DNA, 888 bp, Homo sapiens
  misc_feature (23)..(23): n is a, c, g, or t
  misc_feature (71)..(72): n is a, c, g, or t
  misc_feature (77)..(78): n is a, c, g, or t
  misc_feature (98)..(99): n is a, c, g, or t
  misc_feature (105)..(107): n is a, c, g, or t
  misc_feature (110)..(111): n is a, c, g, or t
  misc_feature (127)..(127): n is a, c, g, or t
  misc_feature (131)..(131): n is a, c, g, or t
  misc_feature (152)..(152): n is a, c, g, or t
  misc_feature (167)..(167): n is a, c, g, or t
  misc_feature (178)..(178): n is a, c, g, or t
  misc_feature (180)..(180): n is a, c, g, or t
  misc_feature (182)..(182): n is a, c, g, or t
  misc_feature (189)..(189): n is a, c, g, or t
  misc_feature (196)..(196): n is a, c, g, or t
  misc_feature (248)..(248): n is a, c, g, or t
  misc_feature (265)..(265): n is a, c, g, or t
  misc_feature (292)..(292): n is a, c, g, or t
  misc_feature (747)..(747): n is a, c, g, or t
  misc_feature (834)..(834): n is a, c, g, or t
gctttcttgttaacttgacaggncgaagctgtaatttttcaaaaacagtaaaagctggtttctcctaaacnnttttnnttgtggtagtagagatgagnnggttannnatnntttttgatcacttggntttnttttgagccgcgtcatttggngggaatctgtaaaantagcacaggtntncngttgttncattggntcacccacatgattagcagagtgcacgaaaaaataaaatttctattaaagantcatgctgagcacaagnttagagaggttgtgacattgcaaactngatagatggtgggggcctgggagattggggttctccaaagggctcccaacaccatctctcctctgatttctgtgacaaatgtggaaagctacttgcttggaggtactgggggaactgatgggggaactttcatcctgttaggaactccgctttccattcctgcgtctctgtcttgctccctggagatggatggatcacggagggggccacagtcagctggggcagcaggtactccctacggcactagtctacagggggaaggacgctctgtgctggcagcggtggctcacatggcctgtctgcactgtaaccacaggctgggatgtagccaggacttggtctccttggaagacaggtctgatgtttggccaatccagtccttcagaccctgcctgaaacttgtatcttacgtgaacttaaagaataaaatgcatttctaccccgatctcgccccnaggactggcacgacaggcccacggcagattagatcttttcccagtactgatcggtgcgtggaattcagcaccacttctgattcgatncacagtgatctgtctctgagtatttaaagagcaatgtcacccagtagtgtccag

SEQ ID NO: 598356 - DNA, 115 bp, Homo sapiens
cacgctctcacattcagtcaccttttgctggtgtctgatacagtagttgggaacagctgaagcattgtggcacactgtgtaatttaaataccccactggggctgaaagtggaaat

SEQ ID NO: 598357 - DNA, 534 bp, Homo sapiens
  misc_feature (51)..(51): n is a, c, g, or t
  misc_feature (69)..(69): n is a, c, g, or t
  misc_feature (91)..(92): n is a, c, g, or t
  misc_feature (96)..(97): n is a, c, g, or t
  misc_feature (126)..(126): n is a, c, g, or t
  misc_feature (215)..(216): n is a, c, g, or t
  misc_feature (218)..(218): n is a, c, g, or t
  misc_feature (236)..(236): n is a, c, g, or t
  misc_feature (238)..(238): n is a, c, g, or t
  misc_feature (244)..(244): n is a, c, g, or t
gccaaagccccatgtgccttgtccaggattgggcgagggccatgcgagggngtcagaagagggcgccanaccactgacggtggggacccanncagnncctctcccctctctgtccagatcattgcnttgccaggagatgggccaaaagcacccgcttttgcagagaggagctgattggagacgggccccctgaagcgcaccccatcctcaccagnngncggacctgcttgtctggncntcacgntgtgtcagaatttttcctaaaggaaaacccaagaaaaaggacgaagggaacaaaaaaacatggaaaggcaattttaatggtgaggcggtgccgggaaaaaagaaagagggttacgtggaaacgggggccagtgggtgcaaatgaacaggttgaatcggagcccccaggttttgttgtgttgaccaaaggtgtggtgagaactgtgggcggttcaccacattaaatggtgagtaagataaaaattgacgaaaagcacaggttaaacacggattttaaggacatggaaagag

SEQ ID NO: 598358 - DNA, 826 bp, Homo sapiens
gtttggaatttctagcttttcaaacatcctaatgttgattctacttatgctgcttgaaaagtagaaatcaaatggaagagtgataggaatttaggtggataggcagatagtgaatagcattagatgttcatgatagatctatgtattgagtgagtagggtagagacctaccgttgcatcacgaaaaaaacaaaagagtcatcgaaggatactagtgcacaatgacaggacacacggaagccaaataatgtacactaacatactactatagatcatccgacaaacaacaaaactaaaacctacgaaactatagccggagaaacggcctcaagaaatgcacaaaaacaaaaaaaaacaaaacacacaaaaaaacaaaacaccaaagaaaaacagcgcaaaaaaagaaccaacaagacaaaaaaaagacaaacaacaaccagagaaaaaagaaaaaaccaataaaaaaaacacaaaaagaaaaaaaaacaaaaacaaagacagaacaggagaaaagaaaaaaaaagaaaaaaaaagaaagaaaaacaaaacaacagaaaagaacaaaaaaaaacaaaacagaaaagaaaaaccgaacacaaacagacaaaaacacccacaaacaacacaaaaaaacagcaacaacgcaaaaaaaaaaaagaaaaaaaagaaaacaagagcaaaaacaagaccaagaaaaaacaacaagaaacaaacaaaagcacacaaaacaaaaaaaaggaacacaaaaagacgcaaagagcaaacacaaaaaaacacagaaccaaaaagacaaaaagaggacaaccaaagacaacgacaagagcgag

SEQ ID NO: 598359 - DNA, 1469 bp, Homo sapiens
  misc_feature (120)..(120): n is a, c, g, or t
aacttgtcaggatagatgccgtcatgacaaacctactacgcatccgctgttaggctgtgtaaccattaagcgactgaagcctgaacgttgtccaggccctattagtcgtatcgattcaanccatttacaggcttgactcgacttatacgctcatctgttcaccgacccgagatgactcgacgtggtaatgctcagtacacgtgataataggctatatacaagccatgttatcaatggaccgtcgcgggaaactctattactcctcgacctgttgtatccgtaccataaagtaatttgaccctcctacgcctagtcgatccatgcttacttcacgcaggtgctagcctgccattgcgccaaaggtgtaacaacaacttgatttgaataactgagtaccgtcaggataagctcctagtgcactgtggcagctcggtgttaggcatacagtcgacctctgtttgccctgtgaacatttcacgtgggcacctttggtactggaacactggagcgtacccatctgcatggggggttcccagggcttgtttgctacctttgacctgtcttcaaaacgcaagattgcaacaatttagacgcatggtccactgcctgtaaagcataggcgggacgcttattcatgaacacttgaggcataatgtgaaccgcaagaaatagacaactcgcgatcaattgcgttatgccatatctaacattttgtcagttcccaatttggcgaagataccaaggctaactccatttacaccgaaggactcccagactgaagtggatccccttcagaaacttaatccccatagcacccctggcctgattttgagcagtaacactttgtccaggcggagtagagggggggcagaacccatctgaggggggcccaaggaaaagccacaaaacagcatcccagtacgaccaggctaaccaattgcctgtaagcgaacttttccagcccaatcgtcggatcatggccgatacccctaaccttaaattaccttcccacttgttgaattctcacaattaacgattgtgagccagaccgtgaaacagagggttaacgccgttaagggggagtaagacacgcggcccaatgccttaattctctagaaagggtcccactattcaagcaaataaggggtttaacggaccggtcgaaatgtatgagcgaccgggacatttccaaattgggttgccacccgccaatcaaaagggctttgggtgtgttcacccgaattacacgatcctccgtggaaactgaaggattaagaccgcggggcaataccaggggaagggcgccaaaatctacctcgacaataacgccccagtatggacacggcaagaccactaagcggacatccacgaacagagccgccgaaaagaataagcacgctagaaataacgcacaaacacagaaaagaggggagacaacgagacagacaagcaaacgaaatggggcaaca

SEQ ID NO: 598360 - DNA, 394 bp, Homo sapiens
  misc_feature (203)..(203): n is a, c, g, or t
  misc_feature (289)..(289): n is a, c, g, or t
  misc_feature (296)..(296): n is a, c, g, or t
  misc_feature (361)..(361): n is a, c, g, or t
  misc_feature (377)..(377): n is a, c, g, or t
cttaggctattgctcctgaaagctaaaccgactatggtagacactggttatatcgaggagctcccttgtcaaggaaggacttgctgacccatcgtcaagggagggctgacagtggatagtcagctatctgcccataagggattgattccaggatagagaactagcttcacctaaagttatgttcgtctggagcagactatatncagtggctgaatcaggcactcttataaaagcccagtcatttggactgcaaggtaggtgaactctgggtaactattaaacgtccagnggctccnaggagggaatgctaagtgccccagtgtaccttgtgctcaccctctgcccaatcctgctctagctncttctctaataaatantctgcacagctaaacac

SEQ ID NO: 598361 - DNA, 769 bp, Homo sapiens
  misc_feature (769)..(769): n is a, c, g, or t
gccacggacttagaccagaggatcgataagtgccgtgtcagccccacctttaggaggacagatgcttccactatggcttcaactccaagctacctgaagaaagtcatctcctactggcggaatgaatttgactggataaaatgcaggtggacgattctcgaacgagataccctcacgttcaagactgaaacattcgaacgggctggacatccacttgcatccaacgtgaagccccccacagcttgccgcgcaggccataccccagaagcccgttgctgataggtggcacggcgtgacccgggcgtcttatctagcgatgttggatagagatcatcgccgagctacctgacgtgatccccaagaagccatggacctgagcgatgagcacgtacggtcgaagtcatctcgcccttccatccctggctatggcttctcagaggcatcctccaagaaggggtcccaactcggtggccaccggcaggatcttttagcaagctgatgctgcaggctgggctatccaggaattctacattcaaggaggggactgggaggtccctgcatctgtactaatcactggcccagctggtgcccagcgacgtgaaatgggctgcacttgaacatgtgttagagttgcaagcaacttctctaccctgaccctcctcctgggacagcgtacgggaggttccttggctcactgagagggatgtggagctgctgtacccgtcaaggagaaggtattctacagcctgatgagggacgagcggctacn

SEQ ID NO: 598362 - DNA, 118 bp, Homo sapiens
gccaaaaaaaaaaaaaacccaaaacaaaccaaaaaaaccaaataaggccttgccatttctctttttgttttctgggccagtttaggtgtttggccccggcaagggggtgtgtacggca

SEQ ID NO: 598363 - DNA, 315 bp, Homo sapiens
tcctttgcatacatgccagcgccgaccaagacaggttcgagaaatggtagaaatcatcaggaggggtgtattttaatgggcggaccgtggacacgtggagctggaacgagccagacgcagtgacatcatgctcatgatgaacctggaatccacggctgtgatcttcgaggatgtggggaggccgtgctggcactcgctccagaaagcttgcggacgagctgtggacgctcatacgcgacgtgaagccgggaagatgtgaagagagtcgcttctaagatggtccgagggaagccgggagtgggcggcctgggtgac

SEQ ID NO: 598364 - DNA, 359 bp, Homo sapiens
cggaagctacggtcatggatgagacatttcttcaataagactccaatttgcttttaggaataccctgagagtgcttctcctcgtgtaacacttcttcgatataggcaccatgtagccccttcctgcacatcttgcattcaggttgatggagctagttcttcagcacaactgtcaaatggtaggaggcctttcctttggggttttttccttgaaaaaaacttttggaaaagtatctagaatgatgagaaactgacattctttcatggcatcaaagtactgaggtaggaattaaaagtctgagttggcccaggtgccaagtgttatttggaaaaccggataagcttgcccgggggccaaaa

SEQ ID NO: 598365 - DNA, 388 bp, Homo sapiens
gctgtgtaaagaaatgggaaaagggaaaaggagagagctattgaggcagttgtccatattcagttttatttatttattttcaatctgggtttttatccaagtccaccagtctctgaaattagaacagtaggcggtatgagataatcaggcctaatcatgttgtgattctcttttattagtggagtggaatgttctatccccccaagaaggattatatgttatagacttgtcttgttcagattccgcattgaaccattttattgacacatagactaagttccatggatttttgttacaaatgttttgagaaaaaaccaacccatgtgcaacattaaaattaaaaggcattaataatatccacgtgtgccttcttactgaaaaaaaaaaa

SEQ ID NO: 598366 - DNA, 131 bp, Homo sapiens
attgatagcggatagggggcacacttggaagaattgtctgggacacacgtaaagctcactaacactgaagatagctgataaggcttaaaaagaaattgcaaaaaaatctcataatgttattgagaactgtt

SEQ ID NO: 598367 - DNA, 200 bp, Homo sapiens
gggcttgtcgtctccccgagcaggcaatggtcgaagcgctcgcccctcgcccgcgcccattcgaggagcttgacgttgccgttgacggcgggaccctcctcgtccccggtgatgaggaagccgagggatccggtgaaggcggggccggcggcgtcgagatagtcgagggcggcggcgagcatgaaggcgatgccaccctt

SEQ ID NO: 598368 - DNA, 202 bp, Homo sapiens
agcagggtgcgtggtggacagtcccattaaaacacaggtgactgtcgttagcaaaaggtcagtcattggttcaaagagtccatattatgaatatgtttttattccccagagcactctctttcctgaggaacaaagcaaagcactttgctctctcatgtatttagaactgtttattagtagatttccaagctataaacctgaa

SEQ ID NO: 598369 - DNA, 111 bp, Homo sapiens
ttttttttggaaattcccccacccccaaaaaacttccccggggcccggggcgggttttttcccccttttgaggaacaagggggcccaaaaaaaacctttttgcttttttta

SEQ ID NO: 598370 - DNA, 408 bp, Homo sapiens
gcggccgcctactactactctactactactaaattcgcggcccgtcgacttttcctctggggaccccaggccccagctcctgtctggttagaggctgaaggggtctgagcgacacctaccctaggggacctccggaggggtcttggtgtcctctgacttctgtcctcagaagggagctcagaatgcagctgaggcttcccctggggcccagggtgtctgtgtccgagccacagccagagtgtgccctggagagtcgctgggatgcacggtgggctctcgtcatcctgtccccactccaggctcaggctggagccgtgatggcaccgctgcactccaacctgggcaacagagtgagaccctgtctctataaaataaaaacaaaaataaagaagagcatgtggtttctgc

SEQ ID NO: 598371 - DNA, 627 bp, Homo sapiens
  misc_feature (46)..(46): n is a, c, g, or t
aattcggaacgagggccaggtgagtctcctccagggcccagcccantcttggacagaggaagttgatagtcaggaaaggcaggagtggcctcttctaacaatttcagctctgaaggggccaagggtggcgatgctgacagcatttcctccagctcccacctgcctgctccggggaactccctacccaggcattgatattcacctggtgatactaataattgtctcaggtgataaattgtctcagctgctctcccacatggcccacaggtccctggaggttccccggatcctttcagggaagaccatgggccctaaacgatcttcataacaaaactgagaagtggcctggcttcttcactgcgtgcctgtgtgctgggatctagcgtggcccgactgggcagctcctttccttccctgccctggggcccagggtgtctgtgtccgagccacagccagagtgtgccctggagagtcgctgggatgcacggtgggctctcgtcatcctgtccccactccaggctcaggctggagccgtgatggcaccgctgcactccaacctgggcaacagagtgagaccctgtctctataaaataaaaacaaaaataaagaagagcatgtggtttctgc

SEQ ID NO: 598372 - DNA, 918 bp, Homo sapiens
  misc_feature (46)..(46): n is a, c, g, or t
aattcggaacgagggccaggtgagtctcctccagggcccagcccantcttggacagaggaagttgatagtcaggaaaggcaggagtggcctcttctaacaatttcagctctgaaggggccaagggtggcgatgctgacagcatttcctccagctcccacctgcctgctccggggaactccctacccaggcattgatattcacctggtgatactaataattgtctcaggtgataaattgtctcagctgctctcccacatggcccacaggtccctggaggttccccggatcctttcagggaagaccatgggccctaaacgatcttcataacaaaactgagaagtggcctggcttcttcactgcgtgcctgtgtgctgggatctagcgtggcccgactgggcagctcctttccttccctgacgctgctccaggggaaagaaggaccagggtcaatccggggtgccccaggtggatcagcgaatgcccctgaagccaggtgccagttgcatccccgtcagatgcccccaccccagtctcctgagcctcattagtcacccctcattttcctctggggaccccaggccccagctcctgtctggttagaggctgaaggggtctgagcgacacctaccctaggggacctccggaggggtcttggtgtcctctgacttctgtcctcagaagggagctcagaatgcagctgaggcttcccctggggcccagggtgtctgtgtccgagccacagccagagtgtgccctggagagtcgctgggatgcacggtgggctctcgtcatcctgtccccactccaggctcaggctggagccgtgatggcaccgctgcactccaacctgggcaacagagtgagaccctgtctctataaaataaaaacaaaaataaagaagagcatgtggtttctgc

SEQ ID NO: 598373 - DNA, 1030 bp, Homo sapiens
  misc_feature (2)..(2): n is a, c, g, or t
  misc_feature (77)..(77): n is a, c, g, or t
  misc_feature (112)..(112): n is a, c, g, or t
  misc_feature (118)..(118): n is a, c, g, or t
  misc_feature (129)..(129): n is a, c, g, or t
  misc_feature (140)..(140): n is a, c, g, or t
  misc_feature (158)..(159): n is a, c, g, or t
  misc_feature (189)..(189): n is a, c, g, or t
  misc_feature (238)..(238): n is a, c, g, or t
  misc_feature (253)..(253): n is a, c, g, or t
  misc_feature (256)..(256): n is a, c, g, or t
  misc_feature (271)..(271): n is a, c, g, or t
  misc_feature (277)..(277): n is a, c, g, or t
  misc_feature (713)..(713): n is a, c, g, or t
  misc_feature (723)..(723): n is a, c, g, or t
  misc_feature (730)..(730): n is a, c, g, or t
  misc_feature (765)..(765): n is a, c, g, or t
  misc_feature (767)..(768): n is a, c, g, or t
  misc_feature (772)..(776): n is a, c, g, or t
  misc_feature (779)..(782): n is a, c, g, or t
  misc_feature (785)..(785): n is a, c, g, or t
  misc_feature (795)..(795): n is a, c, g, or t
  misc_feature (801)..(801): n is a, c, g, or t
  misc_feature (834)..(834): n is a, c, g, or t
  misc_feature (839)..(839): n is a, c, g, or t
  misc_feature (846)..(846): n is a, c, g, or t
  misc_feature (998)..(998): n is a, c, g, or t
tnaatcacagcttgctcacaatgacatacaggaaaatagcactaatgaagactaaatatgcaggcagcaaccttcangagttgggagtacgggagaaacgacttcaaaactncgatangtacttatggngggtatctggngattcttagttggcacanntgccctgcctagcccccttaactgcgtcanttcacagatggggtgttttgttgttggtcgttgttagtaggcaggattnccttacactgggganganagatcagcttgagtnaaagtncgcagtgtttttgattttgtttgtatgtgtgttttaatgcaacaaccagctcacagtttccaagtggaaaaatattcagtagcatcatgtacttgtactataggtaagagcttaaaatgaacatcatcaatcatggcatccacaaataagccacctgacgagcattaattaattcattccatcaaatagaacttaaactagagaattaagcccactttatgaagagcgatttcacggctgtcttgaaccattcgaatttgtgatttgtgttcagcactttaaaaggttcaactttttgcttctacccagattggtctcaggtctgtcttctcatccatccctttctaaagccaaagcacatttgtagcacataatccaggagaagcagaagtaaatgctatgactggtggtatttcttagcctggttttgtagttnttaggcagtnagtagantatgagcgaacaaatgtgaaggttcatgtggagtnanntttnnnnngannnnaanagggcttagncaagcncagagacaacaaagccttctaggtcattaggcnatggngggttcnagcaccatagactgtctactgacctcatttttcttttggaatggagttagacatggggagctcaaaagaacagacctagcaattcatttgagtggaagacacacatcaaagctgttacagacatgtagatatgaatacttgcatatgcatantgtatttttacaaaatgtagtttacaaataga

SEQ ID NO: 598374 - DNA, 754 bp, Homo sapiens
ccgagtctggggagctggacgacgtcacattccactcttgatgatgccgccccagtcctaccatctggacagcaggagaagctgcccatttcctccatctccggtccctggaggttccccggatcctttcagggaagaccatgggccctaaacgatcttcataacaaaactgagaagtggcctggcttcttcactgcgtgcctgtgtgctgggatctagcgtggcccgactgggcagctcctttccttccctgacgctgctccaggggaaagaaggaccagggtcaatccggggtgccccaggtggatcagcgaatgcccctgaagccaggtgccagttgcatccccgtcagatgcccccaccccagtctcctgagcctcattagtcacccctcattttcctctggggaccccaggccccagctcctgtctggttagaggctgaaggggtctgagcgacacctaccctaggggacctccggaggggtcttggtgtcctctgacttctgtcctcagaagggagctcagaatgcagctgaggcttcccctggggcccagggtgtctgtgtccgagccacagccagagtgtgccctggagagtcgctgggatgcacggtgggctctcgtcatcctgtccccactccaggctcaggctggagccgtgatggcaccgctgcactccaacctgggcaacagagtgagaccctgtctctataaaataaaaacaaaaataaagaagagcatgtggtttctgc

SEQ ID NO: 598375 - DNA, 651 bp, Homo sapiens
  misc_feature (46)..(46): n is a, c, g, or t
aattcggaacgagggccaggtgagtctcctccagggcccagcccantcttggacagaggaagttgatagtcaggaaaggcaggagtggcctcttctaacaatttcagctctgaaggggccaagggtggcgatgctgacagcatttcctccagctcccacctgcctgctccggggaactccctacccaggcattgatattcacctggtgatactaataattgtctcaggtgataaattgtctcagctgctctcccacatggcccacaggtccctggaggttccccggatcctttcagggaagaccatgggccctaaacgatcttcataacaaaactgagaagtggcctggcttcttcactgcgtgcctgtgtgctgggatctagcgtggcccgactgggcagctcctttccttccctgacgctgctccaggggaaagaaggaccagggtcaatccggggtgccccaggtggatcagcgaatgccctgccctggagagtcgctgggatgcacggtgggctctcgtcatcctgtccccactccaggctcaggctggagccgtgatggcaccgctgcactccaacctgggcaacagagtgagaccctgtctctataaaataaaaacaaaaataaagaagagcatgtggtttctgc

SEQ ID NO: 598376 - DNA, 155 bp, Homo sapiens
tgatctccaataataactgcaaactcgtggatggagaatgctagacgttcgtcgaactttccactgcatgtctgagggcagagtctcatacgtctctctcgaggcagtcgcaaattctgtcttccgaggtgtcaagagccacacgcaggtgggga

SEQ ID NO: 598377 - DNA, 1281 bp, Homo sapiens
  misc_feature (1271)..(1271): n is a, c, g, or t
gccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatgcaagagattttgccacaccatcactccacacctctgagtcccacatcgaagggntcctctagag

SEQ ID NO: 598378 - DNA, 650 bp, Homo sapiens
  misc_feature (650)..(650): n is a, c, g, or t
ctaatttgtatttttagtagagatggggtttctccatgttggccaggcgtggtggctcacatctgtactcccagcactttgggaggccgaggtgggtggatcacttgaggtcaggagttcgagaccagcctggccaacatggtgaaaccctatttctactaaaaatacaaaaattagctagatgtattggcatgtgcctgtagtcccagctactcgggaggctgaagtgtgatagtcacctgaacctagaaggcagaggttgcaatgagccaagatcacaccactgcactccagtctggttgacagagcaagactctgtctcaaaaaaaaaaaccaaacaaaaaaaactcttaagaactaggatgcggggagtcatcttggacctgtccctcatctacaaccactcccattccatccagtcatttcccaaattcggtaagtttggcctccgggtgtagaatcaaatctggtccctcctttccttctctctcattatgttcattatactctcacttattctatttctttcaagatggggatctgtgctatgctggccagactggactctaattcctgggctcaaggcattctctagcctcagcctcctgagcaagctgggaccaaaaagcatatgccacagttaccgggcn

SEQ ID NO: 598379 - DNA, 164 bp, Homo sapiens
cccagcttggtcccaaagagcactcaatactgacactaactacctagaattagcacagaccccacaggataataacaagagagaaaaggtgaatgctgaaaaacatatccacagaactaagggctgaaaacttcctaggtgcagcaaatgacataaacccaggc

SEQ ID NO: 598380 - DNA, 1092 bp, Homo sapiens
  misc_feature (582)..(582): n is a, c, g, or t
  misc_feature (1091)..(1091): n is a, c, g, or t
gctggcttgggaccatatattgggtctcagctaggtacgaattagaacgatcatggtgatgttggagtaggagggtttatcttggtgactgtggcgatgctggtttcactcgtaggtataacttatgcaaagcaaagacatccaggaaccgaattgccagagaagaaattaaaacagaagatattatctgaaggtacccacctcgatcctgaaagaaaacacaacggcagcagcagcaattgaacaatcttgagcatagaagtcaatgtaaacgaagttacagatcaagcacataaaacatttcatgtgcaataagctctcaatcaagtacacataaccgtccaagtggtaggtcataaaattcccaaacttgtgtggaatcgaaaacttgccagtatattctggccctgtgtctactgccaggatagcatacttacgtagtcccatatagtggactagacatcctctagaatgtgaacagacatttattggcagcgtggaaaagacattatacaaacatagtggtccaatgtacttgaagtttccctagtaagacagtaagtatacgagtccgagtggacncagtcaacgatccttaacaaaaactacaaccttactgactaattcgaatatcaacacaccagcacaactacgtaactgaagttctcgtacacgagccacatgtacagcgcacacattcaaaaatcacaggccatacatcacctttggcagaattgtttactacaagtgcactcaccaatagacaggtcccacaaggcgaacaatgccacacaatccacacaaccggtaaacaagaccgaaagcaaatttggggagacaaacacaagattacaagcgaacacataacaaatatctgaaatcaacatgctgactaccgtatggggccgaggagtaagataccaaggaaaaaattaagtaagacaatataatgacacagtagatgagtacatacttaagacccgctagaagaaacaccaagccgggaatacgaataaccggtgtgaaacaaaacaagcgacatatcatcccctatgctatgtctcgcttttcgtcttcacaattcatcgatnt

SEQ ID NO: 598381 - DNA, 156 bp, Homo sapiens
tattggtggtggagggacctggatattggcaaccagggtgggggctatcggaggtggttattgacactatggaggaggaacttatggaaggtcggaattaccatgatcatccgaattataaccgcagccttctaactacgtcacctgagagtggaa

SEQ ID NO: 598382 - DNA, 328 bp, Homo sapiens
  misc_feature (4)..(4): n is a, c, g, or t
acantctttccagactcacagtctagtatcatactgaatgcaataaactgaaagcctttcctctaatatctgtaacatgtcaaggacgcccagtttcaccactcttattcagcatattactggaagtcctaactagatgcaatcagcctagacaaataaattacgggcatttatttcaattataatgaaacttgacccctatctcttgccatatactacaatcaaattaaaacggattagagacctcaatctaatacctaaatctatgaaactattactagaaaacattcgagataccccctgagacattcatctaggtcacaatttc

SEQ ID NO: 598383 - DNA, 337 bp, Homo sapiens
cgcgttggaacactttggtccttgacacttggaacacatcagagagcagcagcctgtgccatcatcagatgtttaattttaatcttcaggaagacttgccagagtttaacctgacattatttgtattgagtaccatctaacatttctctatctgaaaacttttattactgaagaccacagtgattacaattcatatgtacctgtaaatcgttgcatttgtcaataatgcatgctgcttttgaaaccacaacttgtttttaagactataaaattgagggactgtggctgcagctcagggggtagagcatgccacacacacatgcacaaaagtcgacgc

SEQ ID NO: 598384 - DNA, 460 bp, Homo sapiens
tgttttttattatcacaaaaacagttaccaataagttataaaacgacatttaatttttcttaacaaagagtgtagtttaccaaggtaatccgtgtaagttcattttagtattttataggttcaatttgttactgtgtcggttcgtacaccgaactattttcaattctcaaacaggtaagagaccttaccttattttaacagtgaagggaattgggctctgagcaccaaaacaacaagtataggtaaagattgtatgtctattcaaagaatttttttgttttgttttgttttttcaagtgaataagacgtgagtcttcttggtcgctccttagacgtgaagttttcccttcactttgacttttgtaatccactttaaagtattcatcaactcaaatgagttgtgaccgtagtctacctgactcaaaactcaaaccttcaccacggttaattacccggggaa

SEQ ID NO: 598385 - DNA, 713 bp, Homo sapiens
  misc_feature (713)..(713): n is a, c, g, or t
tggtgtaatgggcccaaactgctgcaaacagagtggtgatagcccctaagcatagttgttaaagttgggattaggtgggctatttccttgctagtgggtgtgtagaagcggataggagtaaaaaagatccctgctacaactatatgtgcttgagtggagtatgggctagaaactgggggtggggccttctatgtgctgaggtgagatgtcatggggtggaagacctaatggggcttgattgtgcctgctgctagcatagagatgagatggccataagaactgtggtggagtagagcggtcttggagattacctgtataaagaatgtgtgctatttaagtatggtgggtgtctccatagatgttggagatgttgtagagatataaatccatggtctaatgtgcagcagtgatagaaacccagatattcgcgcgaaaatacgggtgtgtaaatacggatgtgtcattagaaagtgggcgtgtcgtggtgttagtgggccattcgtgcctcgagagcgtataatctaatcaaatattgtattgaaagccaacaaagaggtgtattattaaagttccctttaccgcccccctctctcaaagccgcggatgaaccccagtggggcacactacgggtgtgtatacgctggtacacctaaagacatcaagctcttgtgtcaaattcagggaacgagagagtagcgaaatttggaacggcn

SEQ ID NO: 598386 - DNA, 195 bp, Homo sapiens
tttgatgttttctcatgaatggggcgaggttatgcattccttctcattgccccatatcaggagattcatgatgtcagtatgatgatgattaccttgactacttggttaagttggcatcttgctggtctttctattgtggagttattctctttccttttgtagttgataagtatcttgcccgagatatttatcaac

SEQ ID NO: 598387 - DNA, 295 bp, Homo sapiens
tacatagatttattatatattcactccctttcttactatccttgtggtagctcttctactgcctccataccacctatagcccataggactctgcagttggtgtcggtggtggcagaggtggtataagagaggtgctgaagattattttcagtcagaaggaaagagctgagagggccatcagaggaagaaaagaactttttccactgctacgacctcccagaatcccttcctctatctttcctagagctgaagaccttcaccacagtaaaattactagaaatcagctacattcctt

SEQ ID NO: 598388 - DNA, 422 bp, Homo sapiens
ttgttgagacaattaagcatgttagtgcctagtacagcatttgagataccatacttgatccattgattttaattccccctgccctaaacatcaatttttctatctacacaacatgcataacacttcaattgtttaactctcgaaacagttgtcagggttaagttgggtgacgtatgtgtaggcaactaaagggttttaaactgttatacacatataaggttatagcagttatttttttcagcaattgtgttccagaatttggcacatgaaagttgttcagtaaatgctgattgaattgaattatgataaattgaactcccctgcaaaaaatgttatgattttattgacccaagaaatgcacaagtatttttctgaatcaaaatgctaaagttattggcaatttgtatattaaagaaaggaag

SEQ ID NO: 598389 - DNA, 1096 bp, Homo sapiens
ggagccgctcagctcccgggacgctttggagctgctgctagaattaatttctgctcagaccactgatcagccgagctcctagcatgcaagcccccggtcatccgtgcggtcgactctcccgtgctttgagcgctcacgtcgcggattgcttccgtgttcgtttcagaggaccgtgagcctcggtgagaccactgtcgccgtgggtgcaggcgtcgtgggcgccggggcgtcccgccgtacattctctgttatcatgggctcgaggggggaggacgaggaagaggcgccgagagagaggagagaggcgtatcttccatgggagttccctaagtggagtgacttgtcgacgacgaaacgcttatgttgcggtgtgcaaacattagttgatccgagacccgtatccgaggaagcgcatcgcgaatgacacacgaaggggacagcactctagtagaggctttggaccctgcgcatttccgtgtatatagagcgcgtagacacgcagagcagttcttcacatgggatcagaggacgcatactcccttgtttcttgcacccgtgggacctttctcgaaaaaagccatgaggcatcccaacaggggagcaatcgttgtgcccagcatattcgtcgcgtgcatccaaggacagtgacgtcagtaaactcaagtcccaggtgcgaaggcacgcgcacgtctgcagagacaactgcgcatcgagcgcaccgagtgggcgtagcgactctctgcaagaaaacggatttcggacgagcccaggaagaccacccacaagtggagcacctatcacagcgcgcgcaataacaagatgccgcatgccttatacgtggaatatcccccacggccaaccgttggtcacctacaatgcggccatgcgccgattctgtagaggcgcataaagcagagttcgtccgcgtgaacccacagccaccaatgacaatgcggttccacactcaaaaggaacacagagcaatcccaacatcaccacgaggggacaatccacgaccacacaccacaacaaaaacaaaggcgcccccagcacgaaccttggtgctcggcccttcaacacaggagaaaccccaggg

SEQ ID NO: 598390 - DNA, 1079 bp, Homo sapiens
  misc_feature (349)..(349): n is a, c, g, or t
ttggaatcgagctagtagcctattattcggcgcatgagctggagtcctaggcacaggtctaagcctcctgtattcgatggcgagcgtggcgccagacaggtaagccttgctgaggtgaacgaccgacatcgtacaaatcgtgtatctgtcagctagcgcgcagtgcgattgagtacataagtctgtgcttcctatcatgtgaaatatcccatgcatataagtcggtaggctataggcgaaggtgtacctagattgccccctcatataatcggtgcccccgtaatatggcggttctgccacgcagtaaaaccaagatacagcctgtcatggacatcttgaccgtccctcntcttccttactcacctgctatcgtctatcgtgcctatgtagtgagatgagctcgggtacgcaaagaatcgatgggttgagactagctctgtaccgcgtcctcattagcatagggatacactatcgtctgcgatcccatgagtagagcctacagttaggacacttagacgcgattgcatatacatccacgtgtaagctacgcttgaagccagagatggtttcgttccgcatacgtcatttccttttaagggagggcctcacttcgaaaattttgcactacaatctagatcgaaattcacttgaagtcattaagaagcccaccatggcggcattaatccgcaaatatcgcaaaacgaccctctacataggtcctggatgccggtcgcctaagtcagcaggcgagtcactaacgttcgttcctattctcatccccaggtccataagctggcttggcaatccactaattacctagataggcaagacccaggaaggcatcaaagaaccaacctttccttcgacccgccggcgggagggagggagaaccccgatatcgtatgagcaaatcaccggtattctggatcattccggtgcacccgtggaaagttatataaacgaatacttaaccagagtctccggaagaaaatcctccccagatcgggaactaaataatccggaaaaaaagaaaccttggggaaccatagggaccgaggccacagaggaaaaaaagggcc

SEQ ID NO: 598391 - DNA, 809 bp, Homo sapiens
cctcgaggacgcgcagtggccccccacccaccaggacgcacgtttcaatgctcatcagtaaaggttccttaaattccctaagggcaagaagttaaccaagtaaaacagcatcggaacaccagtgatcccatgacagattctgttgtcacgtctccttacagagttttgagctggtgctgaactgtcatgcaccatctgtcctggtcccagcatgccttctgagaccccccaggcagaagtggtggcccacaggctgcccccacacgctcagggaccacactcggcgaaggggatgcctggagaaggggtccccagaggataatggaagccaaggagcccctgtgtgatcctggcccgatgctcctgagcagtgtgcacctggcagctggtgccggactgcctccgagtccccacatcaccacacttgaccctgtgcaaaatctccaaaaatcttgccatgatattctgaatgaaaatctggggacacccctatggtcagaatcaacaagatttgggaagaagttcggcctgaagtgtgagctcttggccaatgtgtgagtactacaactgcgggcgggagctgtgaaggaccgcatcaagcctgcggatgactgaagatgctgagcgcgagtgacgatgaagcccgggaccagagaatcgagccagaaatcgggaccacgggaatgggcgggacggagagggaaggaggggaacgagacaaaacggagccaaaacaaagcgaagggaacgctgcagacacggggaagaggagaccaccgaacaagaaaaccaaaacacaaagaagagaa

SEQ ID NO: 598392 - DNA, 167 bp, Homo sapiens
tagaccttttgggttgtcccacttttggctatagtgaataatgtcatatgaacgccagcgccaaaatattgtaaatcctgttcaatcttaggtgttatacctagtagtagatcatatggtaattctatgtttaactttttgagaagacaccacactgtcagcacctt

SEQ ID NO: 598393 - DNA, 398 bp, Homo sapiens
tatgtattctgaggacaccattgactcatagcgctgactgcttgtccactctctcagtgacagcatggagccatcggcatactatgactgcaggccacgtgcaatgtcctgggacacgccatattcatcatcgacatcttgacttggcattctccatgatttgccgcgcgtccacctcagagacgtcatcgctgtcaggaccctgacgctccttctgctcctccacgggcagggtgggaggctgtgctgcctgcggctgctcttcctcctcctcctcttcctcttcttctgggccactttcttcactatcagacctcggagctacttcataccccgggttcatctcgagccaggcctccagctgcccggctttgggggcatctgtgcctgtgaggatc

SEQ ID NO: 598394 - DNA, 470 bp, Homo sapiens
ctcactgtctcgggaaaggaaaagcagagaggtgtccctctcttagtgcttggtcaagaagtgtggctttattacatgggcggtgtagttggctcctgaagcacaggcgtgcctgctcttgctgtcctcctggagtgctgaggaatgctgtttgaccttggtggtgatattgatcaataatcctccacaagcacagtgcagcgactgccaaatgcttagtcaccaggaagtgtccatcagcccacagcccgtgtctgtgcatgcttagcacctgtcctatctggggaaggagtatcctttattcttcaaatggtgtccttcctactatattgtggttaaatcaggtccttctgactgtgtcgctgttatgacatggtgctgttagtagacagtggcttgtctgcttgcattttttttataacaccctttcttggcaaaagaataaatgggtagcaatccaaaaaaaaaaa

SEQ ID NO: 598395 - DNA, 255 bp, Homo sapiens
cactttgagaggctggtgcagggagatcacttgagaccaaaagtccaagaccagcctgggtaacatagcaagactccatttctacaaagaaatatatatatttttttctaattagccaggcacggtggtatacaactgtagtactagccactcaggaggctgaggcaggatgatcatttgagcccaggagttcaaggttacagtgaactatgatttgccactgcactccagcaagaccctatctctaaaaaaaaa

SEQ ID NO: 598396 - DNA, 126 bp, Homo sapiens
tacctgatacaccgggatgtctgatccaacatcgaggtcgtaaaccctagttgatatggactctagaataggatagcgctgttatccctagggtaacttgtcccgttggtcaagttattggatcaa

SEQ ID NO: 598397 - DNA, 273 bp, Homo sapiens
ggaagagatcctgctggacctctagatgcaaacaccagccgaggatgtacccctcaaccccttcaaaggaggcccttcccctttggccttgtccttgctaccctaagcctggcctggcctggcctggcccccaatggtaagaagaggccattccatggccatttaaagggatagatggaaatttgttgatttggttttaaaggtaattaccatcattaaagtgcagttttaataaggaaagggatttaggatcaggggttagagagaaataaa

SEQ ID NO: 598398 - DNA, 283 bp, Homo sapiens
ctgtgtcatcagagctgagagggcgtccgactgcgatccgtcttgcatcatcagatagatgatacgcccgagccgctcgacaacacagcagccattcaagcaatcctatacaaccgtctcggcgcatctcggttatcatcctcgccttagcatgatttctccatacactccaactcatgagacacacaacaaatcgcaccttctaaacgctaatccaagactcaccccactactaagcctcctcctagcagcagcaggcacactcaccaccaggacttctccg

SEQ ID NO: 598399 - DNA, 305 bp, Homo sapiens
ggactttgtctggacatagagaaatccctttacttacaggtcacaacctatccataggggtgaaaaatgtctgtctcagatatctcctggagcagcataaagaccaataattgtactatatgatctgtaagtgctacaacatgaattagattatacttctctacttctgtgaataaatatgtccgaaagataatagaaatcaagccttgaagtacaagggaaagaagagaagaaccgataagtaaggggatatcatctaaaggaagcagaataccacattgagtcagcttgtcttgacgaacaca

SEQ ID NO: 598400 - DNA, 255 bp, Homo sapiens
cggtcctgtcatacgctgtgcccttgtgctgcaatgtgtcgttatagtacatgatttataatcctttgggtatatacccagtaatgggatggctgggtcaaatggtatttctagttctagatccctgaggaattgccacactgacttccacaatggctgaaatagtttacagtcccaccaatggtgtaaaggtgcttctatttctccacattctctacatgctagcgcctatgcttcacatagttcagcgtctga

SEQ ID NO: 598401 - DNA, 302 bp, Homo sapiens
ggcagaaactgggccttccaatctctctcagacaccagagctgcagatccaggctttctgggaaagtgaggcaccaggtctggagaagtctctgtcggctcttctgctgctgatactgctggtgctgggctggtcagccttcctgggcaaggaatcccgggcagaatccaggagattggactcagagtccccaaggtcactagacaaatgatgaggcgattgccggggggaacatgaccttgtgagacctgtgtgtcaatgcgtccggaaggtccgaaaaggaggatgtcagagaatcaata

SEQ ID NO: 598402 - DNA, 213 bp, Homo sapiens
ttgcgcttatactcctcaacgctttatacttctcaacgctttatacttcttggcacaaatactgcatgttctcacttataagtgggagctaaatgataagaacacatggacaaatacagggggaacaacagaaactgagacctacttgaggatggagggaagtataaagcgttgaggaagtataaagcgttgagggaagtataaagcgttgag

SEQ ID NO: 598403 - DNA, 456 bp, Homo sapiens
  misc_feature (176)..(176): n is a, c, g, or t
cccccaaattggggggcatggcccccaacaggattcccccgttaatcccctagaagttccactccttaacacatcggtttatctcgcttcggggggatcaatcccctgagccccccatagtttaatagaaaccccccgaaccccaatatttcaagcccggcttattccaattttantgggtttttattttaccctcccacaagcctcagaggaattggagtttcccttccccatttccgggggcatttaggggtcaacattttttgtagccccaggcttccccggacttccggtcattattgggtcaactttccccccaattgggttcatccgccaactaatatttccctttacatccaaacatccctttggttttgaaccccccccctaaaacgggcattttgtaaatggggtttgactatttttgtatgtccccctctattgatgggggtttta

SEQ ID NO: 598404 - DNA, 165 bp, Homo sapiens
  misc_feature (142)..(142): n is a, c, g, or t
  misc_feature (145)..(145): n is a, c, g, or t
ctctagagtgatccctatatggaaaagaagaatggaatggaagggaacagagtgcagtggagtggagtgcagtggagttgactgaagtggatgggagtgcagtggaatggataggaatgcaatcaaatggaaagaggttgantgnaatggaatggaatgaaatgg

SEQ ID NO: 598405 - DNA, 233 bp, Homo sapiens
  misc_feature (215)..(215): n is a, c, g, or t
tgcgcgcctatagcacgggaaggcctccttcagaactagtcaattcaagtcctgccctgtggagcaatatactgctgactacaaccaaattctttggcattctgcacaaagtgcctctccactggcttgccctgcccaatacactctgttgttcctgagttgttctacacaacgactttgctgcgcgctcttgggttgtgttgggccaccttggnttttctctggcactcttg

SEQ ID NO: 598406 - DNA, 706 bp, Homo sapiens
gcggcatggcctttcccagtgtccccacgcggaaggcaactgcctgatgatggctgctggcgtcgcacctgcccagagctgagtgaatgcctggctgccagttctgcggggctccgggccgccactcagagctatgagctacgtgccgcccccctcccgatgtggatgggtatgacctccctcaaggtggacaacctgacctacctgcacctcgcccgacacgctgaggcgcgtcttcgagaagtacgggcgcgtcggcgacgtgtacatcccgcgggatcgctacaccaaggagtccctgcggcttcgccttctgttcgctattcacgacaatgctgcgacgctgagtgactgctatggatgccatgtgactgggtgcctgtgctggactgtgcctgcgatgctgcgggtgcaaatgtgcgctgctacggccgcaccccctgtgaatcacaccacatgcctgcctgtgtggacctgccacaccctgcacggtacgtgtgggccggttgtgttactggactgcctggatgcctgcatgcgcctcaggctggctgtctgcctgcgaggtcgagtcccggcacttcgcgcagccgttcccactgtctcgcagccgatctcgctacagccgctcgaaagtctcgggtcccggcacctcgttctcgatctcggtcgacctccatgtccagatccgtacgacggtccaggc

SEQ ID NO: 598407 - DNA, 382 bp, Homo sapiens
  misc_feature (8)..(8): n is a, c, g, or t
  misc_feature (142)..(142): n is a, c, g, or t
  misc_feature (168)..(168): n is a, c, g, or t
  misc_feature (173)..(173): n is a, c, g, or t
  misc_feature (178)..(179): n is a, c, g, or t
  misc_feature (182)..(182): n is a, c, g, or t
  misc_feature (186)..(186): n is a, c, g, or t
  misc_feature (201)..(201): n is a, c, g, or t
  misc_feature (203)..(203): n is a, c, g, or t
  misc_feature (212)..(212): n is a, c, g, or t
  misc_feature (216)..(216): n is a, c, g, or t
  misc_feature (222)..(222): n is a, c, g, or t
  misc_feature (226)..(226): n is a, c, g, or t
  misc_feature (242)..(243): n is a, c, g, or t
  misc_feature (245)..(245): n is a, c, g, or t
  misc_feature (264)..(264): n is a, c, g, or t
  misc_feature (287)..(287): n is a, c, g, or t
  misc_feature (296)..(296): n is a, c, g, or t
  misc_feature (314)..(314): n is a, c, g, or t
  misc_feature (333)..(333): n is a, c, g, or t
ttggaganaaggtgggcacaggccaccacatccccccgttgggtgtcaggtctgagatgcagcgggagggccaggaatgggcggcccagggcccagggtccccggagacccagctggccgcggggagaaggctgagaaggcncgggtgtctgaggtggttttgctcanggctngtcannttnttantaatatttattggtnantaggtgggnatgnttaatntgantgggaatgggcaaganntnggattaattggtaaacagntttctccatggaatgatagaaanttatggggnagagggaggggaggtggnggttggagaggaataaaanagcaaggctgccttgcttttggaatcacagaagaaaagtctcggggcct

SEQ ID NO: 598408 - DNA, 179 bp, Homo sapiens
cgtcggagggctccgcccaaagtttggtaaaaggtttggggaaaacaggcccctgggaaacaaccggctttggggggtggggaaaaaaggggaggggctcgggcaaagggaactgtgcagtccccaggccgccccggctccgggctaaaggcaataaataaacccgatcctgccgggca

SEQ ID NO: 598409 - DNA, 150 bp, Homo sapiens
ttctctacagcttccattcatatatccttccagccacctatttttaactccagcgcatactatggcacgcgcggttttaggcgtggagaatacaactgtgaacaagacgaccgaaatccctgcctctatccagtttccggggatcctcta

SEQ ID NO: 598410 - DNA, 126 bp, Homo sapiens
cgcgttacgttccaaccattatagtaagtggagaagggattggccaagtcccaaccattacagggtgaagatattaacatgtaaacggaagatacagctttggatcaaggcgtagtccgatgcaag

SEQ ID NO: 598411 - DNA, 329 bp, Homo sapiens
  misc_feature (18)..(18): n is a, c, g, or t
  misc_feature (107)..(107): n is a, c, g, or t
cctacaggcacttaactnctcattctagtttagaccaagaatcaaacacacctccgccagtaccctttgccttgttgttgttgggacactttctcactttataccantcttttgaccctaatcccacaacaacagaaccaagaacagtactcccaaaggaactttaccctaaatcacacaacacatacaactaaacaacctcccgcaattgattcaaagtgcatctagaagtcagttgacaccaaactcatccagaagtgagtagacagcaaaatacaattcaacactaaagagacccaatttctaaaggtggataatttatttctacc

SEQ ID NO: 598412 - DNA, 277 bp, Homo sapiens
ttccaacctgatgcaagaagttctggccagaactacagggagggcgtgaatcctgtgtgcagaccacaggtggggaagcacgaagggttcacagctttcacagctgggaggctggtagcctggggcaagctctcagccctgcttgtccactgcctggacacagacttagtgctgttgagcagggaatggtgagagtgagactggccctttgggttgtgtgggagctgggtgaggcctgtgattgccagctttccctcacttccctgccaacctatga

SEQ ID NO: 598413 - DNA, 392 bp, Homo sapiens
tggaaagttcatttcctgggattcccttttccagggattttttaaagttaatttgggaaattaacacccgttccctttattgggggtttttgccccatttgactgaattgagcggtcatttggccatttaaagcagctgttttgggggctgtgaggggacatgtattaaaaccaagcccaacaggggttgccctaaaaaattgtccttggaataaccccacttgggagcccaacttcaaaaagggatttttaattgccccaaaaggccaaaatttgtccccctgggggtttgaaagtttgctttaaggggggggcatttttatgttttataaacccaaacaaaatttcccaaaccaatgaagggaacccaaataaaaatttttgcctttcca

SEQ ID NO: 598414 - DNA, 829 bp, Homo sapiens
ctctttatgggcacttacttccctaccatgggaggggcttttctgggcatgaaggccagatggattagaggaatctatgacatgtggaagaagctagactaatgctcagcgatcgaggactgaaccagattccctaatcgtagattcaccctctggtggtccccgaccattaatcgagccaatgtatctgtaggctttcaggtgcagctagacctgacgggctatcattcatgcacggcaagatccccacgctgaagatctctctcatccagatcttccgagctcacttgctggccgaagatccatgagagcatagtccctggactcatgtccggctgctccgaccaggcacactgatgcactggcacatcgcagacagctacaaaaggagacaatccatccccgacaagtcatataagatgaactcttcctgtgcagatatcctgctactttgcctcctataagctggaatgtctcccaggccactcataaactggatgactccaaaggatgtgatggacagcaccaacacccagaactactgcattgccctccacgaagctgctgagggcgactatcgatctccacgaacctatgagcgctaccacccgagaccaagtctcctggaacttacaccaccgacaaacatgagcactctaaccatcagcccacagagtatactccactcgcctattgaaccttgtccctatcaccctgcccccaggagaccaatagcacacctggacaaaacacgtcataaaagagatctcaaaacaaaatcgccattggcccagcacactttacaccctaacaccactgcaccttactg

SEQ ID NO: 598415 - DNA, 84 bp, Homo sapiens
ggcacgaggcctggtccaaaaggtgctaagggctcctcgggtccaactggcccgaagtgaaggcaggccacccaggacccccag

SEQ ID NO: 598416 - DNA, 105 bp, Homo sapiens
ttaatgttctttcctgaatctaagtcactgggatcgatcctagagtcagaccacaaagaacaatggctacatgccttggaagcactttgaaaacaaaacaaaacg

SEQ ID NO: 598417 - DNA, 291 bp, Homo sapiens
tttaagtttcaaggaacttcatggtattcctcatccaagaacctttatctattgatcccatcaagacccactgaattcctcaaactagttattttctccctcattttataggcaaagaatcagaggcccagagaagcttttggattcaaactactatggcagggctggaccctaatttcctcactcgtggtcaaggttacacctataactgactctcagtcgtcggttatttttcactaactcactgtataatctctctttcagcaaactttttggatctccttaaccctc

SEQ ID NO: 598418 - DNA, 408 bp, Homo sapiens
cctccatgtacacagaaatcgcccattccctccaaagcctaactatagcgcccccagataaaaactactagctctagtgacaacacagcacaactctgagtgatccaacttcatatactaagacccagtcctattgaagcagacacatacctcaaagcccattttaatccaatactcatatccattgcatagcaccagtggttcaggtcatgcagaccaccagtgcacacaggaaggcatcagtggagatagttcatagggacgagcctttgcactttatccctccaggtttaaaaaatccttaatatgtcacatgttatttatttgactttatttttttttagacagagtctcacttagacgccaggctaaagtgcaggggcatgatcctggcccccgggagcctca

SEQ ID NO: 598419 - DNA, 394 bp, Homo sapiens
tggatttgaatccaagtgtgcctgatgcaggacctagcttctgttgattgatcagttgattgattgagacaggctctccctctgtctcccaggctggagtgcagtggcatgatctcagctcatagcagcctccacctcctgggttcaagcgattctccttccttagccctctgagtagctgggattacaggcacccgctatcacacctggctaatttttgtatttttagtggagacggggttttaccatgttggccagactagtctcgagctcttgacctcaagtgatccacctgcctcggtctaccaaaatgctagaattataggtgcgagccactgtacccggccccctccttctatttattacactaaatgccatgaaagtgaattttttt

SEQ ID NO: 598420 - DNA, 134 bp, Homo sapiens
gcggccgcctactactactactgctcgaattcaagcttctaacgatgtacggggacatgatcataattgaaaggtcacagaacctttgtcattagagcacagtactgccaaataaagaatggaaattcaaaaaa

SEQ ID NO: 598421 - DNA, 313 bp, Homo sapiens
  misc_feature (36)..(36): n is a, c, g, or t
  misc_feature (110)..(110): n is a, c, g, or t
  misc_feature (276)..(276): n is a, c, g, or t
gggtagagatgggttcttgctatgttgcccaggctngcttgaactcctggcctcaagtattcctcctgccttagcctcccaaagtccttggattataggcatgagcactnctcccagccaagaaaaaatattctttatttttaagacagggtctcactctctcatccaggctagaacgcactggcacaatcatggttcactacagcctcaacctgctgggctcaagcaatcttcccacctcagccgcctgagccattgggactacaggtgcaccancacacctgggctaatttttaaactgttttgtagagac

SEQ ID NO: 598422 - DNA, 1606 bp, Homo sapiens
  misc_feature (1241)..(1241): n is a, c, g, or t
  misc_feature (1522)..(1522): n is a, c, g, or t
gagtgtatcttgcggctctgggtactgagcctcatctatgtgccttgtagtctgaggcgcaggtcaggactagcaccaagggagtcatgagacaccatggcacttacattaatatatatgtgctcacctgacggacgcaggacggcatgagcacctaagtcaattgtggacttgtctcgtgtccaatcagtagcgttctccattgagggataagacatgctccatgagtaagctagtaccgacgaccatagttcgtattgaactgtcaattagtctcttgtgcggcatccctcacgcatatggaatcgcctaggggacacgaacagatggtccactgagtaagatcaaggaagagcatcctcaagagtccctttgtcgtgaagaaccgatatgtcactgcaaggataaacaactgtcttgctccctctttgtatccctcggaagtgcaatgtgtataccacgcgctcagagtgttattcaccaatcatgttgttcagaactaagaagagcctagtttgttaatgcatcttatggcaccacttgaaaatatggggggattgcattttgaactacgccctgcggacttcgtgtgtggtccgcattacccataagttttcttatctatgcctcgagtttggcgtaaggacgaagataccccacttacgggttcgtgcacgaatcctgcttagaaacccattggacgcttagaagggaatgcctcaatcggagaggcccaacggagggaccaactccaagcccttattgccccacttggggctaagtagtcccccttccttggggacacgctattcgggcgaatgttcgcccgtttcccggaaacttttaggcaggcaacttttggggagttagtaaacggttcggcctgtgagtgcttcccaccatagtggtctcggagaccagttcgatattgggcctgtagccataaggggaccctaccacattggggctatacgcgcacatgaggggctccaaacccaatgcctccgggagagatccgctagggaatttccgttacagaagtagctgcgggttccatgtggatggccttacacccaaccttttccacatttcaacctggtattgatacccgcaactattaggacgggagggcgagataacatccttcgcctagcgttaacaatttgtgttcgctcgaagggggacatatacgctattatcacataccacggattacagtccatggagaaaaccccaacttntcaacctgttgtcactagacgcgtgcgttcgggtcaccacctgcggggtggttccaacccaacacgtgaaaccgggagacggtacaacagagcaacagacccgcgtagagacacaatgagccgtgcaccagggcaaggagtccaccacttcgttcacaccacagagcgaacgtcctttccaagaagagcgccgacatctgcctgtgaagcagtccacacacctctgccgcgggtgtgggacgcccgcacccactcacgacccatatccggcactgaatcanaccacatcatattacgacacgtgcaacattccttacgcaaggtccgacgcgccactccagcagtcgtcacaacgtcatctggca

SEQ ID NO: 598423 - DNA, 227 bp, Homo sapiens
tccccccgcggtcactcttacgactcttatctctactacctctttatcttcttctttgatctaccatatttcttcaacctcatcatcgcttacttctttatcacgttccttctccaccataagagtaatgagatatccaataaactagaaaatgtatcttcacaatctcctttattcttcgttcctccaagtactcagatttggtctaccgtaagacataaccgctg

SEQ ID NO: 598424 - DNA, 339 bp, Homo sapiens
ctcgtgccgaattcggcacgaggagagagagagagagagagagagagagagagagagagagagagagagagagagagagagagagagagagagagatagagatagagagatagctactccttgatatagacactgcttttatcatatttttctctttctctgaccattctactattttatcagctttatatcctttttcttttctttatgttccttctttatttctttttcattattctcttttctatctcttttatattcctcattgtttccctcttcttacttttatttatgtcttactcccatttactacacaattaatttttttttcctcttttg

SEQ ID NO: 598425 - DNA, 894 bp, Homo sapiens
caattcctgccgggatcccagagctacccttctggagccacgagggaataaagtgaaacacctcaggctccaagcactgccaaccacagaggctccctcctggagggagagagaggatggaggacgatcacgccctgggcgtggtccgctgcgagcccgtggagactgccaggagatgtcctctttctggttacaggaccctgacggtggccctcttcacgcctgatctgctgtcctaggatcggatgagaaggtattcgaggtacacagtgagggcgaagaagctggcggttgagcccaagagggtccctcgaggtcaactgcagacaccacctgtaagccacgcgctgaagatggggtggtctgggagaccgtctctagcataagattcgtgcgtggacagaacaggctcagtggaaacattacttggtctcgaaagcatcgtcccatgacagggtcctccaatgccacttcgaccgtgctccggggaagcaggagtcgaagtgacattccaacgtcagcgtgtaccagcctccaagggaggtcatcctgagactgcaaagccacgtttggtggctgtgggcaagtccgttcaccattgagtgcagggtgcccaccgttggagcccctggagagcctcagcctcttcctgttccgtggcaatgagactctggactagtgagaccttcgggaaggcagcccctggatccgcagggagggcacaaggcacattcaacagcacggctgaacagagaggatgggcaccggaggttttcctgcctggcatgtgctggacttgatagtctcgctggtgcgaacatcttttaaaaagcactcagacccgaaagatgttggcagatctatgagctgtgtcggagagccagatgggcatca

SEQ ID NO: 598426 - DNA, 101 bp, Homo sapiens
aggcgagctggagagcttggttcgtggaagaaggagcctggtgttccctgaccattgctgagcctggccattatctgccgatgtgcaggaagcgcacgatg

SEQ ID NO: 598427 - DNA, 235 bp, Homo sapiens
atgggtgctcatccccggctactgcctctgcgagcagaccccccacgagcagcatggaggctggctccatcatgctctgccgaggccatggggcagtgcgtgcaaattagggccgaatgcaggagacgtcacaacacagggatgttgctggaactctcaaagccaagcttgcgcctcttggcccatgcaggaccagcacccagtggataccggagctcgaaattcggtacttcat

SEQ ID NO: 598428 - DNA, 231 bp, Homo sapiens
  misc_feature (71)..(72): n is a, c, g, or t
  misc_feature (74)..(75): n is a, c, g, or t
gagagctgggttcctgggctgcgggaagttggggagcagaggccgcttggtgtccgagtagggtaagaccnnanncacccagtccgttaggaaagaagggaaacgaggcaatttttcgggcggattccccggacggagggctaaggttttttggaaggcgttgttccccgattggccacccagatatttccggccccggcttcaattggcctttgcccaaggaaggaaggg

SEQ ID NO: 598429 - DNA, 150 bp, Homo sapiens
gtcggagcatggtgggcacctataatctcagctagttgagaggctgaccaaggagggtagcttccacctgggaggtggcagttgtagtgagccaagattgagccattgcattacagcctgggcaacaatgtgagactccgtctcaaaaaa

SEQ ID NO: 598430 - DNA, 136 bp, Homo sapiens
ccgagatccccctccttccctggcctctcctgaagtgctgggatacagttatgagccaccacacctgccaagtgctttgtgatactatgcatttggcaggtgtggtggctcataactgtatcccatcaccgcggag

SEQ ID NO: 598431 - DNA, 216 bp, Homo sapiens
gaaccttcggcagtgtatactctgaccgcgtgtagtgatccgccgaacaagagccaagcaagagcaggcaggcgctcagtgcaagcacatcgccataggcagaaaacccagctcttcagggctgcagctctacaagccaggcccaggtccattacagagaacgtctagctccctatagcctatgccagcacagcaggagggttacagaacaggaac

SEQ ID NO: 598432 - DNA, 107 bp, Homo sapiens
atactaggctcggaccgctatcttatttgggtaaatggtttggctaaggttgtctggtagtaaggtggagtgggtttggggtcttagctttggctctccttcaaagt

SEQ ID NO: 598433 - DNA, 391 bp, Homo sapiens
ttttttaaaaacctttttagggccttggattttatctcaggaaaacaaaggggttggcccctggtttttccgttttgccccttgttccgcccccttttttttttttgggggggggggtttttgctttttttttttccggggaaaatttcccttttttttttttggggggttaggttaccttccccttttccccgttataaaaaaattttcccccaaaaaaccttgttggcttgaggttttttcccttttttaaggaagggtgaaaatccctttttgggggcccggtttttaagggaaagggttacctttaaaaaaaattttttttcccggggcccaaattctttttttacccccctgggttaaaaaattttaaaaaaaaaaaaatttttta

SEQ ID NO: 598434 - DNA, 341 bp, Homo sapiens
  misc_feature (22)..(22): n is a, c, g, or t
  misc_feature (112)..(112): n is a, c, g, or t
  misc_feature (135)..(135): n is a, c, g, or t
  misc_feature (139)..(139): n is a, c, g, or t
  misc_feature (177)..(177): n is a, c, g, or t
  misc_feature (219)..(219): n is a, c, g, or t
  misc_feature (271)..(271): n is a, c, g, or t
  misc_feature (292)..(292): n is a, c, g, or t
gatataaacctcattataaatncataaattgatattttttgcttcttaatcattctccaatgagttgggttaatattcttacaagtttggttaatgtaccattgagtaagcncacacttcaacaaggtaattaantttncatgattcccaataagccctatcttagtagccaatttncctcccttgctgacacaataaagtattgtattccataaaaanggactgtagagggacatccaaatcagtgtgaacaaatgtgttagcgggaganatagtgtagttagtaggagantggtaagcaaaggctttctgaaggtgggcaacaaaatctaaattttgga

SEQ ID NO: 598435 - DNA, 160 bp, Homo sapiens
gttgcataggctggtctcgaactcctggcctcaagtgatctgcctgccttggcctcccaaagtgctgggattactggcgtgagcgcaccatgcccagcctctttttgtccttattcctaatgtggttttgggttcatttaaccagactattactgctctg

SEQ ID NO: 598436 - DNA, 1073 bp, Homo sapiens
ctattcttctagggagtgtacagctgtttgttctccctgtgttgtgtaatgttagccccctgagtggttgagggcccctctactaccgggggtggcacacccctttcttgtggccccctttttggttcctctccttaggtcccgctggttccttttgtgtttctccgcccagtgtccccaggtatcccaagatttttgggggggtcataacccccgtttgttccccccccaggtgtcctccctgccctggacttcccactcctccgttcaagtttctggttttcttcccctagtcaccattttaagccttatctaattaacctctgtttggaacctgcctaataaatacagtctacacccgaacgtgccgggagattgctgtgtacccccgcctttgaagcacctcctcagtacttttgcccacctatgaaatggccgtgaaaatgcctgaaaagtcccccccctccttacttacctgcctgaagaaattctgcctttgaccattaatcctatacccgctttttgtttctttatagttcaccagaatctcccattcagggctcttccaaacttgtttgaaatcaaaataatagttgtcttcttgtttaacgccatttattttccaacccctaaggggctttttgacacatctgttaaaacgctctttttgtttttttgttaagtcttttacacttttaatagtttttgaagacccattctaggttaagcccagggcccaagggccccttgtttgccccttaattggggggtgggaagggaaagagggtacttgccaccatagtttcctcttttaactgcacttttctttaaataatgcgtttgcacttttgttacttgctaccctgagtactttcacggaagactgacttaaatattcgcgggtgagctaagtagcttgggtataagattctgaacttttcattctgcacgaggcccacggaacaatactttgacacttgtgacttgactgtggaagatgatggttgcatgtttttagtttgtatatgtttccatctttgtgataagatgatttaataaatctctttaaatta

SEQ ID NO: 598437 - DNA, 267 bp, Homo sapiens
ctcactgcaatctccactcccggggtttaagccattctcctgcctcaccatcccgattagctgggattacaggctagtgccaccaagcctggctaattttttgtatttttagtagaaacgggtttcaccatgttagccagggtgttctcgaactcctgacctcaagtgatccacccacctcagattcccaaagtgctgaaattacaggcatgagccatcgtgcctgtcctcagtgtccttttaaatggggatatttagacacaggga

SEQ ID NO: 598438 - DNA, 300 bp, Homo sapiens
gggtgggttttggcggcttctttactacaaacttttttattagcaaggtctttaagactcgtatcttgtgctgacctcctatctcatccggtgactagaatgcctaactctttgggaatgcagcctagtaggtctcagccttattttacccagcccctactcaagatgggattgctctggtttttatgcctctgacaacatgacatgaccatccatatcctctcatctcctcttttttttttttttggaaaacaaattttgcccttttcgccaggttaaagcacatttaaccctcaaggt

SEQ ID NO: 598439 - DNA, 227 bp, Homo sapiens
cgaatgtagaggatcccctaggctgtggaagagggaaggaagcacctgtctgtgtacgcggccgcccggacgaagctgaagagggacctgaagcacacggacagcgcacatccgctcggtcaacaagaaccgtcacgaatccatcaaacaggtgcacgcagctgcaggcactagactatggactgcatgcgcgagctgtataacagctgcacgtctcgtgaggagat

SEQ ID NO: 598440 - DNA, 178 bp, Homo sapiens
gaggatcccgtggaatctctgctgctcaggatacccgggccagttagattagaaaggcctgctcacagaagtgttttagggagcgtttgacagtgatgaggggtggtcgtttgactgcgtgctccgtagctggatacatggcaatgagtgcagtgatctgctgtgatcctgtgttgaa

SEQ ID NO: 598441 - DNA, 1235 bp, Homo sapiens
gatcccctctgcgggatggtacggcccttcaagggacccattccatcctcctcctcatttctttccatttggacatccagggaatgtgtctgccctatggtgtccccatatccttattgcccagacactggccccatcgaccaccctactacctccatcccatcagaaccactcatatgacaccacatgggattgctgtatttatatcactcatgacccatggagatgaggacgatcagcattcagaggaccaacccgaacaaagatatcgaatgcaatacacaaagagatgacagagatgacgatgacacggacccattccagaactccctgacatcatagacgagattcgagagaaccacttgatgaaaggcatcagcataaagggaagcaacgagactaggaacgcgacacgcagacagtaccaccataacactgggagagcctagaagagcaccacaaggagacctacaaggacctggtgacaaaggaaaccacggaagggtggggcacagcgagatagcggccaataccacaaggcacatacaaaagacccaagcgaagcaaaggtgaactgaaacaacacaaacagaaagcgggtgcggcccagacatgaaagcgcacaagcacgatagcacgcccaagaaaccacatcgagccatcaaagaagagagacatgaaaccatcacaagcacaccagcacccctagagcgaaaagccaagacacggagcaatcacattcgggacactacctagaagcaagaacgaaagagacactcgaaggacccaagaaaaacgagacgaaacgggagaaacaaacaagaaacacagcatggagaccccccacaaccaaccacaaccaaacgacgcacagctgccagaaagacacaaggacgcacacagagagatgaacacactgacacacgaaccaaggaccgcaggcccgaacccccaccagaacccaccacacagcacagagccaccgggtcaccgcagaacaccaacgagcacacaaaagcacgaacaaagcacaaaacccagtgggacaacaggggcacagacaacgactaccccagaaccaacaacacacacacaaaacaccagacgccacagccacgaacgaacacaaacccagcgcacaccagaaacatcaccacagacacaacacacacaaacgagcaacacagccccgcccgcacccaaaaacaacaacacagaacacccaccaacgcaga

SEQ ID NO: 598442 - DNA, 380 bp, Homo sapiens
  misc_feature (80)..(80): n is a, c, g, or t
  misc_feature (146)..(146): n is a, c, g, or t
  misc_feature (166)..(166): n is a, c, g, or t
  misc_feature (243)..(243): n is a, c, g, or t
  misc_feature (284)..(284): n is a, c, g, or t
  misc_feature (321)..(321): n is a, c, g, or t
  misc_feature (344)..(344): n is a, c, g, or t
tgagatagagtcttgcccaggctggagtgcagtggcgtgatctaggctcgccgcaacctctgcctcccggctttaagcanttgttgtgcctccatctcccgggaagctgggattacaggtgcgcaccaccatgcctaatttttgtntttttagtagagagtagggnttctccattttggcagactggcttgaattcctggcctcaaagcaatccaactgtcttggcctcccaaagtgctgganttacaggtgtgagctgccttacctggcctggaaaaacagcnttcaaacatgagataggacttcaccagaaaatgactnttatgtcttcagaatattaatgntctttcccatcatctatatccagacagatttttttt

SEQ ID NO: 598443 - DNA, 697 bp, Homo sapiens
gacccccaatttatttcaggaagccctgaatctccaattcgtttatggtgtgtggggctgggaaacacaaaagtgacatttacaaatcccaaaaatccagttaggggtgggttttccatccaaaacataccacctttgcatttggttctccagataacataaagcagtggaaattccctgatggaagtttcattcaaaatctttccggtcataatgctattattaacacattggcggtaaattttgatggagggcttgtatttggagctgccaatggccccatgcatctttgggactggaaaactggctccaattttcagaaaggttcccccagctgggcaacctgggtctttggacagtgaatcaggaatatttgcttgggcttttgatcagtttaaaagtcgatttctaccagctgaaggtgataaaacccttaaagtatccaaagaggatgccccacccccaaaaaaaactcatccagtcaggtggaaaccaaaaattttcaaaagaaaaagtttttaatgaatggggaattttttttctctctttttttttttttttaattaaaaaaaaaaaagcttggggttcttgaggatatccagtccttttgtgctctggctgggaatataaaggagaaattcccttgtttcaatcattgctgtttcattttttccaataaactgtcccctgtccccta

SEQ ID NO: 598444 - DNA, 123 bp, Homo sapiens
tagaagtctttcacagcactagattggaaggtggatgaaggatagggcaaaataagctaaggaaagtgcatcctatgacctcaggctgacttcaagtaagagtggatttgataaaggcattgt

SEQ ID NO: 598445 - DNA, 249 bp, Homo sapiens
taggttgaaggagactgttgtgatgcgacatgacgtagctgcggcctcctatggatcgattcaggcccgagcgagctgatgatgtgttctcgcgttacggtgatcagagggtggactcacgtacgcgaagctctgcggcggcacccccgacggcaggagttcagatatcgccagtggcgtttcaaggcggacggcagctctgatgccgatgcctgcgccggaggcgcttccggcgtagtaccgctcgaa

SEQ ID NO: 598446 - DNA, 361 bp, Homo sapiens
caggaaccggccggggccccatccctgacactgctgtcgcccggctgtacctgggtgctgtgtccccggggcgtttggaaacgtcaatgtggtcaaaacagggcctggaacggggaggtttggccttaactaaaaaaatgaggggggtatccgcttttcccccctggcctcaaattaaaaggctttgggggcaggagggagtcaaacacgtgcagggcaggcggcctgtgcagggcccaaccctccggccccaaaacctgacctcctcaaaggccccccccatggagggatgtttgggggattctgtgccccccccctacaatgtttggttaaaaattaaagccctttcaaaagtggccca

SEQ ID NO: 598447 - DNA, 465 bp, Homo sapiens
  misc_feature (15)..(15): n is a, c, g, or t
  misc_feature (39)..(39): n is a, c, g, or t
  misc_feature (101)..(101): n is a, c, g, or t
  misc_feature (115)..(115): n is a, c, g, or t
  misc_feature (174)..(174): n is a, c, g, or t
  misc_feature (183)..(183): n is a, c, g, or t
  misc_feature (210)..(210): n is a, c, g, or t
accaagatgggatgnttttcaaggactctcagtccgccnaggtgtttttgggggagcccgttttcctagtgtattcctttaagaggttgtctaaagtcttnttaattatggaagnttttatatcccagagtagtcaattaaggatataaacgatataaactttccacaccttcngtcgtgacnttaaagcacagaaggacaaccctgaancatgtaacgttggtcatttcaatattttgtaccgttttaaatctgttagtgtatttacttcattgtaaatatttttgagggtacctttgtattttgcttttgaccttggttctgtgatttggatgtcaacaacttccctaaaaagcaccagtgtgttaggttctaatgtcatgacccaatttgtgttattcatctttaatcctgttttcagtctctatgtgtacagcagtatttttaataaagaattacagagat

SEQ ID NO: 598448 - DNA, 176 bp, Homo sapiens
  misc_feature (28)..(28): n is a, c, g, or t
  misc_feature (34)..(35): n is a, c, g, or t
gaggcaggcacagttagatacaagtggnatcttnnaggcccgagtgtggcaccaagtacctgctcaacctcaacctggagcctttctctgagaagagcgttcctctttgcatcctctatgtagaaataccgtgactgccttacggagtccaacctcatcacggtgcgttggcccaa

SEQ ID NO: 598449 - DNA, 477 bp, Homo sapiens
taagtgaaagggctcaaactcactatcacgtacgtgtagtgatcctcgacaaatcgagctgatcggcatacaatgactggtacatgacgacgtataacaagagtgaatatttactatctggatcggacaaagagggttctattgaaccaagccagtaaatacgctccaacttctgaaggattacctcgactatctcctgatttaggcaaatctttggcaaggttctcttttagggagaggtttactctgatgcgtaaaactgagccttggtttcttcttgtatagtagtcgttggttgagatattttttaacatttagaaggatggttggattggagttcttgatgtctttatctgtcctttgtcctagctgctgtctgcaaaccaacagatggcagtggaaatggtcttcactgtctgttctggtgtgtccaccaccaacttagaatttctttcttcattctcgtgtctccaactc

SEQ ID NO: 598450 - DNA, 254 bp, Homo sapiens
cccccccccggttttttttttgggcccggggggggaaaaattttttcccccgggaaacatttttcccctttgccccttttttgggcccctttaaacccattttttccaaaaaacccgggggggcccccccccgatttccccggttttttttccccccccgcccccccccccggcccccgggggggggtttttttttttggggcctttttttttttttcccccttttttcccctttttttttttttcccccccca

SEQ ID NO: 598451 - DNA, 448 bp, Homo sapiens
agtttgtttgttttttcctgaaattattagttccactcttttcacattgcctgtaggtccttgctctctgctcccctgtttgatctgtatttctttttctttcactgattttccaaatattgcttttatcatggataaatcactgcccataaaaagcttgggaatgggccgggcgcggtggctcacgcctgtaatcccagcactttgggaggccgaggcgggcggatcacgaggtcaggagatcgagaccatcctggctaacacggtgaaaccccgtctctactgaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctca

SEQ ID NO: 598452 - DNA, 728 bp, Homo sapiens
atgaagattcagggtggcataaatatatccagaaaagaagatggaaaccacatgtatgggcttaagatgttaatcgatagaacatagtagaagcttgtattttttctctacgagtattggttctatataaatttggaacggtggcgcaatagagaagctgacgaggtatgacttgagtacggttacattcataggagcctccatcttgagggaattggggtcgccatttggtcccgttgcagaagaggcgatactgatgtcagctcgaagaattggcatccctgtatactggttccccctacttgggtacacggccattggttacgcgtaaaagccgcatggtggcttggtcatactgaaccgtgcctagagggaggggatctgcaagaggattcagggcgtatgagacgccatagggggtaagtcctctcaaagcctaggtgattaggcctatctttgcgtacccttgttcacaatagagtccacgagcataaacactttgactgtgcgagagaagcctttctgtaagaaacaattttgaccgcaaccgttctgacgggttatgagactcgacgagaaatgccatccaggactcctagtggggaccacgtgcgaagttacaagggaggttgggagaacacaaggaaggcttgggaaggaggtccacacgaggcccttaaaacctgttgggatcaaggttggcacaaaagccccaagtgggtttgcca

SEQ ID NO: 598453 - DNA, 664 bp, Homo sapiens
gattccgtcctgcgcggttgttctctggagcacgcgtacttttatctccgtccgccttctctcctacctaagtgcgtgccgccagccgatggaagattcgatggacatggacatgagccccctgaggccccagaactatctttctcggttgtgaactaatagggcctgacaacagattagtcgactttaaggtggcatagactgagtgaacacatgagcaccagattatcgtttgaagaagcggtcagtttagcgggctggtgcacaaggatgagttgcacattgttgaatgcagaggcaatgaattacgacgtgcagtccatacttaaagtaacactggtcgaactttgaagaatcgtcttgtacagaccaacggtttccctctggggcgctttgaaatagcaccaccagtggtcttaaggtctgaagtcgtggttcagggccagtgcgatagttagtaggacagcacttagtagctgtggaggagagatgcagagtcatgaagatgaacgaggaggaggatgtgaaactcttgaagtatcatctggagcgccgggctgcccctggaggtgggtagcgggggtacctagagaaaaatcgtaaagagtatgcgtgcgtgatggaagaatcgatgaccgatgatgatggacgcagggatagatgg

SEQ ID NO: 598454 - DNA, 237 bp, Homo sapiens
  misc_feature (146)..(146): n is a, c, g, or t
cccgagtgagagatcacttcttcgagtttgtggacggggtgaaatcggaagggctcctggaggaagcagcatttgaactgggccttcctgaaagaatagggtagtatttagatatgggagatgttgaggagtgacaggtatattcntgggtagaagaaaccacagaggtgtagcgacaggcaagcctgtgtaaggacaggaaacggggagtggttctatttggcagggacccactcg

SEQ ID NO: 598455 - DNA, 335 bp, Homo sapiens
  misc_feature (187)..(187): n is a, c, g, or t
  misc_feature (202)..(202): n is a, c, g, or t
  misc_feature (215)..(215): n is a, c, g, or t
gacagaattttcctgaaatcagagatatttatactcaatagtatgtattaatttggatttataggtgagaaaatagacaaataattaaccagggagcgtaaaataaaattattccaattaactatttatcatatttatgtggcgtaattactttttaaaaattcttttaattttatctagggataancactcacatcatggntaagttgccaggnacttcaaaactttggaaaagaatttcatccctgagaagtgagagatagaaaaatatcttaaaaaagagaagccacagtcttgcacccttttaacaatctcaacaaatggatgcaccccgg

SEQ ID NO: 598456 - DNA, 678 bp, Homo sapiens
  misc_feature (356)..(356): n is a, c, g, or t
  misc_feature (597)..(597): n is a, c, g, or t
gcgctccctcttagcttaggatactctggagagtcccttctttttattgaaatgtgccactatatgacactgtgccataatgtccttaaaacttctctatggggaaataaaactgtacctattgcaagagtgtgtataatatgtacactcatgacattttcaatccacccggggatgtcacattcaaattactattaatagagggtcttttctgggaaaaaaatgtgcacagcttttgaggggccctatacgagaggcttgctttttatgaggaaatctacttgttgggcatgagttcaaaaagcgggttatagggcaaaaacactagaaaaagctctctcttactcaaaaacagnccaaaaaagggtgggaatcatttataaatacgcacagcctcttaggtaattaactcaaatattgccatggacttctctgtgtccacagtgatgaatggcatagaaattctcgctatattatttgtgaaactgcgggtaagctcccataagaagttttttagacatcacaccaagtggtgtagggactctggggtatatatatgtttatgtatatatacacacactatctatatgcattttntcaagcaaagaaatgtgtatcagatggaactatttattgaatatttgccccaaacattggtgattcattttttagatggtt

SEQ ID NO: 598457 - DNA, 395 bp, Homo sapiens
agggggtgggtctctcattattctactcaccgtgtgcgacacacctgtgcggaagaccaaatcacacatgcgtacacattaacccctgctattgtgtttgagcgcctgactggctcttatggctggccttgtgtttcaacacgacctataacattcatggacaagatgacactggaatatggcggactgatccgaagcatccataacgactcatactctgcccttgagcttgagtaattataacaataagcgggctaaccactggtgacatgagtgtcctttaagtacctccacaatgcgccgatggaaggaacttaaatcaacttccggatcctgttttagggggtcagttggggggggccctgggggtgggccccccctccttcctttttagg

SEQ ID NO: 598458 - DNA, 144 bp, Homo sapiens
cccagctgctcatctaccagtacaattgaagaatatattaataatctttgaagaagaagaagttgaatttagtctattgtgcctgttcccagtagtttgcagactagtgatcctcgccaacattgtttcatgtactttaacaat

SEQ ID NO: 598459 - DNA, 102 bp, Homo sapiens
taatagtcgtacctctctcagtccccaagctcagtgtgagctgagtttatagatgcattcacactgaggccttggggactgaggtgagagggcccagcagtg

SEQ ID NO: 598460 - DNA, 801 bp, Homo sapiens
  misc_feature (11)..(11): n is a, c, g, or t
  misc_feature (99)..(100): n is a, c, g, or t
  misc_feature (105)..(107): n is a, c, g, or t
  misc_feature (110)..(111): n is a, c, g, or t
  misc_feature (116)..(116): n is a, c, g, or t
  misc_feature (121)..(121): n is a, c, g, or t
  misc_feature (124)..(124): n is a, c, g, or t
  misc_feature (137)..(137): n is a, c, g, or t
  misc_feature (140)..(140): n is a, c, g, or t
  misc_feature (168)..(168): n is a, c, g, or t
  misc_feature (182)..(182): n is a, c, g, or t
  misc_feature (199)..(199): n is a, c, g, or t
  misc_feature (229)..(230): n is a, c, g, or t
  misc_feature (232)..(232): n is a, c, g, or t
  misc_feature (261)..(262): n is a, c, g, or t
  misc_feature (274)..(274): n is a, c, g, or t
  misc_feature (314)..(315): n is a, c, g, or t
  misc_feature (322)..(323): n is a, c, g, or t
  misc_feature (332)..(336): n is a, c, g, or t
  misc_feature (343)..(346): n is a, c, g, or t
  misc_feature (352)..(352): n is a, c, g, or t
  misc_feature (355)..(359): n is a, c, g, or t
  misc_feature (368)..(369): n is a, c, g, or t
  misc_feature (371)..(371): n is a, c, g, or t
  misc_feature (375)..(375): n is a, c, g, or t
  misc_feature (390)..(391): n is a, c, g, or t
  misc_feature (393)..(394): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (412)..(412): n is a, c, g, or t
  misc_feature (418)..(418): n is a, c, g, or t
  misc_feature (423)..(423): n is a, c, g, or t
  misc_feature (441)..(441): n is a, c, g, or t
  misc_feature (443)..(444): n is a, c, g, or t
  misc_feature (462)..(463): n is a, c, g, or t
  misc_feature (480)..(480): n is a, c, g, or t
  misc_feature (490)..(490): n is a, c, g, or t
  misc_feature (495)..(495): n is a, c, g, or t
  misc_feature (497)..(497): n is a, c, g, or t
  misc_feature (501)..(502): n is a, c, g, or t
  misc_feature (507)..(507): n is a, c, g, or t
  misc_feature (643)..(643): n is a, c, g, or t
  misc_feature (650)..(650): n is a, c, g, or t
  misc_feature (652)..(652): n is a, c, g, or t
  misc_feature (656)..(656): n is a, c, g, or t
  misc_feature (668)..(668): n is a, c, g, or t
  misc_feature (673)..(673): n is a, c, g, or t
  misc_feature (678)..(679): n is a, c, g, or t
  misc_feature (681)..(683): n is a, c, g, or t
  misc_feature (688)..(689): n is a, c, g, or t
  misc_feature (691)..(691): n is a, c, g, or t
  misc_feature (789)..(789): n is a, c, g, or t
ggggggggaanggcttgggttgtaaactccctcccccagccttcctgtcccttggaggggcagttcagctgggttctggttcagggtcaggcaggcagnnaaggnnnggnnggggngaganggnggggggcgggggnggnagagcgcaggccgccacgcgggcgccangggcagagaaaggnaaaaggaaaaagaaagngaaggggggagggaggaagggcgggggggnncngagggagagggggggagagggcgcagacnnggaaggaaaggngggaaagggggaagggaaagggggggagggaagggaaaanngggaganncgccggggnnnnnaaagaannnnaggaanaannnnnagtaagggnnangggncaggagaagggggtnnannangangangagcagggcnttgganggggnaaagagataaattgaaantnntggggttcttaaggaaanncagattaaagtccaganccagctgganaaagntntggnngcttngcacggtggagatgaggatgacgcttcgttcttggccttggaattcttctactgaacccaccttcaagtccttgatgtcatccagtcctcgaagctccctgtcaagtttggtgatgcagtaacggattttctccanctgtttncngtanggggagatgacncccanacttnnannnctcanncnagctttgcccttcttggaggagggggccaggagcagcttcaggtaggaagtcactgtggcagcctcttcaggggttgaagaaggatgggctgttgccntcacgctcatct

SEQ ID NO: 598461 - DNA, 279 bp, Homo sapiens
cacgagggaaaatggtttcatcatccgctttgggacctgaagtcctctaggcctaattgtgtatgttaatgatcagaaaaggcatctcatacagtcgccaagtgtggagtacagtttcagggtcggaggtaaatggaactacagttacctgggttctggcagtgcacctgctacacacccataacaacataggaataaatttaacgggtattgaaaccagagtgagtttatagtttgggcagatgtgctgtttcaccaagttggacgaggtgggcccag

SEQ ID NO: 598462 - DNA, 188 bp, Homo sapiens
cggttacaaggtggtgcccaggcaggcaggcaggggcatggctgtacagctggtagctgttggtgtggtggctgtgcttctcagtgctggcagggcggttgcagtccctggcctggagccgggacgtggctttggagctggtgactgtgggtgtcgtggccgtggtgctcacatgtggcgttgctcag

SEQ ID NO: 598463 - DNA, 129 bp, Homo sapiens
ggcagatgtacagaactgcaaattcgacatggcgaggatggcaagccaaagctggcaacttctatgtacctccagaacccacattgggcgttttgtcatcagaattcagaggtatcactggagtgagcc

SEQ ID NO: 598464 - DNA, 683 bp, Homo sapiens
ttttctgattaagaaatttttttgagacttaaaggatcctcaaaacattggggattcagcttattcctgcgacaggaaccgttccaaaagcgcttcactctctactattcacatgtgtggggcctgatacagagccctggactgctgacatcctttctctctttgtcaaatacattctcatacacggtcttttcatagttcaaaagaaaaacatacaggtttctttcttggacaaatggcctggcactctcaccctgggatctgattgcttaataaaaaagatcagggcgccaaatcccacctataattcccattacaacagtggttacttatctatgaggggatggatgcttttgtctttctatgaggggaatcattatccccggcttattatactgatcaacaagcccaggacatgtgtgtgggaaggagggtgaatccaaaacataagggtctcagatcagaatgaggctctcatcaacaagccattgcaaaggctttatggtacattgttgcaaaccactccctgcagaggtcaaaagtgcggactttaaactaaaagtgaaatgaaaagactttctgtggaccaagggagaacaaaagattgtgtcctttacaaccgagctggctaataacgtttgttaattgctaaccctgtagattggcgggcaaaaagttggttt

SEQ ID NO: 598465 - DNA, 296 bp, Homo sapiens
ggagagactgcagccaaaaagaatccaaaaacagcttctcctgtagaggggcatgaagtacatattggtctgagcatggtcaagattcccaaaaagatgaaacagcacgaaaccaagcagatgggtccagatgttgccagtttctgtatgaatgcggaagatgctcttgaaagcaagcccgaaaggaaggccatgggaggtctatgaacattgtagcagatagctcgtaggtccctttagccagctcaaggggcagcacatcactatgggcactgaaccctccaaacgctccctcc

SEQ ID NO: 598466 - DNA, 461 bp, Homo sapiens
  misc_feature (181)..(181): n is a, c, g, or t
  misc_feature (211)..(211): n is a, c, g, or t
  misc_feature (244)..(244): n is a, c, g, or t
  misc_feature (294)..(294): n is a, c, g, or t
cgtgcatcatttcagtgacaactccacaggcgccaattaaacatggaaaagacctgttctgaagcatgcccatctggcatttcccaaggaactgtagtcaatggctgataaaacatacatgatcataactataaagaaatttcgcagccctctccttgctcaaaagcaaccggggcctatnaggacaatgaacctggaagacacccaaaanaggaggtgagtaaagaaaagcctgcatttgaanccaccactgctcttcctcatgcacagaaagcaaagatcgggagttgcatnaggtcagattttcagccaccaaaaacaaacaaacaaaaaaaccaaccaaacctcaaaaaaaacccagacgggtctagggaatacttgggagtttgtctggtagtctgtgggtgaacttcaattgttatgtctccgagtgaaataaaggattggcagtagtccaaaaa

SEQ ID NO: 598467 - DNA, 147 bp, Homo sapiens
attagaggatcccgtgtgggtcttgcagagtttgttgttgactaggagcacggaagcagctggtgtgaaacacctgctggttggcaagagagctccattggatagactgtcttctgacattccactgcaggtctctcttggcaggtg

SEQ ID NO: 598468 - DNA, 185 bp, Homo sapiens
gggtaccgatgtcgccggtcacgttgggggacaaacgaagggggatggggggcacgaaggtctcatcattcaaaataaaacaaaataaaagagtgttaaggcgaacgattaaaaaaatattgcattacataatttacacgaaagcaatgctatcacctcccctcccaacggtgaccggcgacttc

SEQ ID NO: 598469 - DNA, 151 bp, Homo sapiens
atcatatagacattaaaatcaattttaaatagcggcagcttcggtgccgtcacatgacaaggggccgcccaggccagtgtggaatcaccaggttgtctggccaccaccaggaccaccggtcctaaggcctcctgctcacacccggggaact

SEQ ID NO: 598470 - DNA, 222 bp, Homo sapiens
atctggtaggataccgaagatattataccgtcgttcagcgacctcattgatacagtgtacttgaatgatcagcatgtgacattctactatgagccgcgggtgtgagagcgtctggggacatggcccaggacacggggatccctgctgacatctggcgcttctatctgctgtacattcggcctgagggccaggacagtgctttctactggaccttttctcgga

SEQ ID NO: 598471 - DNA, 170 bp, Homo sapiens
ttagaggatccctcctcagctgaaaagacatagctcaaaggaagcgaggggagacgtagaaaggattataacgaagcgtatgaggggactgcacgccgtggaaatacctgccctaagctgcgcgcactaccggctcggtagctgtcatggtcggcggggtcacgtgactc

SEQ ID NO: 598472 - DNA, 793 bp, Homo sapiens
  misc_feature (147)..(147): n is a, c, g, or t
  misc_feature (161)..(162): n is a, c, g, or t
  misc_feature (243)..(243): n is a, c, g, or t
  misc_feature (251)..(251): n is a, c, g, or t
  misc_feature (254)..(254): n is a, c, g, or t
  misc_feature (277)..(277): n is a, c, g, or t
  misc_feature (286)..(287): n is a, c, g, or t
  misc_feature (289)..(289): n is a, c, g, or t
  misc_feature (342)..(342): n is a, c, g, or t
  misc_feature (344)..(344): n is a, c, g, or t
  misc_feature (361)..(361): n is a, c, g, or t
  misc_feature (374)..(374): n is a, c, g, or t
  misc_feature (395)..(396): n is a, c, g, or t
  misc_feature (406)..(406): n is a, c, g, or t
  misc_feature (409)..(409): n is a, c, g, or t
  misc_feature (411)..(411): n is a, c, g, or t
  misc_feature (456)..(456): n is a, c, g, or t
  misc_feature (460)..(460): n is a, c, g, or t
  misc_feature (465)..(465): n is a, c, g, or t
  misc_feature (495)..(496): n is a, c, g, or t
  misc_feature (591)..(592): n is a, c, g, or t
  misc_feature (594)..(594): n is a, c, g, or t
  misc_feature (596)..(596): n is a, c, g, or t
  misc_feature (605)..(605): n is a, c, g, or t
  misc_feature (629)..(629): n is a, c, g, or t
  misc_feature (633)..(633): n is a, c, g, or t
  misc_feature (640)..(640): n is a, c, g, or t
  misc_feature (642)..(643): n is a, c, g, or t
  misc_feature (653)..(654): n is a, c, g, or t
  misc_feature (656)..(656): n is a, c, g, or t
  misc_feature (667)..(667): n is a, c, g, or t
  misc_feature (675)..(675): n is a, c, g, or t
gagacaaaaacttattaaggttaaatagaatgtttcttctgaataatctaacaaaggaaaatataagtgattgaatcataagatataaggggggtgaagtattaaaaataactttttgtttgataacttgagaatttagaagatttngccaagtatgtgtnntgcttgattcttaaatatggcattgatgaatttaaagtaggagcatcagttattacttctgattcattaatggccagaatntgtgtggngtnatagttgtgtcaccattcttgtngctttttannantcaggctaatcatgtggtccatgtctcttcaaagcttgacctgcacaaatgcnanatttctattgggaccanatattctccattngcattgagcagtagagtacannggaacgggantangnatactgattattctgaacagtttagtcccaagagaatagcgtttnaaanaaganaaccaagattggagtcatgtgggttatccnngggatggaggatcttaaaaatgctaatgtgagagaatcaattgtgaaaagggtgaaaatttctgaaaataaatggcttaatttacatatacaggnntnanatagttggnagagggtggattatcattaccttnacantactgtntnntcagaagtcnncngacctcaaatngtaatctngactagaatgttgctgacacggaggtggagggatggaagggggttacaattttggacaacaatgtcacttggggttacgacaaataatggaggtcatgccagacggggaagcggagaa

SEQ ID NO: 598473 - DNA, 128 bp, Homo sapiens
atcgcagatgacccagtcaccctgaatgtcctctatggtccagacctcacccagaattataccctatcatatcacctattaccgtaacagagagaagtcctactacttgatcctgttctagcggcact

SEQ ID NO: 598474 - DNA, 780 bp, Homo sapiens
  misc_feature (1)..(1): n is a, c, g, or t
  misc_feature (81)..(81): n is a, c, g, or t
  misc_feature (96)..(96): n is a, c, g, or t
  misc_feature (98)..(99): n is a, c, g, or t
  misc_feature (107)..(107): n is a, c, g, or t
  misc_feature (111)..(111): n is a, c, g, or t
  misc_feature (126)..(126): n is a, c, g, or t
  misc_feature (228)..(229): n is a, c, g, or t
  misc_feature (231)..(231): n is a, c, g, or t
  misc_feature (280)..(280): n is a, c, g, or t
  misc_feature (284)..(285): n is a, c, g, or t
  misc_feature (287)..(287): n is a, c, g, or t
  misc_feature (289)..(290): n is a, c, g, or t
  misc_feature (292)..(293): n is a, c, g, or t
  misc_feature (305)..(305): n is a, c, g, or t
  misc_feature (310)..(310): n is a, c, g, or t
  misc_feature (317)..(317): n is a, c, g, or t
  misc_feature (328)..(328): n is a, c, g, or t
  misc_feature (331)..(331): n is a, c, g, or t
  misc_feature (334)..(334): n is a, c, g, or t
  misc_feature (337)..(337): n is a, c, g, or t
  misc_feature (339)..(339): n is a, c, g, or t
  misc_feature (373)..(373): n is a, c, g, or t
  misc_feature (383)..(383): n is a, c, g, or t
  misc_feature (390)..(390): n is a, c, g, or t
  misc_feature (406)..(406): n is a, c, g, or t
  misc_feature (416)..(416): n is a, c, g, or t
  misc_feature (424)..(424): n is a, c, g, or t
  misc_feature (496)..(496): n is a, c, g, or t
  misc_feature (502)..(502): n is a, c, g, or t
  misc_feature (510)..(510): n is a, c, g, or t
  misc_feature (693)..(693): n is a, c, g, or t
  misc_feature (779)..(779): n is a, c, g, or t
nagtctttcagtatttccgttacacattctgttaacaagaactcatacattggtaaaattcattctaagaaaacttggcanataacgctttggccngnnattggcanttcnttctctacttttccntcccaccatttcttccttttaaactacaggatttatattttaaaatgttttatttcagaacattaagatagcagttacattttttaatatttatattatttnnanatgactctttaagatacagttttaaacccatgggctagggatcatacgnctgnnantnngnngcattatttggnctaanatttttnatcattctganacnggnttngngtaatacattgataaattcatacaatttggaagngtcagttgangttacanggacccaatactagcnctctttcagngaatgcgngcaaatctgttattccattggcaaaatcgtattgctgctctcctgttaatctcacatttaaaaaaggatcangaggcngccaagtnctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattganatgcattcattcatcatgcataggcacaatcacagaaatattgcacaaagtatgtccctgactgaaaatgagaggtacaaaaacgna

SEQ ID NO: 598475 - DNA, 441 bp, Homo sapiens
tcactgctacgacggctcatggaggaatgcacgattgatagtagccatttggaatccagaggatgacttaagtactcccggacgcgtcgaatgagagaggcctgggttctaggctcgatcctaggcccccgagtggctgtggggccagccccccggggatggggaaaacagtggcctccccaaccagagagaccgctgtgtggcaaggggacagtggcctgatgtgagaggcagccagcacgggcacactggaagacaagtttcctccccttactcacagggcgagagcacctgcgaaactcaaaccaagctcaaaaagttccaaactgggactcggaccaagaaaagttcaaagaaaaaaaatgaacgagactatattttgcttggtttctatcccagtgaaatcagaatcacatctgccagatagagatatggacaaca

SEQ ID NO: 598476 - DNA, 463 bp, Homo sapiens
  misc_feature (271)..(271): n is a, c, g, or t
gggcggctgggaccggggtatacgtatcgcgggaaaacgtggagggcctgtgcagaggctctcatcgcctggtcagtgtacagcgggggctcgaggtccggggtgcgtctccggcgaccgatgcgccattctgcgcagtttggggccagaggcaagccggcaccccgtgagattgtctcgcggaaattgtcctgtccgggcaagtgtccgcaggatgtatgtagaggatgatgttgatggcactgtcttgctgatggtttggagcacggcnaacgggcccaatatgccctacgtaattgttgcagcgatatgcatggagcgtagcagtgggaacagctacttctcacgaggccatgactagacacgcgagagttgcggtagcaatctagtgtgctggaggcttctgcttgggatttcccgtagtcatagataggcctcgcaaggctcaggtgaccgtagtgga

SEQ ID NO: 598477 - DNA, 1294 bp, Homo sapiens
gcgtgtcttgtgatcgttgcacaccttgaggtcgtgggtcgttctgtgcgactgtcgacgtcggtggtttccacacccgcttgttgtggtgacactcgttgtgctcccttcgacgtttttctcgcggattttatgtgtttcgtccggtacctcgcctcttgggtttgttggtcgagagcttttttctgggggggaaacattggggagtttttccgattgttccaagaacttgttgcttttcttcaaggagtgttttctgtcttgttggtgctaaccatgttctcttgggtgagcctgtgctggttagttgtggttcccgctctctcatgttgggagatacatcctttggtgttttcttcttgggtgtaacagggggtgtgtttatgtccccttgtgtacctcctttctcgcaggggtcctccgaattgttagtgcgctccgggccttagttgcgccccgctggttattttagtggagttttgccaccacccaccggggcttctacaccacgttcgccatagccaacaggtttttgctctcgacgctcttgaaatggggaaatagagttttgtatttccccccgctttttcgtggggtttagaaaaagcgttgtggagaaggattggggccccctcagaaattttctctctggagagaagtcactcgtggtgggaattgtgcctgtccccacatgtggtttgagataattggggttttcactcggggccaagggccccctgttggtggtctgagggaggcttttctccccgagtctattgcccccccctctttggtgttcgccttttggctgttttcgctggaatattgaggaccacgaccacctttccgcgttgggtgttcacttccaagcacggtggacccaagaaaggctcgctggaggcatggacaaggtcaccccagggtttgcccacgagaagctcacggaaggctaaatgaaatatttaatccctaaatatcctcgccaccgcccacactcttaaatcacgtggtggaaagaacggtttcacgaactcgttttgtttcacaattggccacatttaaggtttatgtagtataaagaactggttatatgataacccaatgcactcgtttaaccttcacgaaggaaaggagaaatgttttgtggaccacctttggttttcttttttgcgtgtggcacgttttatagttatttatgttcttttaaaatcacgtactttttataatggagaacacacttgagcccaaaatttgtcacagaattttgagaccccatttaaaaagtttaatgaga

SEQ ID NO: 598478 - DNA, 796 bp, Homo sapiens
  misc_feature (1)..(1): n is a, c, g, or t
  misc_feature (81)..(81): n is a, c, g, or t
  misc_feature (96)..(96): n is a, c, g, or t
  misc_feature (98)..(99): n is a, c, g, or t
  misc_feature (107)..(107): n is a, c, g, or t
  misc_feature (111)..(111): n is a, c, g, or t
  misc_feature (126)..(126): n is a, c, g, or t
  misc_feature (137)..(137): n is a, c, g, or t
  misc_feature (146)..(147): n is a, c, g, or t
  misc_feature (155)..(155): n is a, c, g, or t
  misc_feature (163)..(163): n is a, c, g, or t
  misc_feature (169)..(171): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (208)..(208): n is a, c, g, or t
  misc_feature (218)..(220): n is a, c, g, or t
  misc_feature (240)..(240): n is a, c, g, or t
  misc_feature (257)..(257): n is a, c, g, or t
  misc_feature (264)..(264): n is a, c, g, or t
  misc_feature (271)..(271): n is a, c, g, or t
  misc_feature (273)..(273): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (298)..(298): n is a, c, g, or t
  misc_feature (300)..(300): n is a, c, g, or t
  misc_feature (306)..(306): n is a, c, g, or t
  misc_feature (340)..(340): n is a, c, g, or t
  misc_feature (342)..(343): n is a, c, g, or t
  misc_feature (346)..(346): n is a, c, g, or t
  misc_feature (353)..(353): n is a, c, g, or t
  misc_feature (356)..(356): n is a, c, g, or t
  misc_feature (368)..(368): n is a, c, g, or t
  misc_feature (370)..(371): n is a, c, g, or t
  misc_feature (389)..(389): n is a, c, g, or t
  misc_feature (399)..(399): n is a, c, g, or t
  misc_feature (406)..(406): n is a, c, g, or t
  misc_feature (422)..(422): n is a, c, g, or t
  misc_feature (432)..(432): n is a, c, g, or t
  misc_feature (440)..(440): n is a, c, g, or t
  misc_feature (512)..(512): n is a, c, g, or t
  misc_feature (518)..(518): n is a, c, g, or t
  misc_feature (526)..(526): n is a, c, g, or t
  misc_feature (709)..(709): n is a, c, g, or t
  misc_feature (795)..(795): n is a, c, g, or t
nagtctttcagtatttccgttacacattctgttaacaagaactcatacattggtaaaattcattctaagaaaacttggcanataacgctttggccngnnattggcanttcnttctctacttttccntcccccccctnccccctttnncccccccngcctcccntttccnnncgcccttattncngnacatccagacagccgctccacntctctctccnnncacccccccctattctcccntgcccccccaagacacnccccccnccccccngncccncnancncacgccccgtcaatnanccgccntaccccggcccacccacctcttttaccctctccnannccngattcgncgncccacctccganannctcccccactttggaagngtcagttgangttacanggacccaatactagcnctctttcagngaatgcgngcaaatctgttattccattggcaaaatcgtattgctgctctcctgttaatctcacatttaaaaaaggatcangaggcngccaagtnctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattganatgcattcattcatcatgcataggcacaatcacagaaatattgcacaaagtatgtccctgactgaaaatgagaggtacaaaaacgna

SEQ ID NO: 598479 - DNA, 317 bp, Homo sapiens
  misc_feature (28)..(28): n is a, c, g, or t
  misc_feature (33)..(33): n is a, c, g, or t
  misc_feature (52)..(52): n is a, c, g, or t
  misc_feature (57)..(57): n is a, c, g, or t
  misc_feature (71)..(71): n is a, c, g, or t
  misc_feature (107)..(107): n is a, c, g, or t
  misc_feature (112)..(112): n is a, c, g, or t
  misc_feature (123)..(123): n is a, c, g, or t
  misc_feature (128)..(128): n is a, c, g, or t
  misc_feature (161)..(161): n is a, c, g, or t
  misc_feature (178)..(178): n is a, c, g, or t
  misc_feature (203)..(203): n is a, c, g, or t
  misc_feature (225)..(225): n is a, c, g, or t
  misc_feature (261)..(261): n is a, c, g, or t
  misc_feature (287)..(287): n is a, c, g, or t
gtgaggtttgttcggctatgtccaagtngtcgnttactaatgtacccctgcngtttngctttcggtaatgntgatgttgatgtgtctccccctacccacaaccatgngcctngtcgcggtagnagggnagcagcataccaaagagatgtgctgcaggactncggaggcggcctgggtnggtgagccatcgggcagttgacctnggtcttgaaagagtcgggagtnacaagctcagagagcatgaactgatgctggcatganggattccaggaagatcatggagaccnggctggtagctgtaacagagatggtggagt

SEQ ID NO: 598480 - DNA, 162 bp, Homo sapiens
gtatgtatctctcagaaatagtaattttaacctctaataatttgacatgggtttttcccctgttatatctttcatatcttattatcatggtttactttaacctatttatgctttcatatttaaagtgggtgtttacgtgggcaacatacacgttgggccttc

SEQ ID NO: 598481 - DNA, 910 bp, Homo sapiens
gcagctggtgcagacatggccccgtcctgggtgcccgcatgggcttcacggctggcgcccatgcctggggtgcttcgtgggctcccgttttgtccacggactatgggtctccgctggtacgccggtctgcataaggccctcgtggcacccggcccactgggtgctgggccctgtctggggcacgctctactcagccatgggtgtatccggttcctacctggtctgtgaaagatggctgggaggcttcacagataatgctgtggttcccctgggtcctctacactggtgcagctggtcctgaactggggcatggccccccatcttctttggtgcccgacaaatgggtttgcgccttggtggtatctcctgctggtcagtggggcttggcggcttgacactaccgtggcctggtaccgatggtgagcctcgctggccgcccgcctgctctacccctacctgggcctggctggccttcgtgaccactgtcaactacgtgctgttatggcgggacaaagcatggctggcgtgcgggacggcggctgccagagtgagtgcccggccacagggactgcatctgcaccatcagttgccatcacgcttgtgaatgtggtggctgtccgctttcatgaccactggtgcctgctagtctgtcagggcttggccagggttgtcgcatgagctcctaggtggcccactgaagccccacctggagcaatgtctgtgcttcctgatgttaaacctgttcttgacatggattaaagctgataagtttggtcgttaagaaaaaaaaggggcgcaaaagatccagggccggtacgcccgtttacaaggccagaaggtaaaggcagccgtaaccgaagaaagaacgctgagagctcgggaaagacaaacgaaaatgcatgggtacaaa

SEQ ID NO: 598482 - DNA, 448 bp, Homo sapiens
agtttaaatgggtagtttttgttaacaatgagatttatggtaagtgtatgaggaactaaaatctcaacagctgaggacagttatacaggtgctgcatgcctacgtgactgacccctaataaaacctctgaagaccaaggcaagattgagcttcctgactggaaatacatcacatgtattgccacacatcattgctgggataataaagcacatccataggactccactgtgggaggacacctagaagcccatgcttcatgtcttctagactttatcccatgtacctttacaatttgctaattttaatgtgtatcttttcattgtaaaagaccctaaacatggagatagtaggtttttctgagtctagagaatcttcattctctagaatgaagtggtagtggtcatgaggagtctctacccataaataaaacatatttttaatgaaaaaa

SEQ ID NO: 598483 - DNA, 226 bp, Homo sapiens
atgaccggcgcaatatactatagttccgccggggggatgatgagagaattataacctagcatcatatagcaaggactaaccccatataccttctgcattcatgaatgtaatctagaattaactttgcaaggagagccaaagctaatacccccgaaaccagacgagctacctaagaactgcttagagagcacacccgtctatgttgcacaatactgggaagatttat

SEQ ID NO: 598484 - DNA, 842 bp, Homo sapiens
ctgtttaaaaggagaaaagtgaggccagggcatgctgtgaaaagatggtcacttatcagtgctcattatttaccaatggggcaacctccacaagggcaaagggccctcaccaatccagttacccattttagcttgaaatgtaattgtcagttctcagactgattctgattaacagaacctgcttcctcctgggaacaaagatttcccttggttttgcttattagctccttttctccccattagaaatagcacctctaattagagtgctggttccacagggaatctcaggccctctagcaagactgggtttttctgccaatgtatgaccttccttgagtggttaggtacggaacagaggagttgtgcagccagccccaaacctggcaacagcagcctcttcctgtccctctacagtgctcttgtgctgcctgagatgccagtgccaacaatggctactcctgggctccctggaagcatggcccattagcttgagagcaagccaggagctattaacatacaatatggatgtaaagttgagcacgtatctcaataattttaccagacatatttgacatggctgtttggagcctggtcagcatgtagatcacttggctgatggcgctgtttgggaagctgagaaagtccagctccatgtaaaatacctgtggtaagagaagtaagggagttttactacttgttttctggaaaacagtttcatgctgcaatgatgtcatctgttcagagccatccataaaatgttacagatccaaaatgatgtcacatctttggaagcaagcgtatagataatcattaaacattacaatgctcttaaagaaaaaaaa

SEQ ID NO: 598485 - DNA, 313 bp, Homo sapiens
tactgtgtctcccatttaaaggagaagatctgatgactcaaaatgacttgatgtcaaaccagctaatatcatgatacctgacagaagagagagacacaatgtattatgaaacttgtcagatttcaagtcatcaatatacaaaattagcgtatggttcccaattttgcatacgtaccagaaacacatacacaacttttacattccagcacataatcctggagcacccacaacatcctaggtttagaggcttaacagatgctgacccagccacacttgggccccttaccctgaggagctaactgtctgtatcggt

SEQ ID NO: 598486 - DNA, 276 bp, Homo sapiens
ggggttttaaaaggggggggtttttcaaaggcagaacttccctttgggggggggctccgaatccatgaatttttagggtttttctgcccccaaacctttggggtcccggggggtcccccccccaaaatcctttttggcccggcttccccaggggcccctagggggttcccttggttttccaccccccccccctttgggggccctttttccccccgggggccccttttccattccccccccataaagggggttggggtgggtttttttttaggttga

SEQ ID NO: 598487 - DNA, 913 bp, Homo sapiens
ggcggatgacgccggtgcagcgtggggggcccgggggcccctgtgtggccctgggatggggaaccgcggtggcttcctgcggaggtttcggcagtggcatccggggccggggtcgctggcctgtggacggggccggggccgaagccgcggagctcgcggaggcaaggccgacggataaggagtggatgcccgtcaccaagttgggcccgcttggtcaaaggacattgagagagtcaatgtccccttggacggaagatctagtctctttactcccctgcccattacacggaatcgagagatcaattgaatttcttccttggggagaccatctcttcaaaggggacttgacggtcatcgcacagcgatttattgcccagttgccaggaaagaccaggaccccggtgacacgggacccaagcggccaacacagggattccaaggggcaatagcgggtcaggacataatccagggagggaacctttaaccaaaattgggacccaacgaatacggagatccttgggaaatttgattcacacagttggacttccccaaaaaggtgaaactgtggattgagtgcacaaagacccgggcccaaatatccacgttatggatagacgtacacccaatttcaacattctcatttggggcccacaaataggtgacatatcggttatccaaaaatttcacggaattcccacaccacacagaaataagagacggaccagaacacaaacagtagcacactattaacaaccgtatagtgctacataggtatataactcccctaaacagggaaattattccagtagagcccaataatgctgcacaaccacaaaacacaaaatcccagtgtggcattaccccccagaattttaggccacacaacagcaggggcgtttggtaaacaccatat

SEQ ID NO: 598488 - DNA, 378 bp, Homo sapiens
gatctaaggatcccccggtcgcacagcttctcaaggatggaaacagccccattgggtactcttacgcatttgatagagcccttgcccagccttcatggaaccttccatcgacaagggcacaggagctgattttgactatcacgcagcgtccttaatgagccagcctgccatttccacagtgaggggtggttctcatggtggctgtcgactccccgcaggagatcatcatgaactccaacattgacgagaagttctctgcgcactacgacgcggtggaggcggagctcaagtccagcaccgtgggtctcgtgaccctgaatgacatggaggccatgcaggaggctctggtgaaggagcgggagaagcagctggcctata

SEQ ID NO: 598489 - DNA, 316 bp, Homo sapiens
  misc_feature (16)..(16): n is a, c, g, or t
tctgctccctcttcangctcacatgcacaggaatgctacatgatggcagctgcttccctccttggttatcatccatgcagtgctaattagaaagggttggaaggaataactttaagtaaatcatggggatattattgatttattttcactttttgcgatttttgtgggggtgggaagtgggcgagcaggaatttgcactccagacattgacatttccaattcatcctcttgctatatgaaaaagggttcctttcctctatgggggaacatgtgttgtgctcagttctagtcagcctgcaagcttctttgtattaat

SEQ ID NO: 598490 - DNA, 102 bp, Homo sapiens
cagtacggatgtggatacggcagctaagcgcctcaggggtgcgggtcaatgggtgctagagagcccgcgggacccagtctgctggggacggggggtccttgg

SEQ ID NO: 598491 - DNA, 204 bp, Homo sapiens
taataaattgtatgcttttcatctgctttccattataagctgcctcagcgtgaagcatctgagacacgtgagtgaaaggctattatgaccttaactctcctggagctccaaaaccaccacccacagaggaaatggaggaccacagatagcattttgtctgtgtagccctgagcaggggagagagttgcagagaagcagccttca

SEQ ID NO: 598492 - DNA, 327 bp, Homo sapiens
accggatagagcggtctagagcgtctctttgttcactgattccccctattctccgggtacacactcaaccaagcatgagcaaaaattcactttgtaattatattcgtaggagtaaatataatattcattcccgtagcactattcgtcacatgatcaattatagaattctccatatgatacatacactcagaccccttcatcaaccgattctttaaatacctactactattcttaatcactataataatcctcgtaaccgccaacaacctcttccaactctttatcggatgagaaggcgtaggaatcatatcagcagcaggaggagga

SEQ ID NO: 598493 - DNA, 963 bp, Homo sapiens
  misc_feature (606)..(606): n is a, c, g, or t
caatatgctaggcttttgtgttccccaagacactcgaatgtccccgttcccccaggaccctctcccaaaaggttgctgtatctataacacaaacttttcttaagcacaaaacaatgcgggaaatcctcggcaaactcatgatctctctcctacattgttacaacaacgcagggatgttctaactctgatcaaacaaagcaatcgtgttgttctatttaacacgccccaaaaaagtaccttctgcttccatggtatttcaaaataaccccgatcttaccgaccactacataaggtattatcttgtacgcaaacaaacaccgacctttatgcgtgccgcctgctccctccagaagtgaacaactctcttcgcgggacggcgtgctccataaaagggtttacaactttgctgcgggaactgcacctgcttgtcgtgagcccagaacaccgtcgtcctctgcctcaagtacacgtgcgcagtccccctcggagacgcacccctatgatccccaagaggccattttctgtgtgggcgcccttatataatacgccccacagcgaatgtgagcgagtgcgtgaatctcagagattctccggcgagaggatccnttgccctggtttatgaaactgatgtgaggaggctaacaaatattctattgcagcgagaatcactgagctgtgtgagtagaagagcgcttttacaaaaacacacatgtgagtgagaaaaccacccccaacaattattctacacacagtgtttacggcacgccatacatttccatcataggggtgaacctttctacagccccatggtgcttgatagttctagcgcctcctggtgaccttggcaatcatggtgttggtgccaccagaaacaatggtatatctcccttctcttatctgtaaaaacacagaattggcgtgtcgtaagaaagcctttggaaaaaaagcttccacaacaggaca

SEQ ID NO: 598494 - DNA, 310 bp, Homo sapiens
  misc_feature (243)..(243): n is a, c, g, or t
  misc_feature (279)..(279): n is a, c, g, or t
  misc_feature (298)..(298): n is a, c, g, or t
tcctcacagacaaaggaactgctgtgttacagttcctcacaagcctctttaagccttttgtggaatcatatcagttactttgcagataccttttgcatgaagaggactacttcggtgagaaggaatacttggttgcagccaggaagttcacccgtcagcttctggatcaaggctcctctcagtgttacgatgcgctgtcttctgaactgcagaaaaatgccttaagcagctttccgtgagacntgggggtggtggaaaagaagaaggtagaatagtaantatgtgtattatgtgaacnggccttgccaca

SEQ ID NO: 598495 - DNA, 83 bp, Homo sapiens
tgaaaaaaaactttaagcattaagattttggccccctcacccctatgttgttcatagagtgtaaatgagaaataaacttttat

SEQ ID NO: 598496 - DNA, 411 bp, Homo sapiens
  misc_feature (256)..(256): n is a, c, g, or t
  misc_feature (391)..(391): n is a, c, g, or t
  misc_feature (397)..(397): n is a, c, g, or t
tgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattatagggcgtaacacncatgcctgggccaaaaattaaaagattttatgaaacgaaatgggcttcccattctttctatttcagcttctaagtggggctatttcatttgtgctctcctctttttttgttttgttttggcaattttgttcaatncatttngggggaaatagggc

SEQ ID NO: 598497 - DNA, 103 bp, Homo sapiens
gggaggcagaggttgcagtgagccaagatcgtgccactgcactccagcttgggtgagaccctatctctaaataaataagtaagtaactaagggtaccgagctc

SEQ ID NO: 598498 - DNA, 106 bp, Homo sapiens
agtcgtgcaggaaatagctggtgactgcaactctggtatgggggtgctgctgttgctctggcggcgtggagtaatcaacgtcggtgatatcacgtttatgttaacg

SEQ ID NO: 598499 - DNA, 1081 bp, Homo sapiens
cctgtctcaaaaaaaaaaaaaaaaattttttatagtatttccacagagtggtgcaacccatcaatttaaagaaacatttccatcacaaattttggtggcctgtaatagttgtcctaaaaagctggtttactaaacaggaagtaccacaagctgggcgtggggataaaagacaacagaactgtaattcctgggccgggtgcagtgggatcaacgcttgtaatccacaacactttacaggaggccagagtgtgagcacaggatcacagaagttcaccggaagattcaaagaccaactcctgggaccaaacatattggttgaacgccccttttcctaaattagaagaattcaccaaaacattacgccacggggatattgggccgccacgcgttatataggtccgacaaataacatcaaggaggtatttatagggcacagtaaagaaaaatacgttctgacaaaaccctgagaaaaagggtgtagaagcgttgtgaacaagtgtgatagaccaacagagaattcggttgcaccaatgtagggaaacttcattaggcctggggggggtgaacatgagagcgtgaagtgaatttcagaatttctcaaaagagaaaattgagaaagaaaaacaaagaagagtggtaaatacccaccaatgtaaaccgactaacagagacaagcgccaaaaaaaaaagaacaccaaaaaaaggaggcaagaacgaaatggaacacataccacagatctgtcacacactaaaaagacaaacgacggcgaaaggaggaccacaccaaagaacgcaaaaagaacaacaaggacacaaatacgaaggaaacatgaagaaccaatgctaaggaaaacaaagggacatcacacacaacagccaaggcaaaaaaaagcgtacacacgagatagaaccaaacatgaaaagagatagacaccgggcaacaaaacagcgactggccaccaaagtggtcgtcacaaattacatggaccggaaagaggccacccccaaggtaagacagccagaacgagggaaaaagacaatgcacacgaacaagaagcatagacaacccctaaggaagaac

SEQ ID NO: 598500 - DNA, 1380 bp, Homo sapiens
  misc_feature (369)..(369): n is a, c, g, or t
  misc_feature (1122)..(1122): n is a, c, g, or t
gcgaagagcttgatccctgaaccaacatcaaggtaaccttgcggagatcgtaaagaccggtgactgaactgactctactgggaatgtgcggtggtcaggagaccaccttaagggccactcgatggcgcagcgattactaatacccagactggcgcacgagtggcgctcggtactatgtcgtgggatgagacctcgtgctggacctcgtcgattagaggactcgagaaggaagctccatgacctgaggcggcatcgatgagatcatcgtagcgattagtcaaaagcatagtcgaggggccaatctctccggaagctgtatcagactgtgcggtagacgcacggacaagggcaagtctcggaaggaacacntcacatggggtccactgtcttcagccagacattggccagaagagattctgctgttgagaccagactgagaggtgcagactctgagaggcatcgactccaaagcgtcacaatagagtcggaattatggaaatgcccataaccagtgatgccatagtcggtcagggcagcaagtggaccctgacatacggagcaggagcgtatggacggatagagctgtacactgtgactcactggactcacttcgaacacacgcacacgatacacataggagtctcgccgcgcaaagaccacgagaggacccgataaaaacggagtgcagaataagtcggaatagccttactatattgattccctgggtagatcgagacggctacaaggtatgcacgaacatgggctgccatagaactactcagagcttgaaagatcaaaggcgagcgtgtgtcgctatctaagacgcgtggggatataaagcccactaggtctatggctcgcggggcgcagtgacagttcctcatggtggaaacagcgcatttgtgggggccccgctaaagattggcccattggtcagagcacctagcaccgccaattccatctttgcttgggcccgctgcgtggagacaagggggtcgcacgctgggaaatcgtcgggatggttctggcttttgcatgattttcggggtgctgcgtgtacttcaacgcctgaggccgcccatgaaggatgcctcccctttcgaggaaattcttcacctcganaaggtgggggggagagggactcaaacgttcggggagcacatacgggaggaacgtggcgatcgcaagggaaggccacgacgcgggggacgcgtgggagaatacccggcgtcctgggacatggtccatgggtgggagagcataggaagagcttctaccgtaggccggtgggaaacacacagtggcgtcagatcaggacagaacagggattcgcccggccggggcttcaccggagacggggggatgacagcgaacacacat

SEQ ID NO: 598501 - DNA, 262 bp, Homo sapiens
ttgcgagatgagccatcggtccagcagcgacattgtccagatttgagtgtccctgataaatgatgcccttgctgtgtacaaactgcagaaacatgaatgatgagaaataatttgtggctataaaaccaataatcgggatgggtgcagtggctcatgcctgtaatcccagcactttgggaggccgaggcgggcagatcacttgagatcaggagttcgagaccagcctggccaacatggtgaaaccccatctctactaaaaata

SEQ ID NO: 598502 - DNA, 126 bp, Homo sapiens
gctttggggctcaagctgatggcatttgtgggggtcagggagcctccttaggggcacatacctgcctatagtgcaacttttatgcacctagtgttcttccttggtgcaaaatccttcatttcctcc

SEQ ID NO: 598503 - DNA, 1180 bp, Homo sapiens
tgatgaagaggactgtgagccccccacagaccacagcagccagctgcgaagacaagaaggagtttctgtgcgctggaatccaggcagcatgcctctcctcctccctgcgcatggaactatgttcgatgactgctgtgggacggagttctgacagaggaagtgactgctagcatcagcacccaatgctgacacagtctgcgtccagcaatgccagcatctgtggggacgaaggtactgctgcgtgcggcgaccggagaaagcaggctactgtgcctgccgctcgtggcttgcaaaccgggccctggcagcccggatgccaatgacatcaacgagatgcctgatgctttcggacaactgctacccagctctgcgaactagcgaccaaggggcggacgacctctgcagactggcgacgtacggtaactctcatgatgacggcgacaacgacctgccactggcgctgaaggctctgtagtaacaggtcctgatacatcgcctgatgagaatgatgattgcgcacagctgtataccaccgtgacatcccccatatcggagtctacagtagcagggcagttccacgggtgaccgagacgtgttcaggcattgactcgctagttggagtgtccattgatcaaaggcttggggcggtgtctatcttggaaccaacattggcatcactgggacgaccatccgtcactaaccgcatgcactgacaaaccatgagttcgcgccttcgataccgagttacacaaagcgcaaccggggagaaaaggatttggaccacgagggtggtgaggtgaagttcaaggatttaaagggcttgaagattgccgcagagggattagagcaacggaattgggtatgacggaaaagtgatattggaccgagtcggggacgagatgagatagaagatggggcaaattaagggcaaaaggcggagaagacaaattcaggggatgtatgaggagacaagacatggggtggcacaaagagggcgaacaacaggacgcagggatcacacaaaggagaagacaagaaaggcaaaaaagaacaaggaagaaaaaagaggaacagacaagaaaagaaagagggaaaaagagaagaaacgaagaacaacagaaaaaaaaaacaagaagaaagaaaaaaagaagaaaaagagaacgaagacgaccatgaaaaa

SEQ ID NO: 598504 - DNA, 300 bp, Homo sapiens
cgtgaggagcagctgccagcttcgctggagatgagcagggaaccaggaataaaaattctgcttgatttgaagacgcggctggagcaggagattggcaactaacggcggctgctggagggagaggatggccacctgactcagtacaagaaagaagcggtgacgcaccgtcaggtgcgtaccattgtggaagaggtccaggatgtggaggtcatctcctcccgcgagcagggtcaccagaaccaccggtgaggactcagctatcccgggcgggcaaccaggagggcgggaggggggcgggcc

SEQ ID NO: 598505 - DNA, 175 bp, Homo sapiens
cccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcatgccagccccttccgcatccccgaggacga

SEQ ID NO: 598506 - DNA, 152 bp, Homo sapiens
  misc_feature (74)..(74): n is a, c, g, or t
tcctcatgaaagttggacaagatgcaagttctgctggatcaaccaggactaaagatccaacaagacgtgcaganctagaagctcgtacaagtgggaagaagttcgacaacaagcccctttgtaaaaccaaatccaggttttagcacagacgg

SEQ ID NO: 598507 - DNA, 307 bp, Homo sapiens
  misc_feature (23)..(23): n is a, c, g, or t
  misc_feature (104)..(104): n is a, c, g, or t
agcatgtttggggccccctgggntgccatccatttaaccccaaatttttttgggaaactcgccccccctgggaaccaaagttttgggtttaacctttagcaagntatgccctagttccaaaaaagcccctaacaggctgccctgtgtaaatgtaggttttttaaagatcccagggtgggtcatttgatccctggatggatagctcagcctggggcctttagtgttttccctggtgataaatcccccaggcagctggatttggagctgggggccagtttaaattatttaaaatttatttgtgtgggga

SEQ ID NO: 598508 - DNA, 162 bp, Homo sapiens
aaaaaaaaaggaaaaggaaaaggaaaagaaaggttcctgggtgccccccccctggggtgggtgggggttagggggggttggataagtaaagccgtttgcaggggacttgggttagtccacccctggcggcccctccaggggcagagggggaatgggtttcca

SEQ ID NO: 598509 - DNA, 321 bp, Homo sapiens
accgctgtaatctcacatcatagacacacacatcttctgctatacatcctcactcatgcgcatatacacacagcgtgctgggtacctgtctacacatgcacataccgagttcctgcattgcttacatactacacgacacacacatatgttcactcgttacatgctacacatatagggtctgcagaataaattagcgtgtgtgtacacagtgtgcacacagcgacactataagctcatttatacagtgcttattcacacagtgcctacacacaccagacctacatgttagcacatacacactcatgcctacctgcaatcatg

SEQ ID NO: 598510 - DNA, 314 bp, Homo sapiens
  misc_feature (246)..(246): n is a, c, g, or t
  misc_feature (275)..(275): n is a, c, g, or t
  misc_feature (297)..(297): n is a, c, g, or t
atagcaatcttcccaaatgacacttgatgaagtaggtgaatagggttggagtcaggacagatacttccagtcactggcagtgattcagtaaacatttcaggttcatagaggagtaaagggaattattgattagatctatatccaaataataggtgaaagtgtaattacttaggctaatacaggagaaaaataggaataataaaacataatcctgaaggaatataagggagagactagggtgcattnggctcacgcttttaatccccgcctttttngggaggctgaggttgggtgggntttttttttttgggccc

SEQ ID NO: 598511 - DNA, 116 bp, Homo sapiens
ctcctcccctgtctgcctgcgtggactggagagaaagcaaacagccagatttggggcactcccatgaaatgcaaatgtctaacacaggctattctctcatcatacttcacgtttac

SEQ ID NO: 598512 - DNA, 81 bp, Homo sapiens
ctcctcagtgactctggcttctatctctgtgcctggagtacacggccgactagcaagtggtacacagatacgcagtatttt

SEQ ID NO: 598513 - DNA, 238 bp, Homo sapiens
agcgagtgagcacaatgcaaactgccacttttaaaccatcaaatctcgtgagaactcactgattattacaagatctgcatggggcaacccttacccataatccagaaacctcctacaggtccctccttcaacatgtgtggattacaatttgagatgagatttgggtggggacacagagccaatccatgtcattgctatttcaaccacagaaattgaaaccatttttacgtggattagg

SEQ ID NO: 598514 - DNA, 469 bp, Homo sapiens
ggctgctccggcctccggggccttggggagactcgagcccttcagcgtcagactgacgccgccgagtcgtcagctcgtgtactgcgtggccggctctcgactggctggtccactctcgtgtcaggggcagctagtgtctggcgcaaagcgatctccgttcgacgctacacaggctaggtcgctcgccgagcgggacggcgatcgtggcggggtcattggacgcgtgggctggagcgctccaggttggcactgaggggcactagcccaccgaacttctaagagtgcccgtggacagatgtcaccggcgagggaaggaccgagactggctgtgtgtggaggtgtggccagccagttgtggggtgagcaggcgagccatgatcaagggaacctcatttagacgtgattgtgtacttggctgacgtgaacaagggcatccgagcttaaagcacgagcgccattaacaggtgaa

SEQ ID NO: 598515 - DNA, 883 bp, Homo sapiens
cttggtgatttccctaccgaggacctgggatcgagaccccgaagatattttccggggcctcccccctgtttgtttccccgggaccctcagagtgatccctcccctagccttcaggaaccaagggggttccctggagccgtacttgtgttatcaagacgggtgcccccccccggattccaaggggaccctgaccagcctcgtatttccccccacgggggttcccgccagcactccaccttgttgttagtcccgcctggcctcgacaacaccagtttcgagccacattccgggattatctgggtgcaccaatatcggatcccaattttagaaccccgggcccccccacccccggtagaaagatacttgtctgcagctagagaccttctgaggaaggtggctgccctgacaaccccccggatgttgtgcagccctcggccccccttacggctcgtcgcgctgggcccccccagggccttcctgtaagactgccctcccgaaggagccccccgccccccagaccctggcccctggcatccaggaagagctcttcccagccccctggctgctgctgagtccagcccacctagcgctggcgcccaagcagcctccctgggctgggctggctctgtgatggagccccggcatcggccagggctctcgggaggctgtctgcccctccagacatcctgcctccagccctgagtggaaggcacccctgaggaccgcgcggatcgggacctggacctggggctggcctcaggcccccgtgcacgtgctgctccctttttggaagacccgctttaaccctagagccccttgagagacttcctttgcccccccggaaggaaatccaattaaccccccctgactacctttgccttta

SEQ ID NO: 598516 - DNA, 962 bp, Homo sapiens
  misc_feature (15)..(15): n is a, c, g, or t
ccccttcctctcccncagaatttgtgttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctgtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccacctttttttactcccaaaaaagaatgaacacccctgactctggagtggtgtatactgccacatcagtgtttgagtcagtccccagaggagaggggaaccctcctccattttttttgcaacatctcatttcttccttttgctgttgcttcccccctcacacacttggttttgttctatcctacatttgagatttctattttatgttgaacttgctgctttttttcatattgaaaagatgacatcgcccccagagcccaaaataaatggggattgga

SEQ ID NO: 598517 - DNA, 997 bp, Homo sapiens
  misc_feature (15)..(15): n is a, c, g, or t
ccccttcctctcccncagaatttgtgttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctgtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccacctttttttactcccaaaaaagaatgaacacccctgactctggagtggtgtatactgccacatcagtgtttgagtcagtccccagaggagaggggaaccctcctccattttttttgcaacatctcatttcttccttttgctgttgcttcccccctcacacacttggttttgttctatcctacatttgagatttctattttatgttgaacttgctgctttttttcatattgaaaagatgacatcgcccccagagcccaaaataaatggggattggaaaaagataaaaagtaaagggcacgccgctcgcgat

SEQ ID NO: 598518 - DNA, 253 bp, Homo sapiens
gtagactctacaggatccccccagttctgcttcttgaaaccagttcctgctcccaattcctggatcggagtcagtagcaactccagagcacatttcagagcaaggacattaattaatagggaaactaatacacgtcatttcattcaatgtatatttatggagttcctaccagatgccatgtgtcattcaaagagcagaaggaggccgggcacggtggctcacacctagttaatcccagtcactttgggtaggc

SEQ ID NO: 598519 - DNA, 244 bp, Homo sapiens
acgcttggctagcacagttggtcctgcccataataccagcactttgggagtgctgatgtgggaggatcacttgagcccatgaggtggaagctgcagtgagccaagatcatgccactgcactccagcctgggcaacagagtgagaccctgtctaacaaaaaaaggaaaacaaacaaataaaacacccacaaaacaacaacaacaaaaagcagacatagcaaactgatctctagtgacagaattgg

SEQ ID NO: 598520 - DNA, 86 bp, Homo sapiens
gcggccgcctactactactactgctcgaattcaagcttctaacgatgtacggggacatggactaagaacgatgctggctttcaagc

SEQ ID NO: 598521 - DNA, 316 bp, Homo sapiens
gctccacccttactaccagacaaccttagccaaccattacccaataagtatagcgatagaattgaacctgcgcaatagatataggtaccgcaggaaagatgaaaatataccaggcataatatagcaagggactacccctataccttctgcataatgattactagaaatactttgcaaggagagccaaagctaagaccccgaaccagaggagctacctagacagctaaagagcacaccgtctatgtgcaaatagtgggagttataggtagaggcgacaaacctaccgagcctggtgatactggttgtcaagatagat

SEQ ID NO: 598522 - DNA, 237 bp, Homo sapiens
ttcagggattgtagtgggatgcgatcaagtgatagtctacttttagttctcaaatgaatctccacactgttttccatagtggctgtactagtttacattcccaccagaagtatagaactgttccctgttcaccacattcacacaaacatctattttttttttaatggtcattcttgcaggagtaaggtggtatcacattgtggttttgatttgcatttccctgaagattgttggtgg

SEQ ID NO: 598523 - DNA, 806 bp, Homo sapiens
agcggggttggggtgctgcgccggtgccgagtggacgccgtcgctgacgccatgcagctgacggtgaagtgcgctgcagtggcctggcgagtgcagcctgcaggtgccagagtgactgagctggtgtccactgctgaaagcagctgtgtctccgatgaaggctgaactgtcccatgtgcgccagcatgctgtgctgctgttcaatgggcaaggcccctggcagactgggaaactgactctcggattatatgcatcgggcccaagtccaagctcaacctacgtggtcacaaccccctggacgaagtgtgctactagaagacagtgcgagtgcccacgagtgctgggccgacgtcccgctatcaccccgacagagtcttggcaagacttgatcctccaacaagtcttggccccgccaacttcagttgccggcatgacttgcacaagacaagtcggtcctaggcaaccaagcttacacggagtgggaattaacagaagatggatacccttgaggttcgacctgacacgctgggaccgaccattccgacacggtttggccccaggccaggatatcccttgcaacatagccctgcaaagggtggaaccttggacgcacccacactcgtgacggcaaaggagggcctcttccctcaccacacacatacgacaacatttccgtcagggaagagcccattgatagcgcaaccgtgttggcaccccgaacctacgccccagcgggcgataagccatgactatgccacactagagttagcaccaccatacaaccctgactggctaccactccgcaa

SEQ ID NO: 598524 - DNA, 951 bp, Homo sapiens
ggcattgcgtcccgacgcccgtgaggtcctcgcggatgcgcagccggttatgcgagctgtgggtactctggcaagaccagcgtggcacagaggacttgtgcagaatgacaatcgcaaccagactgtgacagcgcctttggggcaagctggagctgtctgtgttggtgacgcagggtcttgcagcgaaatagaagctgcctggggcgaagggcgacgtcgtgcatgctgatgccgatggtaggtcccgagccacgcggcatgcgagtttctcggagtgtccggagtccccatgaatgcagatgcacaagcctggcgtgaatggctagtttccacgcagctcgcgatggctattcgaaagagttcccgcgtgccgggtctatgatacatccgcgttttccaggcacgagtcgttcagcgcagaggaggtgttatggaagctgctgaacggttgtgaaatgcggagaagtgatttcttactcatgcaattagcgagcctggtaggctaacgccctaaagccgtcgctgagcagatgggaggagcaatgagaggcaatcctgtccccatcctcatcccgtgcaacaagaggggatctgcagcaagcgggagaccgatggggcaacgtactccggaggactggggcggaaggaaatggcttctggcccatgaagggccagcggcaggggaaagccagggcagagaagggagctcaaagtctggcaggggcaggggatcaagggacggggaggctacctcgggctcccagaccgggtgggccgacacctgagtatgtgcaggaacggatggacggttgaagcgaaaaacaggtgttacactggcataggatgccggacgtggagggacccgtggattaaaggcagtggcgcgtccggcataaacaaaaagccaaagaaaagacaaacgatcccgcacgcggccatacaaagccagga

SEQ ID NO: 598525 - DNA, 1066 bp, Homo sapiens
agagtaacagaagcatatagccatcttatttttttcttttaaaaaaaaaaaaaggaaatccagaatctgggccactcccgaccccactctgaaagggaggacaaacccgactgtgctctccaactaacttagccaaggtggcgccatggtacagtttaacagtgatgagagggccctccgtgaaaattcgcaggtcactgtacttcaatcacagatcctgtcgcaatttttccccaatgtgacacaatgcctacgtaactacggggcgcggctactctcacaaaacagggccgtgctcccacccccttacatctagccaccaccttccctcggtgaaaacggccacccacctttgtgtgacaactccctacgtacgaggcacccgggtcgtggccatacaccgtctgcagtacaccccatccgaggcaggggcctccaccatcacacagggctggcgccccgaccacacaatcccgggaacgccatgtcacccgtgacagcagcgacggtccccccacacaacaccgagctgcaggggaacagcgcctctgggaaattgtgacagcctccgccccagacaagggaaactgcggggcgaacacatgggcctccaaggacaagggaactccgtcgggcacagcgacactcccaccggggacggcgacacacacccacacccaccgtcacaccctggtgccactgcgcccagaggcatgagttgggcaacaccgttggacccgcggcaaccggacgctccagggggaactggggcccggcacgtaaaccggttactccaacaccttgtgccacgcgggtcaccccacgtgacctaaccactgcatctggccggaccacggcgttccccccattgtggtccagtcggacttcctccgacaaaactacaccaccacagcggccttggcaagtgacccagtctcgaagtgatcacctctccggcacctctccactgtacgctcaccagtaactctacacattggtctcagttcacagcgaactcacgccgacgagctgcagtgcactgcgcacaacctactcccaggaccga

SEQ ID NO: 598526 - DNA, 109 bp, Homo sapiens
atgagctggtacccatcccacctgtgtgctctccccgctaaccgtgttgccatgacccgctcagtactgatgagatcaagggaatgttcaagcgaaaagccgagcagga

SEQ ID NO: 598527 - DNA, 440 bp, Homo sapiens
gcagcccccgtggctgtggaacccggggcaacagtgggctcacttctttcaccgggcctcctgccccatttgtggcctgcggtggggtttaaaaccaagactgtccttaaaaagggctgcaaggactgttacctggtgaaaagggggggtgggtgggacgttttctgtaaaacccatccgggggccaagcagagacagatggagcccctttccctccagagtcagggacaaacttgtcatcgcatcccttgggggaatggttgtatcttatgggaggaattatcccatcaaggagtcaggggaaaggggttggaagcaaacgccctaaaagttccccctcccgtttcaggggaaatggggaactaaagaagccattgggtttttttttttcccaaaggttccaactaaaaaacattttcctattaaaaaagcccttccga

SEQ ID NO: 598528 - DNA, 1099 bp, Homo sapiens
agcgtgctggggcaggagaatggtgtgaacccgggaggcggagcttgcattgagcagagatcgcgccactgcactccagcctgggtgacagagtgagactctgtctcgaaaaaaaaaaaaaaaagtagccctcgtggccaggcatgggggctcacacctctaatcccaacacttggggaggctcaagcaggaagatcacttgaggccagagttcgacaccagcctgggcagcatggtaggaccccatctctacaaaaggtttacaaattgggcaaggcatggtggcacatgccttggagaggctgaggcaggaagatcactggtgatggtgccactgcactccagcctgggcgacacagcaagaccctgtctctgaaacataaagtgggcctctgtcacattcttccctatctttcataagtagctaccctcacctcttctagtggtggtcccgggtacttatctccatattttcaaagttaaggctctggtcactatttcttatttgatcagtttagatcttacttatggatctcgggccagggtagaagaggatgtagttctcacattagagcaaaatgactcatatcttctaaccgaagggacctaccaaaagtgtgcggtacacatgacttgacagacacagaaaagcgggtcaaaataaccttttgcagaacaccgcgaattagggcctaagagtttccaaaagggaactacacgcggggcttcaccaaagttagggagccaggaatcgaagggcaccaaacgtcaaatgaggctataagcggcaccacgagaaacccgggacagagagtgggacaggacaggggcgcacatgtaacgaacagacacggatagccccacacagaggtagaacatatgaggacaaagggtgatatctcgggaacaagggagattaccgggttagacaagcaaaaaatgacgcgaaaaaaaggggggcccaagaaacccaatatcttacaatatatattagaggaaaaaatgataagacggactcttctaggagaaaaatagtgtgaaacaataaaaagggggatagagaagacgataaggggaacgttctatactatcgataaaa

SEQ ID NO: 598529 - DNA, 256 bp, Homo sapiens
ccccccccaaaaaattttacccccaagggggtccctttggtttttttttgggcccccggggggggggcccgcccaattcccggtttttttttccccaagggttggggccggggttttttgcccaagaaaaaagggccttttttttttttgggggtccccccaaaaccatttcaaggggttttggttttttttttttccccttcccttttttaaagggtttcgggggggggtttttttttttttttcccccccccca

SEQ ID NO: 598530 - DNA, 222 bp, Homo sapiens
cagccggtaatatcagtgtctttctagcgagttcatgtgagcaggactgcgtcttcctagtttcatggagttgcatgggggcaggtgcccatctttctagtgagttccatggggtcagggggcacatctttctagtgaatatccctgaggtgaggggctgcgtcttatctagtacttccatctgtgtactgagccccacagcagggactcagtactccttgt

SEQ ID NO: 598531 - DNA, 345 bp, Homo sapiens
ctggcaggacgcggtccgcaggcagcatggcccgggatgcctgcacccaggtcgaggctgaaggacgaggggtctcggtgtacccgacgctctaaaggctgtggctgggggctggctcacggacacgtcactcttcagggtgctgtggggactgccggtggaatgcggtgaggacgacacgaggagggcgctgggctcaggaaccctgtcacagagtggactccaaagaggagtccaaagatgtcatcgtgatggctgttgctgttggagtcgctgtcctagctctggggggctggagtaattagctgcctcctgcagcctcatcagcatgttcatcagaggatc

SEQ ID NO: 598532 - DNA, 173 bp, Homo sapiens
gatactccattacccccagtagtggtgcacgggcacagtaacaccaactcgaaagagacttatgaatgcaaggagtgcggggaagcatttaattctcccaatttatttcacactccatcaaagaactcacactggaaaggaggtcctataaatgtagggaaaatagtgagagc

SEQ ID NO: 598533 - DNA, 294 bp, Homo sapiens
aaaaaggcaaagtgcagcaactaatgcttgtaatcccagcactttgggtggccgagggaggaagattgcctgaggccagcagttcgagaccagtataggcaacatggcgagagccatctctaaaaaaacaaaaccaaaccaaattagccaggtgtggtggctggcacctgtgttccaactacttgggagactcatgtgacaggaagatcacttgagcccaggagttagaagctgcagtgagccgtgatcttgccactgcgctccagtctgggcaacacagggtctcacgaattc

SEQ ID NO: 598534 - DNA, 923 bp, Homo sapiens
  misc_feature (226)..(226): n is a, c, g, or t
  misc_feature (228)..(228): n is a, c, g, or t
  misc_feature (681)..(681): n is a, c, g, or t
gggcgacgggaacgggcgaatacaagcggcataagcactggcccctacagaggccatggtccatccgagtagaagactatgttgtatggcatctgtctgttcaaatgagaagatggctggatcaataatgggcgctatgcagttaggcagacgcaattcaagtcgcgctttgacagcaatgcatgtgtccgacgcactgcgcagaacgtgagtttcctcattcaananagagcataggtggcattgcccatgtaactactgcgatgacattttctaggaaggacgcgaactgtaggagcagcacagaatatcggtgaatagcggaagggtgcagatagacgaggaggaaaggtgcgttgggaaacaacatcggttctgacatgaattggtttcatgtggtttcagtgatacacttgcaacgtggaattgagtcggacgctatgagaggacatgttgcattggaaagttgagtaatggggaacaactgaggaagaagactactaagatggctgtgacacgaacgtatgcaatggtcacgtaagagataccactttcaacgtcataggcacgaactctcgaggaggccaggccactatctcgggagttaggacccatctggtgcataccttgagctgtggtttaaactgaaacccacaggaggtctggaacacagacacaagngcgccaagcgttctagcagaggatgagcagttacttgtaatgcgtcttaacccgtatcgctaagccattttcgacggcctgtcgtaaacagcaagaatatacattacctctcgcccgcctgatggtgttgaccttggctgcatgccctcagtgtcagataattccatgggtgaagtttcatgtcagctcgcgaggttggagatggattggtgccaatgggttggggggacgttggaatgtcc

SEQ ID NO: 598535 - DNA, 981 bp, Homo sapiens
tgggcagtttccaagtcatttaattcaaaatttggtgttggtttcctgaatcaataaatacaatacaaaacaaggtaaaaatggctaccattttctctcccctggttccccccaccgggggaaaacccccggggaaacctcacttaggggttttcaggggttctccctccaaattgggtccaagcaaatgaggctgacggtgacatagtcccttgattcactttccaaaggagctcagctgaggtgaggagagcctcggggaatcgggaggtctactaggttagggaaagggattagggttattttgattttttggggaacaaaaacccggcctgggggaagagcttaccccaaaaaaccggggtgtcctacactgggtccagcgtcccctttctttggccttcaacaacggtggaacgttctctcacaaagagaaaaaatatgagcaaaatgtgtcacacccatgtggggaccccccgtccatcttacccccctactcagtgtgagtccctacagccccacagaatattatgaccctcgtgccgtgggaacctgtgaggttgagcaaggaaaggcccctacaaaatgcaggctaagcaaccagtggcgggggcacttccccacagggggaacgtggtgtaaagggacacagagtgtcgcggaaagaagcccagggctatactacggcgaccacggtaagagagcccaacacgtttcgggcacaaacgcgtccaccctgcacggatggggggacaatagatccccgtgtgggggggaaggtcaccgggaagacaaaagcaaccgcggacacataatgcttctgcgcggagcttagggaaacaaacctgtataaccaaaggaacccccatagcgcttgaccgggcacatccacgcggggcacgacagcaaccgttcggcgacgacactccggggtaacaaccgcacagaaaaaatgcaaccagatgtaaatgacggcacgag

SEQ ID NO: 598536 - DNA, 422 bp, Homo sapiens
gtagcctcaggcctgacggcgactcccaggctccgggacgattctgggcagtgtcggccccacaggtcggccggcgttgcccgttcaccagcgactctgggtgcctgcggagacccaccctgatcctctctagcatccgatcctgcccagcctgatctggtggcccccgcctttagcaggatcatgcctgacctggcctagatcgccttccgtctataccgccatctgtgccaccgcagctacatcacctctgccttcttcggccctctgagcgtacgctgccggctcttgaataggcgacctggggaccaaggctggctcttactgtgaaagccctggaggccttgcatttcgccttaccgggagttcagaggctcgccctgaatgctttcttgcggcttcgtcccctcgaccagctctcc

SEQ ID NO: 598537 - DNA, 145 bp, Homo sapiens
ctcgtactagaaatacaatattagccaggcgtgctggcagtgcccacaatcacagctactccagaggctgaggcaggagaatcgcctaaacccagagtggcagaggttgcagtgagccaagagtgcaccactgcactccagcctg

SEQ ID NO: 598538 - DNA, 922 bp, Homo sapiens
ttcctggcacagcatggcagcgagtaccagtctgtgtaagctggtgggccctgaggtgcggatggcgaatgcgagatgccaggaacatgggcgcagacctgtgccggcaggagcgcagtgaacctactacttcaggcgtggatgctgacgtggccctgaccgagcccaacagcctgcggttgctgatccaacagaacaagaatgtcattgccccgttgatgacccggcatgggaggctgtgggtcgaacttctggggggctctcagtgcagattggctactattgcccgttccgaggactacgtggacattgtgcaggggggcggcgtgttggtgtctgcaatgtgccctatatttcaaagatctacttgatcaagggcgcagtggcctggggggttgagctgcagtccttcagatctcttccaaaccacaagaatgcgtggaccccgacatggccttctgtgccaaaatccgggcagccaggattgtgttcatgttcctgagccaatcgggcacaccctttggccatcttgtctccctagacaggtacccgaacaaccacctgaaagggacctctgggagggtgttcaggcaacccccgaggactggcacgggagaagtactattcgaccaagaaactacagcaaagcccgtggcagggaaacctggtggaagcgagcccctgcccgtggatggttattggttcccaaatttcacgggggggtggccctgtgattgagccttgttgcgagaatgggccactttggccccggtgcttttgggcgcacaaccaagggaaccgcattcacggggggactcgacaacgtccggaatttggatcccatgacgcaattgtttggcgggtgcgacaatcctggggaaatgtgccaagagggaagtccccgggctaacaggcagtgcgt

SEQ ID NO: 598539 - DNA, 855 bp, Homo sapiens
  misc_feature (11)..(11): n is a, c, g, or t
  misc_feature (15)..(15): n is a, c, g, or t
  misc_feature (228)..(228): n is a, c, g, or t
  misc_feature (330)..(330): n is a, c, g, or t
  misc_feature (413)..(413): n is a, c, g, or t
  misc_feature (416)..(417): n is a, c, g, or t
  misc_feature (422)..(422): n is a, c, g, or t
  misc_feature (430)..(430): n is a, c, g, or t
tgccgactagnccgncgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctganaaaaaatagtcaatagtgctcagactggtagcttcaaacagctcacagttaaggaagctgtgctgaatggtttggtggccactgaggtgttgatgtggtttnatgctcggagagattataggcaagcggggcatcattggctatgatgtttgaagaccaatctttaacatctgattatacttganttnntcatntgagtgtngtggaccatgtgtgatcagactgctatctgaatacaaactcacgatttgtcaaaactcagtgctttctccatcagatacttccatgacacaggtcacaatttctcttgatattaagctgggttagtcttttaaacaacccttaaaatacaacgtcttgtatagcccgcaaattgggaaccaggatcactctgctggcacgtattaaccctggtaccctgactactatggggaataccagtctaacatctgcaaggggtcgtgggaacctagtacttatattgacacgcctttaatttcccagaaccaggtgcaggggttaaagggtcttggtgcaaaacctcgttagctttgccacaagtaagaacgacacatagtcagtacccatatggcccacagtgcactcgaccatcaacccaatgtccgg

SEQ ID NO: 598540 - DNA, 314 bp, Homo sapiens
agatttggcatatgatctagaatggtggctaggtttttgtcagtgtgacgaagaacgcaggccgtgagtgtctataggggtgccttgggtaaactctgggactcagaagtgaaagggggctattcctagttttattgctatagccattatgattattaatgatgagtattgattggtagtattggttatggttcattgtccggagagtatattgttgaagaggatagctattagaaggattatggatgcggttgcttgtgtgaggaaatacttgatggcagcttctgtggaacgagggtttatttttttggtta

SEQ ID NO: 598541 - DNA, 680 bp, Homo sapiens
  misc_feature (11)..(11): n is a, c, g, or t
  misc_feature (15)..(15): n is a, c, g, or t
  misc_feature (228)..(228): n is a, c, g, or t
  misc_feature (330)..(330): n is a, c, g, or t
  misc_feature (413)..(413): n is a, c, g, or t
  misc_feature (416)..(417): n is a, c, g, or t
  misc_feature (422)..(422): n is a, c, g, or t
  misc_feature (430)..(430): n is a, c, g, or t
tgccgactagnccgncgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctganaaaaaatagtcaatagtgctcagactggtagcttcaaacagctcacagttaaggaagctgtgctgaatggtttggtggccactgaggtgttgatgtggtttnatgctcggagagattataggcaagcggggcatcattggctatgatgtttgaagaccaatctttaacatctgattatacttganttnntcatntgagtgtngtggaccatgtgtgatcagactgctatctgaattaacataagatttcgtcagcaaatagaactctaaaaatcaacacaagaagctcgggggcgtcatccctggggggcgtgcaatcagcggtgttgcatggggcgtggggagctcaggcgtgtctggtgccagtctggtgtcctgtgggtgaatcgcggcgggcaccctagggggatccgcgatatcacggatcccgggttgccgtgtaggcccggcgaa

SEQ ID NO: 598542 - DNA, 401 bp, Homo sapiens
tcactcagtgctggcagcggtcctgggatagaaggtcgtgcgcaccaggccttcaatggtgtagcggctgtgtccggagtcgttggctgtgaattccacctctgcatgttcattgaatgagaggaggccaagtgccttccagtacgatttggtgtttacgtccacagatgtacatcctgtaacgactgtctatctggctcgcagagtgtcatcagcagcctttgggacacgcattgcacgagccacatgttatggcagcagctgcctcgatacagcatctagaacatgtgaccatcaaatatcatcaggattccccggaggcagtaggaccacgcctcagacacctattcatgtcccactcgccataggacgagctgtggatgagaatagatcttgccaag

SEQ ID NO: 598543 - DNA, 606 bp, Homo sapiens
  misc_feature (11)..(11): n is a, c, g, or t
  misc_feature (15)..(15): n is a, c, g, or t
  misc_feature (275)..(275): n is a, c, g, or t
tgccgactagnccgncgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaagctgtgctgaatggtttggtggccactgaggtgttgatgtggtttnatgctcggagagattataggcaagcggggcatcattggctatgatgtttgaagaccaatctttaacatctgattatacttgggtcgattattcgaggggtgtccgaccatgtggcatcagactggcttctgaataaaccaaggtttggcacgggaggactattggatcttagcggtcaggggggggtttagctgcgccgtacgactgggcacttaggttttaggggggggaaggttatccaggcgggccggaatcgggctgatgtggccttaacgcctatgggggcgccctatcccccccgcggtgggggggtaagggcgagcaggggagg

SEQ ID NO: 598544 - DNA, 361 bp, Homo sapiens
ttgctgctgtcctcctcgccctcctcctcgtcctcttcatcgtcttccacacccatgccgagtgctcaggggcctcaatatccctctcttcgagaatccctcggtggcgtcctcttcaaagctggtcagggcaaagagggctttaaattggttcctgtcctcatccttcctgtcagccatctttcttcgtttgatctcagggaagttcaggtcttccagccgctctttgccactgatctccagctggatcttccgggcacgcagcttgcgccagtggctgtagtacaaaggcaaggggggcccctcttcccgggtcagcttcttccaagctttcactggctgctgcccaaaaagccggaat

SEQ ID NO: 598545 - DNA, 203 bp, Homo sapiens
tcgtctagagcctacacctgctgccccttacgcgcgggggccctgctggcagcttaggggcgtgctcagaggagaaggatgatgaatgggaagaggagtgcggtgtagacacgggtgtacagtgatgagttctgcatccttgatgctccccgcctgggcatcccgccccgagatggggagcatcaaggatgcagaactcatca

SEQ ID NO: 598546 - DNA, 293 bp, Homo sapiens
  misc_feature (182)..(182): n is a, c, g, or t
ggtcaagtatgtctctactggagctgcattattaagggcgtgctgtcattgtcgagcacgtgacgctgagatgtagtgcagatcagccattgcctcggcgagagtaggtcataggacagagagatggcctccatcgggacagtcaggcagatctcgtagtgaaagacgagaaaagttcaggnccaggcccaggcggatggggttggtgggcggcatctccttcttgctgatgtccatggcctcctggtaggctgaccgggctgagtcaatgatgcgcttcttgtcgtcaccgg

SEQ ID NO: 598547 - DNA, 429 bp, Homo sapiens
atggcactccttgtgctggcagaaggtgttcccatagctactacgtctaggatgagccttgattggagctggcattgaagatacaaagcaagttctaagaaatgacacaatagccagtaactgtcccaagtttgtcacatcaggaattatgtacaaagttatcttcaagcttctgtactgggctgcacagagcatctccatgtaataccagcaggtcctaagccttcagctccaaggcagagaagcaggagactctgaggtggtgtttgggccattcacctaatggtggccttggaagagtatgtccctgaaagattccaaagaaacttcaatgctcagaatttttattctttggctcagtccaccacagagacccaaattcagcccatataggaggccaaacaaagccctgctctgacaggcgggctc

SEQ ID NO: 598548 - DNA, 536 bp, Homo sapiens
  misc_feature (536)..(536): n is a, c, g, or t
cctgtgcattttctcttttatgtttctccattttaaaggaattccagtattttcatcggtaaagactaaatcgtatgagtggtgtatagactagaaccaagctaaatagaacatgttgcacgttctgcctttatggtaataatggtcactgcctctagtgcctttggtatcgattttcagcttgacttgggttatttttgtgaagatgaaatggtttactctggcactttggactttcctcagagctccactcagttttaaacgaaaaaattttgtttatttatttttggtagttcaaatcagcatacttccaaatggtctgttttgtttttgaagtttgtaactcatggctgtggggatattgagatagagtaactcctcctagaagattatgttactgatacctgtgttgtgtttgtaaatttgaaaaaattagtaaggattttattccttcctgaaacgtcaggaaaaaagtgggttgagtgtgtgtgtgtgtgtttgaatgggtggtgcagtgcatttcaaagctgatagan

SEQ ID NO: 598549 - DNA, 192 bp, Homo sapiens
  misc_feature (81)..(81): n is a, c, g, or t
cgccagtggtctggcccgcgacgatagcctcctcgggctgttggcgctactcgtcgatggcagcaggcaacaagttcaggnccaggcccaggcggatggggttggtgggcggcatctccttcttgctgatgtccatggcctcctggtaggctgaccgggctgagtcaatgatgcgcttcttgtcgtcaccgg

SEQ ID NO: 598550 - DNA, 264 bp, Homo sapiens
acatatccatactagaaaagaaaccacagacataggtataaaaaaactactatgtagtagtctgggggaatgaacgcacagatctagtatgacttatgttataacaatcagggctcccccacctcctcccattactagtgtccttacatagtagcattagctgtctgcaacaggcgccccataggccccatggcacgacattagcatgcttccagtgccccattttctctactgctcagcatggcatgttgcatgccctggcag

SEQ ID NO: 598551 - DNA, 108 bp, Homo sapiens
cacaaagggggggggaagctagggtttgactatatgcgaccgcttctgggacactcaaagcaagtatttcacctgccaatgtgctctgagaagtgcaagcactcaagc

SEQ ID NO: 598552 - DNA, 124 bp, Homo sapiens
  misc_feature (17)..(17): n is a, c, g, or t
  misc_feature (26)..(26): n is a, c, g, or t
  misc_feature (48)..(48): n is a, c, g, or t
  misc_feature (54)..(54): n is a, c, g, or t
aaaatacttccctcaantctgtaaantaaaagaatagttattttacangttccngggattgtgaaataaatgttgcagttttttaattataatgaaaataaatactcttggttttgctttgtga

SEQ ID NO: 598553 - DNA, 397 bp, Homo sapiens
tgacattataccaatcgagctctgtaccgtgaacattcgtgtccccatcattagcttgtctaatgctctgaccaagccgagatgcccattctctatatgtgattgccggttagggttagagtaagggaatttggctcatagcttcagattaatatggtgcattccaaacagcttgactgcttcttaatcatcaaagattacttgtgtaaagttgtttgcccatattaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacacgaatgttca

SEQ ID NO: 598554 - DNA, 83 bp, Homo sapiens
  misc_feature (16)..(16): n is a, c, g, or t
acaccaaagtgttttnctcatgtcgagtttattaaaactttagcagaacaaattatccagattggagattatcaaaaaatcaa

SEQ ID NO: 598555 - DNA, 1392 bp, Homo sapiens
aaccgcgtcggataatcccgggatatatgtatgacccacgctgtactgctcgagccctgctagggcactcgtgagtgcagctgcactgtacgtatccccgaacctactcagatcagcagaactgcactatgaatctcgtacactctaatcctactctatctgaccacgacaagaaaccataccactaactagatatactctacgactaaagataccatatgataacatagagatactatactagcaataaccacagacataaacgataaaaccagcaaataaagacgaactacaacgagaaccatacgatcctcactggatatcagcaacacagagcatagaacactacgcagatatagatacgacgcacagcaacaaaatgcgcatagaacaatacacacggaaaacaaaactatggcttgaactacgcacagagatagcataacgaaaaccaaagctcaccaaaccaaacacatgcctcaatcacttcatcataccatacaaataccccaccaaaaacacaacccacgccttatacaccaaacaaatacatatataacaaacaacacccccaaatcaaaacaagaatccctagcacaactacccctacattacattgacacaaacaactaactcccaccaaacccctacacccctatcgcaacatactacctacatgtctaccaaacactacaccctctaataatcactattatagtataccaccccacacatctctaacacctcaccaatcacaacaacacaataaacacaccacacacattaaacatcactacccaaaacaaaacaataaaaccactcagcacctacccaacaccaaaccaacaaaacctacccacaagaaaccaaataccatccataaatacccaccctacacaaccacaccacatcatcatcactaacactatcaacccaacaacaccatattccacacataacccctataacgtaaatcacccttcacataacaatcataaacaacacaaatactaacaataattatactaacaaacaactacatccatctgaacatcacaaatacccaaaatacagaaaacattaactataaaatccactacactacacatctaccaaaactcccacattcacacaacaacacataaaaaaaaacaatacaaaatcaacacatacctcttataaccaatacaaactaaactataaaaatcaattaaacgaaaaccacaactttacatctacaaacagctaattatacaaaaaaatcctaccacacacatacacatacaaaccactctaacacacaaaaaaaaatatcacatacaccatcacataataaacataattaccccaataacaaatacaaacaataaacatattaatatcgaaatacta

SEQ ID NO: 598556 - DNA, 149 bp, Homo sapiens
ggctcggcccccgtgtcctttctccataaaattcttcttagtagctatactgtcttattatttgatcgtagaaattgacctccttttacccctactgggttaggtctacctggggatctaccatggctagctgggttaggtctacctgg

SEQ ID NO: 598557 - DNA, 331 bp, Homo sapiens
  misc_feature (49)..(49): n is a, c, g, or t
  misc_feature (82)..(82): n is a, c, g, or t
  misc_feature (252)..(252): n is a, c, g, or t
taatcctaaaagtgtcagaggatgggtgcaagtggctcacacctgtaanccctggcacttttgggaggctgagacaagaggntcacttgagcccaagaggagtttgagattagcctgagcaacatagtgagaccccatctctttccaaaaaaaaaaaaaataataataataataataataataagccaggcatggtggtatgtgccttcagttccagctactcaggaggttgaggcgagaagactgtttaancctggtaggttgaggctgcagtaagccaatgattagccagtgcactccagcctgggtgacagagtaagacccttgtctc

SEQ ID NO: 598558 - DNA, 112 bp, Homo sapiens
  misc_feature (60)..(60): n is a, c, g, or t
gcggtgatctagaggatcccgcaggtctgtcggtttaagggtactgtagagccgaacttngagttactgtgcaagattttttttttaaagctcattcattttaatagtggag

SEQ ID NO: 598559 - DNA, 137 bp, Homo sapiens
  misc_feature (32)..(32): n is a, c, g, or t
  misc_feature (45)..(45): n is a, c, g, or t
  misc_feature (97)..(97): n is a, c, g, or t
  misc_feature (110)..(110): n is a, c, g, or t
caacatcacagtcacatacagagatggccgantggcacagctggngcaggtatacatccgtggcagcaaaatccgctttctgattttccctgacatnctgaagaacgcanccatgttaaagagcatgaaaaataaaa

SEQ ID NO: 598560 - DNA, 114 bp, Homo sapiens
cggaagtgatacctaaaatcccaataattaaaacaaatatgcagtcactttaaaaatatgatcttaagtatatttacataaaatatattttctccatgatgaaagctcagattg

SEQ ID NO: 598561 - DNA, 352 bp, Homo sapiens
cggcaccccggcaactgcttcggatggtgctggaggccattatcccaaactaacgcaggtacagaaaaccaaacatagtgtgttctcacttataagtaggaggtaaatactcagttacatagatacaaagaagggagcaacagacactggggcctccttgaaagtggcggttgggaggaaggtgaggacagaaaactacctatcaggtactatgcttattagtgattaattaatctgtactccacacctctgtgacacacaattttcctatataagaaacctgcacatgtactcttgaatgtaaaataaattttaaaaaaaagaaaagcacaggcatccgaagcagttgccg

SEQ ID NO: 598562 - DNA, 566 bp, Homo sapiens
ctagagcaccctgtagagagagactggataatcagcaattttctcagagcaccagtattggcataaaaaataatatctctgcttttcttgtgatgggagttgtgaggtttaatagaatacatttctccctaagtagtttcagtaagaattaggttggaggacattctgagcttatttatgtgttacaaaaaaactctctgacattcttaatgaaaaagcgggtaaagccaaaactaaaatgtgcaacaagacaagtgatagtcttttgtgcatgaaattttgtgtccagtcttctcactgctcttttcagggatagtatccaaagccaccaagaaagcctttctgttctcaggtccagcaatgagtttatgcgctatgcagtgaatgtagctctgcagaaagtacagcagctaaaggaaaccagggcatgtgagtaggcctgatagggcaaaaacccgaaaatatcttttcagaacctctgtgacataaactcgagtcttgctatggagatacacttcaattcctacttcagtggaagagtccggaaagaaaagagaagggaagag

SEQ ID NO: 598563 - DNA, 383 bp, Homo sapiens
  misc_feature (383)..(383): n is a, c, g, or t
agttatatttttttaactcttatatcaggttcaagggtacatgtgcaggtttgttatataggtaaattgtgtgtcttgtgggtttggggtttggtgtacagattatattaccacccagtaataagcatagtacctaataggtaggttttttggtttggtttggtttggtttggtttgtgaccgagtcttgctctgtcgcccaagctggattgcaatggtgcgaacttggttcactgtaaccttcggcttccaggtttgagggattcttctggctcaagcttcctattagctggaattacaggcatgtgccaccatgctgggctttttggattttcagtagagaccgagtttcatcatgttggccacgctgtgcttgcccctgn

SEQ ID NO: 598564 - DNA, 441 bp, Homo sapiens
tttttttggggaaggccccccccaaaaatcctccctttaaaaggggcccccccttttttggtgaacaaccccccccccccaaaaaaaaaggggggggaggcggggttttttgggggggccccttaaaaaaaaacccttcaaaaaaaaaaaagccgccaaaaaaaaaacccccccccccaaaaatttttaaaaaaatttttctttaaaaaaaaagccgccccccccgtgtgttccaagagggggggggggttttttttgtaaaaaacacccccccccggttttccccccccccccccccccctttgtcaaaagaccccgggaaatttcccaaaaaaaaaaaattttcaatttgggcccccccccaagttttaaaaacggtccccccatttcaatcccaaagccccgaaaattggaagcctccccaggcttaatttctccaac

SEQ ID NO: 598565 - DNA, 162 bp, Homo sapiens
cccctattcaggcaggacgatcctgtctgcagtcacatctttgtgggggcctgctgacccacaagctttggttctctcagtacttgttacccagcttctcaacatccaggcccaattgccctgcctggagttcccccgtggctctaggacactctaacaagc

SEQ ID NO: 598566 - DNA, 925 bp, Homo sapiens
  misc_feature (1)..(1): n is a, c, g, or t
ngtcaccttttgtttaaaaacgcccttgcttgttgttgtaaaataaaaatgtagcggtgtttgaccttcttttaagcaccccttcgacgccctcattcgtccgaccacaacgacccttcttctatttctgggggtgcaaagatatttaattttttgccccgccgctcgctcttgtggaaaaaaaaaatttttcctctctgtgtaattcgccacgcgctctatcaaaaacttgtgtagtattgtctaataaatttcccgccccatatattttttctatgaagatcatatccaccacacctggtgttataaactcctgcgcgcgcccccttctgtagaggaaggtgtccaccccccgctccagccccctctttttaataatcacccacacaaaattttctggtgggttcccctcccccgctcctctctcgttttttaggagaaaataaacagtcaccacagaagaaattgtggtgcgtacactcattttgtttgttttaaacacatagaagagagtcaccccacgatgtctgtctctctctctccccccactgtgggaggaaaataaattattttctcccccccccctctcctttttgtacccctcctctcctattctatctctataaggtatagagaaaaattccatctacataaggggggaatatctttcgccaccactagaagagagtcctcttcattatatgaaagcatcataatggtggtgtccaccccgttcccccctcaatcatcaatcgtagttgcgcgcaacgccgcatacccacgaacataggaaaggggtcttcttaacccaccccccccccaataattagttgttttttctggttttgggaaaaccccacggggaaaaaaaaattttttaaaattttttaaagggccaaatttttaaaaccccactggtttttta

SEQ ID NO: 598567 - DNA, 111 bp, Homo sapiens
ctgggtatactatgaagaagattattacaaatgcatgggctgtgacgatacacgttgtagatgtggtcgttaccctgaagattgttggtggcccatgaagattgttggctg

SEQ ID NO: 598568 - DNA, 473 bp, Homo sapiens
  misc_feature (1)..(1): n is a, c, g, or t
  misc_feature (141)..(141): n is a, c, g, or t
  misc_feature (159)..(159): n is a, c, g, or t
  misc_feature (197)..(197): n is a, c, g, or t
  misc_feature (225)..(226): n is a, c, g, or t
  misc_feature (256)..(256): n is a, c, g, or t
  misc_feature (260)..(260): n is a, c, g, or t
  misc_feature (325)..(325): n is a, c, g, or t
  misc_feature (332)..(332): n is a, c, g, or t
  misc_feature (334)..(335): n is a, c, g, or t
  misc_feature (344)..(344): n is a, c, g, or t
  misc_feature (386)..(386): n is a, c, g, or t
  misc_feature (473)..(473): n is a, c, g, or t
ntgccagcgctgctcttgtctggagggccaagcactgtcatgaagtcagtaacgacagcccagacaattggaacggttaactttacgtacaaaaacaaaattcaaatgatttccttcagaggtggagttttcttaggttcncatttataaattagtctncacagtcaatcctgtttgggaacaagaaataaggaacncatttctggtttcctacacatgacccanntgtacattaattctcgacttccgtggtccnttgnctccagtctgtgaagggtgagtggctaccatttttggatcacctactttttgcatcagctaactngcatatntnntttcaaacntctgtctgtcagcaatcctgaaggtagatgacaggtactatnaatctcattgtacagatgaggaaatgaaggctcagaacggctaagaaacttgcccaagcccaaagtcacgccaggaagtaaaaaaan

SEQ ID NO: 598569 - DNA, 131 bp, Homo sapiens
gagtcgttgaggtctccgcgccgctccctgtaccaactcggtggctcgcgcctctggaaagagctttccgccagagatgcttggagagattaagaaccagccggaccagctcctaaccagataccgccagc

SEQ ID NO: 598570 - DNA, 1415 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (13)..(13): n is a, c, g, or t
  misc_feature (18)..(18): n is a, c, g, or t
  misc_feature (56)..(57): n is a, c, g, or t
  misc_feature (182)..(182): n is a, c, g, or t
  misc_feature (261)..(261): n is a, c, g, or t
  misc_feature (294)..(294): n is a, c, g, or t
  misc_feature (348)..(348): n is a, c, g, or t
  misc_feature (357)..(358): n is a, c, g, or t
  misc_feature (463)..(463): n is a, c, g, or t
  misc_feature (476)..(476): n is a, c, g, or t
  misc_feature (498)..(498): n is a, c, g, or t
  misc_feature (503)..(503): n is a, c, g, or t
  misc_feature (546)..(547): n is a, c, g, or t
  misc_feature (566)..(566): n is a, c, g, or t
  misc_feature (591)..(591): n is a, c, g, or t
  misc_feature (620)..(620): n is a, c, g, or t
  misc_feature (697)..(697): n is a, c, g, or t
  misc_feature (702)..(702): n is a, c, g, or t
  misc_feature (797)..(797): n is a, c, g, or t
  misc_feature (1185)..(1185): n is a, c, g, or t
  misc_feature (1227)..(1227): n is a, c, g, or t
  misc_feature (1292)..(1292): n is a, c, g, or t
  misc_feature (1332)..(1332): n is a, c, g, or t
  misc_feature (1334)..(1334): n is a, c, g, or t
  misc_feature (1360)..(1360): n is a, c, g, or t
  misc_feature (1415)..(1415): n is a, c, g, or t
ngngngcacctcntcggngcggaaacttcgcgcgagccgacgccccccgctttacnncgcggcggaatgcccacgccgagatataatcagagtctcgtgagagaatagagagtataaagtgatgtttgtatggttccatacggtggttacgaaaggcagtcgcgccccatgggcccacgctncgcagagaaaatacacacaacaacgacactgtgcaggggaggcgagagaatgagtaggcgcgatcagcgcaacgcgcancaccacgatacacacaaaacgccacagtgccgngccgtacccgacgctaacgactgcatgagatacataagattatagagtgttagntgtagtagnnatttgtaagatgtcggcgagacgcgagcgatgggagtagcgagctactgacgaggccgcgtgcgcgtcgacttatttaatcagacgcgatgcgcgtgagcagcangcggcgcgcgtcntcgtcttcaccggggagaagangagantagcatgtccttacgacgagagagaaatcatataataacaaannagaatatatacaatataanagacagacaatacggcagcttgtanttacaagaacagaatatctcatgcagcgngtatgagtagagagtgttacgcgcgcggtcctcgtcagccatctgtctcgcctattgcatcgtgcgtgcggcatctngtctncgactcctatttcgccgcactcgagagctccgcggagcctgtcccatagcccatcgtcggtcccatgagcgatcgtgatatgtcaccataggcgngacactcgcccaccgtactcactgtccattctatcctcctcttgctgtatcacgcaagcacgaagacttaagctacatgatgagtatataacatgaagagaagcgaggagagaatgagtaagagtcggcgactcggagccagctaggtagttgatcgccatcacaccaacacgcctaaccaggtactctgattactaagtataaggaacgccctgaggtggaccaagagagcacgataaagacaccaatagacactaagtacagcgcggggaagacagcagagtgcaagttgcgcggtactcaccgtcgtcacaccatcagttcaagaaacgcgctgctctgcgcgcgcgtgatcgtacgttgagatagcgacacatgtagctggtgngtcgggagtggcgtctcacacacgcttattacaccacaccanagataaacgagtgatgcacctagcgtactcaaacaaacgtaatcgatctgacctccagtgagcgngcgactcccgcacacacgactcgcgcgacacgacgtaatncnacacagtagcatcagcgctgacacancatcgactacctgacaccactttcagcagtctacctacgagactcctaacgcggn

SEQ ID NO: 598571 - DNA, 399 bp, Homo sapiens
  misc_feature (49)..(49): n is a, c, g, or t
  misc_feature (140)..(140): n is a, c, g, or t
  misc_feature (174)..(174): n is a, c, g, or t
ccttttttggtgctagacttttaaccccttttttccctccctcctgtgngggggttttttgatctcttcggactaaaattttttatcccggagtgtatctaatcggttctgttctgtcctatccaccacccccaccccanctcttccggtgtgctgtagccccccgctgttagncgccgccgctgctgctgctcgccccgtcgttacaccaacccgaggctctttgtttcccctcttggatctgttgagtttctttgttgaagaagccagcatggtgccccttctccaagaccgcagcgaagggagaagccgccgcgcagagccctgggcacggcgctgtggtctcgtcgcctcccaaagccaattgacaggagaattgccacgtgaaggtaacacggc

SEQ ID NO: 598572 - DNA, 286 bp, Homo sapiens
gatactgacggagggttactttattaatatattgtatgtttaagacagggtcttactctgtcacccaggctggagtgcagtgatgcaatcacggctcactgtagccccaaactcctggcctcgagtgatcttcttgcctcagcacccccaaatagctgggactatacatgcatgccaccctgctagctaatttatagaggaggtctctctatgttgcacaggttggtctggtcttgaacttctgacctcaagtgaaactcctgctttggattcccaaagtgctgag

SEQ ID NO: 598573 - DNA, 360 bp, Homo sapiens
ccacgatcaaagaggacaatgcatcaagcacgcagcaaatgcagctcaaaacgcttagcctagccatcatcgcccgcagctgggaaacagcagtgattagcctttagcaataaacgaaagtttatcgaagctatactaaccccagggctggtcaatttcgtgccagccaccgaggtcacacgattaacccaagtcaatagaagccggcgtaaagagtgttgaagatcaccccgctccccaataaagctaagaactcacctgagtcgtaaaaaactccagttgacacaaaatagactacgaaagtggctttaacatatctgaacacacaatagctaagacccaaactgggattagatagcc

SEQ ID NO: 598574 - DNA, 206 bp, Homo sapiens
taggtgtaaccgtttgcaggatagtgacacatcaaggcttcgttgtgcttgacctcctagggtcaagttatcttcttgcttctggctcctgagtagctgggacctcagtgtgatccacctgccttggccctcaaagtgctgggattacaggcatgatgcataatgctttttaaccaatcaaatgttgccttttccaaggctaccta

SEQ ID NO: 598575 - DNA, 516 bp, Homo sapiens
tttaaatactacccagttcacagggttgttgtgaggatccaaaataatgtatgtattaatgaaatgcctggtgcctatgctgcaaccatggacaccatcactaaatactaagaaggtgaaattccacgaagcttgctgaaatccctggatgggggtactgtcaagatgaagttataataagaatgttcctagacagctatgaattgcagccattcttcccttttccagaatatgtaaagaatgtttgtgtgcccacggaggagccgcatctagcctttgaggctgttcagctcatctttcccaacccgaggattttcctttcctctggactcctcccttcattctcccccactggacatctgttcactgcctcgccaaccaaggggggaaaacattctttgggaactgaagctgaggcaccaccaagagtcaaggcagctatgagatgtttattgttcacagagaatatgtggtgctggctgaccacagaacctgccagggttgggattgccaagg

SEQ ID NO: 598576 - DNA, 345 bp, Homo sapiens
aaaatggagtctcaactctgttacccaggctggagtgcaatggtgtgatcttgtctcactgcaacctccgactcccgggttcaagcaattaccaagtagctgggattacaggcaccagccaccacgcccggctaatttttgtatggtgtttcgccaccttggccaggatggtcttaactcctgacctcgtgatccacccaccttggcttcccaaagtgctgggattacaggcgtgagtcactgcacccagccagtcccagcattttgggaggccatggtgtgtggattcctgaggccagaggttcaggactggcctgccaacatggcgaaatcccatcttcacta

SEQ ID NO: 598577 - DNA, 880 bp, Homo sapiens
ataggctgatcaaactgttattcggcgcatcctacggaggcgcagatatccttgagcctgtggagtggtcactttgatacctaaggatcggactacaaagtacagagtgaatgttaccgattgtattgctgagaagaatttgggtgctgaaccaaagaaaatgttgtttctgacagtatgtgactcgagtaggcaagtgctgttagaggaagtgagttaggtgtgcacgttagactgtggtggggagaccagtgtaacgcgggattactagatgatgaaagacttactacaggctgatattatccttcagtgaattataattgaggttcctcaagtgtagagaagggtgtgaaggtgcagagacgatgtgttaccaacatgagttgttcgctgatgtgttctaggtcgattgatacctggtagacaaggtacgttacttgaaataaacatattgtagctagaatatgtatgcgggtatggtatatagtgtgtatgctcggatgaaacttccataggtccatgggtgacagaagtctcagttggagggaaactaaaatgatgtagagaatgttgatatgtgaattggtttgacatcatactctaagccttgaggtgagtggcagtgtgtggtcgggagaagaaatggttatatacctattttatgtgctagggttgatcacatcgtgtcttaaaatggcagcaggtgggaaatattcagaagcttggtcttttaaaagtgaagtttccaagagggttttaaggaaagaaaatgagtggctgggtttaaactttaaacggggacattgggtttatttaaaaacagggcctctcggtaaacaaggggaaaacccggtgcacggttataagaggttggacaagg

SEQ ID NO: 598578 - DNA, 1151 bp, Homo sapiens
gaaattaattcccattttagagtaagactggaggcagagatggtcacccagatgaaaatgaataacccaactgtgtctttcttctggtgcctccacgtggaacgtgggctgaccaaaatacttctaaagagcattggcactttgttctttaaataagacggaggaggatgaggagagagacgacaccaaaattcactcacagaagtgaacatacaattctacacattcggtaaaactttgtctatcagtatgaaatacatcagtcagtagtctcaatccataaacagagtatctcttgtacaaatgtctgctctctgacgtgattcactatggatgcgtactgaaacatatacctgttaaagtacgcttgacgtgacttgcaactatcggctcactgcttcattataatactcatcgtcatgtcacagtgtacgcagacctattcaggattaaaaacagaagacttcgttcttctacttataccatagtatacgatacattactgaccgagagtctccaagaacatccttgtcgtgcccaaggggcattaagaagataacaagaggattgaatgacatccgtaccggcgtttacatggcaagaccctgcatgcaccataccatgagggatatccaaagcgacaatatcttatcagtggacccttcgaagaccatatcctagcacgatatgcttgggagaactctgacaagggcaacacaagaacacagaccaacgaaccttggggactcaaatttactctcaggaaaaatgttcattaaaggtaagacaccaaccgagaggacatttttccgacaccatgagagtgacgccacggggcactccagataaagcgtacgaaccatccctgggaaccccatcaaggggagacatatacaccaacaaagcgatgaacatgtgacacgcaaatcatgaacagcgaacaagattgacagccccacacagcaaaatgaaccctggcggacaccaatcgaaaacacataccatctagatccaacacgccaattgcacagtctaagcaacgaaaacagggggtcacaaggaaccacaactagcaaacggaacacgaaatcagcagtcaagcagacaatacacatggaacaacacaaaatgcccgtcacaacacacaacca

SEQ ID NO: 598579 - DNA, 220 bp, Homo sapiens
  misc_feature (171)..(171): n is a, c, g, or t
accctagaggatcccggcactctagtcatggcaaatgctgtaccaacacaaatggttccccagtttttcatcttgcactggcagactgagtggtttggaatgccaagcatgtggtgtttggcaaagtgaaagaaggcatgaatattgttggaggccatgggagcgctttgnggtcccaggaatggccagacccagcaagaagatccaccattgctgacta

SEQ ID NO: 598580 - DNA, 325 bp, Homo sapiens
  misc_feature (17)..(17): n is a, c, g, or t
  misc_feature (56)..(56): n is a, c, g, or t
  misc_feature (127)..(127): n is a, c, g, or t
  misc_feature (255)..(255): n is a, c, g, or t
  misc_feature (266)..(266): n is a, c, g, or t
  misc_feature (281)..(281): n is a, c, g, or t
ctcagcctcccaaagtnctgagattacaggcatgagccaccatgcccagccatgantttttttttaagacccaacagtatgctgcctacaagagtcacctcacttttaaggacacccatagactganagtgaaaagtttggaaaaagatactccatgcaaatagaaaccaaaagaaagcagggatagctaaacttatatcagacaaaatagactttaagtcaaaaactgtaaaaagagacattatataaatgatnaagagcatcanttcatccaaggaggnttattaacagttatatatggcacccaacattggaaacacctaat

SEQ ID NO: 598581 - DNA, 820 bp, Homo sapiens
gctccttggcggtgctggagcccgggcgcaccccaccgctcccgggactgttgggggctggccgaaccgtcgtcgaagggagccgctcggccacccccgacgttcctcgccccgcccgacgttccctcaagtggccgaaccagccggacgagccaaactcgccgggcctcccggcggcagcaggtggccccgtccttccagggagggccctgcgccccgcggcgctccggagccctctcggccgccccgccaggcggggtgggaggcgggtttggggacggagaggagctgtgccggttggctcagtcttcgcggtgtgagagcagaagcgtcggggcgctgggcgcgaggagttccgggcattgtgcggagctgcgggtgcggccggccgacgccgaggcagtattccagcggctggacgccgaccgtgacggcgccatcaccttccaggagttcgcgcgtggcttcctcgggtccctccgcggggggcggcgccgggactggggtcctctggatcccgcgcccgcgtgtctgaggcggggccggagacacacgacagcgaggaggacgaaggcgacgaggacgcggtgggggctggcactcgtgggccgggagtccggcgggttggaggattcaggcgcgattggggaagaagcaagttcattccagagaagagcagtagtacctgtatcaaaaattaacttgtggagcagattaatcagcatatgactgttaagactttccggagatagattaaggcagaatggaatttgcctggggaaaagccgacagggttgctatgtgcggcagaaacacctca

SEQ ID NO: 598582 - DNA, 1592 bp, Homo sapiens
  misc_feature (1592)..(1592): n is a, c, g, or t
gcactcgttaaagtctctcttcacccctgccgctcatgtctaagctcagcactctccctaaagagcccgaacagctgacgaagcctcttcactcggagggtctgagctcttgaaacaacctgactgacgagccctgacgcgacgccacttcttgacgcaactggcgcgcacacgcctcacgcgacctgctgctgcgctacactgcaccacgcattccaaaaacacaccacacgcgcgccccagcggcgccctcgcgcgcgcctgactgcactccacactactgacccactgcagcgcacgcgcacgcgctgcgcactgcccgcccaactcacactgccacaggccccacccacccacacggctgcgcactggccacacgcacgctccgctgcgcaaaccccacaacagcacgcaacgcccgccccatcccacccagccacaccaactctcctcaacacacgcaccccacccgctgccccccaccctccacacccctgactgcacacacccacgcccactcactcactgccccgcgcaccgcgccccccctccacacccccacacgcacccaccctggcaccccgccacacccacctcccccccccgtccacgccaacccactccccctccccccgcacacccacgccacactgccgcacccacacacccccgccccaccactcgccactcccgcccaccaccctcccaccacgcaaccctaggcacccccggcaacgcgacacaagccggcggcagcccaacacacgcaacacaacacacgacgcgcagcccctcctccccgcacccccccaccgcccgaccataccaacgaccacagctttggaaaccccggcaaccaacccaacctgccaaccacactacccgcgcaagccgcacaccatcaaccacgacaacctgctgacctaccacaactacacccaccagacaacgcagcacatcgtaacccaccaaaatcagacccctcgcccctcgccaccccctccgcgccacccccacaccacaacccaccattggaccgccacacaccagcctcccaacgcaccagcaccacgcagaccgcccatccacgaccccgccaacaccacacgcaccaccacaacgacacagccaaactgccggcgcccctcacgaacgcagcacacaacccaccactacacacaaaaacacacccaaacacccccaacccggcgcttcaccgcacaccacccaccctgccgccctcccccccgacggcacaccaacacacctcccacaccgcgcccacaggcgacacagccaccaacacaccacacgcagcaacaacagactagacagcaacatcaccaccgcagcatagcacacgcacacacacaccacacagcacccacacacaccacacatacccaccacacacccaaacgcacagcacacacacccgcaccaccaaccccaccacccaaccacgtcagatccacacaccacaacaccagaccaccacacacagcacgacacacaacaacacgaaaacacaaacagacaccacgcactaaacacagcgcaccccaacacaacccatcagcagccacaacaan

SEQ ID NO: 598583 - DNA, 668 bp, Homo sapiens
  misc_feature (10)..(10): n is a, c, g, or t
  misc_feature (91)..(93): n is a, c, g, or t
  misc_feature (105)..(105): n is a, c, g, or t
  misc_feature (112)..(112): n is a, c, g, or t
  misc_feature (177)..(177): n is a, c, g, or t
  misc_feature (196)..(196): n is a, c, g, or t
  misc_feature (211)..(211): n is a, c, g, or t
  misc_feature (275)..(275): n is a, c, g, or t
  misc_feature (295)..(295): n is a, c, g, or t
  misc_feature (299)..(299): n is a, c, g, or t
  misc_feature (350)..(350): n is a, c, g, or t
  misc_feature (365)..(366): n is a, c, g, or t
  misc_feature (479)..(479): n is a, c, g, or t
  misc_feature (561)..(561): n is a, c, g, or t
  misc_feature (565)..(565): n is a, c, g, or t
  misc_feature (598)..(598): n is a, c, g, or t
  misc_feature (646)..(646): n is a, c, g, or t
aagataaaanattaaaaatgcagaggaagaatatggggatcaggttgggtctagggtgtcctcaaacaggctgaggaggttccgaggctcnnncggggggaaggngccccgngggggctctgagttggtgtcgcttaggtccagggcttccctgggtgtgcacctgctcgggggggngggggtgctccccacggtnggggccaggggagcntggggggggagtgaaggccctaggctgtcgtcatcccagttgctggagaggctgctgtccaggngcaaactgcagggtggtganccanggggggtggcatggcgggcccaggggctgtagccagctgggagggtgagcnagcccatgccagggnnagcagagcagggcaagcagggcctgccacagggcccaccctcggctcagggcctccgctgccatgcaccacagcacaccccaggcccgcggctgcctcaacacaggcagtgcnagcagggcctcggccgtggcccgcagcttggggtctggctccagcatcatgacaagggcagaacgcagttcggaagacagancggnagtgaactcagggggcaggtagccctggcgcantggctgcaagccctccccaccgtggggcagctccatgttgcatgccanttacaggatggtgaggcccaga

SEQ ID NO: 598584 - DNA, 122 bp, Homo sapiens
  misc_feature (106)..(106): n is a, c, g, or t
ggctcagtgatctcccgtctcagctcacagcagttgagattaaggcatgtgcaaccacgcctggtaatttttgatttctagtagaaacggggtttcgccatgttgnccaggctggtctcaaa

SEQ ID NO: 598585 - DNA, 1153 bp, Homo sapiens
gtgggctggagccctcgtctgggccggaaaaaaaaagccctccgatccgtcttttagttgcttctcttccttttttctctccggtttctcatcactccaaccagccgcgaccatgcccaggaagaaggcggcggcggcggcctgggaggagccgagctcgggcaacggcactgcccgcgccgggcccaggaaacgcggcggcccggcgggcaggaagcgcgagcggcccgagcgctgcagtagcagcagcggcggcggcagcagcggcgacgaggacggcctggagctcgacggggcccccggcgggggcaagctgcgcggcgcggccggcgacagcaggcaaggcgggcggcgcggccgtggtcatcaccgaacccgagcacaccaaggtagcgcgtcaaacttgaagggtcaacagtgcaaagggcagcttttgattcatggggcaaccaactgggacttgcattggtcgaaacagaagtgcctaaacagcaagctgcttaccgcaatctcggtcagaattgtgggggccccacagatatgggtgcctggcagggggtccgggtgcggacagtggtctcgggctcgctgtgctgcacacagcctcctcatcaacacggcacgcgcacgctgtggcagctgggcgtcgacatgagaagcgccagctgcgacatggtgccaccaagcagagtaaagcacccaacacatcgacggcctacgccaacgagggaacggtctccccaatgcgccgccaccacccttgcgccagccacggaaacggccccgcgaaggactcggcgaacacaaacatggccaccgtcgctgcgcaccgacagatcgcgcacaacaccgcgcaacgaacgtcaggccagcgaccccaatgcacggcccaacccacaaacgggctgctagcaacaacccgacctggactccacatatgcgctgggacactcgccgcactcagccgcccggctcagccgcggacacccggcacgtgctctctaagcccgacactcatcacaggtaccgtggtcaccgggccaaatgcgctcacaccacaccacggcacaccctgctgatcacacaccagcagcatacaagcccacacgatgactacaaaaccaccagccacctaccgcaactccaccaccct

SEQ ID NO: 598586 - DNA, 892 bp, Homo sapiens
ggagctaaaaaacacagcatgagaacttcatgaagcatacacaagaatcaatagccgaatcgaccaagtggaagaagggatatcagtttgaagaccacgttgctgaaataaggcatgcagacaagagtagagataaaagaatgaaaaggaatgaacaaaacctccaagaaatatgggacttcagcgtttaaaaagaccaaatctatgattaactggaatacctgaaggagatggggagaacagaaagaagctggaaaacacacttcaggataatatccaggagaacctccccaacttaacaagacaggccaacatgcaaattcaggaaatacagagaacaccactaagatactccacaagatcaacccaaagacacataatcatcagattctccaaggacaaaatgaaggaaaaagtattaaggacagccagagagaaaggccaggtcacctacaaaggaagcccgttggaataatagcgtaactctcagcagaaaccctacaagccagaagagattgggggccaatattcaacattcttcaaagaaacataattttaaacgcagaatttcatatctagccaaactaaacttcataagcaaaggagatcctttccagagaagcaaatgctgagggatttgttaccaccaggactgccttgcaaagagctcctgaaaagaagcactaaatacggaaagggaaaaaccggtatcagccactgacaaaaactccaaatgttaaggaccaatgacactatcaagaaactggatcaataagtgttgcaaattaccaggtagcatcatgatgaccggatcaattcaacataatatattgacttactgtcatgggtaaatgcccaataaaacgcgattggcaattaataaatttaggaa

SEQ ID NO: 598587 - DNA, 1456 bp, Homo sapiens
cccgtccggatatccgttgagttgttgcctcgttgcgccctcgcgtggttttccgttctaagttatatgtttctgtggcgagagagtttttggtggggattgtcctcccccttgtaggtatgtggtgtcggaatactcttggtgggagattttcttgttgtgtagatacccccccgctgtgtcctccacgtgttgtgtggtattatgtgtccccccctggtgggagtttgtcgtcccactttgtggtcccaccagttatgtgtgcaaccactactgttggtggggggggacatctgtttttttttggtagatcgatcgtcccgcgtctcgctgtggggggttcccattgtggtgccattcagtttggggtggtgtgtcgcatcttatgcttccctccagcgccgcggtgttgcactctgtggggcccacctgggggtccccccctggtgtgccacagggggggcccctgcttgttttgtcacccctcacatgggggtggccaccaacgtggtgctgtttcccgtatgttgtgcttgtgagataggcccagctggtctcatatcgccgcatttgtgtccccgtctcccacccatggggccccccccttctcgggagctctgctcgtgtgcacactcacggctgatatgggtgtcctctcctctctttgtggggtgtctgttgtctctccacagcgcgctctctctctcttgtgggataccccacagcagatgttgttgagagcacacgcgtgtgagaagagaatctcacaggtgcgcgcacagtctccgctctgccaccacgcgggtcccctgtctccccatagagagagagagtgtgacacacagtgtctcgctgtagtcccgctctcccaccgtgtggctgtctctctcccactcgtgtggcgcacacgcacacgcccgtcgtcaccacagtgtctctctctgattactgtgtggtgtgtgccccacaatcctctcgctcttttgttccacagagagtgtgttgtgtgatacgtgtcacatagctccacattgtcacaagatattgtgtattctcggtgtctgtggcacacactgtaatatagacacacaccctcagagtagaatatgaggcgccgcgggctcaataatgtgataagattattttaataacaccagattctctgttgtgttgtgccacctctcctgtataactcccgaccctgccatcacccgtggtccacaggccaggggtgatacatccatccatatttcggaggacatcaatggcacctagatacaccagatatttgtaagtacttatccccatacaccacaaccccctttgtaccgttgtacgacccccaagagataaatgtgtttttaacccccttccctttctgtggcgtcttacatttggaattttcccctgtgtaagacctttggactgagaattgggaaaacccaattactccccc

SEQ ID NO: 598588 - DNA, 558 bp, Homo sapiens
atctagaggatcccgtagtagctatatgcttctcatgaacattttaaaaccctgacttggcaggcatggtggctcatgcctgtaatcccagaaccttgggaggccaaggtgggtggatcacctgaggtcagaagttcaagaccagcctgctcaatgtggcaaaatcccctctctattaaaaacacaaaaaaattagccaggcctggtggcaggagcctgtaatcccagctagtcggaaggctgaggcaaaggaattgcttgaacctgggaggtggaggttgcagtgagccgagatggagccactacactccagcctgggcgacaagagcaaaactctgtctcaaaaaaaaaaacacaccttgacctttatgactctgagctccggtggtccttctacatatacgacaattctcttccatgggattctccaaattcaggtttctccacagttgtgtgccaaatttcctccttcaaaaggtccacttgggttccataatcctgcttcttttccaccttgagcttttagaacctctctcattctagctgccaataatcaaa

SEQ ID NO: 598589 - DNA, 480 bp, Homo sapiens
gtaagggggtgtatgcaggactctgactgcttccttgggtgcagttcctgcagcatggccaggcattctcagttttctgtttggttctcagagagttaatcacagaatagatgaagtacgtatcttttgcaggacttaaccccctttatagagtatgttagcaaaattggggaatgggacacttagctgttgctctggctagcctgcctttaaaaagagatactgaagataaatttttacttaacccataaaggtggtaagaaagattttttaaagctttggagttttatatgagagaaatgcttggctgtcctggggaccattgttactctgcctggttctagtagagaatccgaagttggtgtggtttagagtgtaacaatttaacatatgttaataggagagtttcctgaatctctttgtgacagtttagaaactggtagtttctgccggatttggtgactcctgtcataatcgcag

SEQ ID NO: 598590 - DNA, 953 bp, Homo sapiens
  misc_feature (8)..(8): n is a, c, g, or t
  misc_feature (105)..(105): n is a, c, g, or t
  misc_feature (129)..(129): n is a, c, g, or t
  misc_feature (175)..(175): n is a, c, g, or t
  misc_feature (181)..(181): n is a, c, g, or t
  misc_feature (321)..(322): n is a, c, g, or t
  misc_feature (330)..(330): n is a, c, g, or t
  misc_feature (349)..(351): n is a, c, g, or t
  misc_feature (355)..(355): n is a, c, g, or t
  misc_feature (357)..(358): n is a, c, g, or t
  misc_feature (360)..(360): n is a, c, g, or t
  misc_feature (364)..(365): n is a, c, g, or t
  misc_feature (370)..(370): n is a, c, g, or t
  misc_feature (376)..(376): n is a, c, g, or t
  misc_feature (380)..(381): n is a, c, g, or t
  misc_feature (383)..(383): n is a, c, g, or t
  misc_feature (385)..(385): n is a, c, g, or t
  misc_feature (392)..(392): n is a, c, g, or t
  misc_feature (412)..(412): n is a, c, g, or t
  misc_feature (418)..(418): n is a, c, g, or t
  misc_feature (427)..(427): n is a, c, g, or t
  misc_feature (449)..(449): n is a, c, g, or t
  misc_feature (453)..(453): n is a, c, g, or t
  misc_feature (469)..(469): n is a, c, g, or t
  misc_feature (487)..(487): n is a, c, g, or t
  misc_feature (492)..(492): n is a, c, g, or t
  misc_feature (504)..(504): n is a, c, g, or t
  misc_feature (511)..(511): n is a, c, g, or t
  misc_feature (530)..(530): n is a, c, g, or t
  misc_feature (540)..(540): n is a, c, g, or t
  misc_feature (556)..(556): n is a, c, g, or t
ttgtacangttaaaaaaatggtgtgaggtttatggtttccttgaggttacagttttgtggctgctcttagtgtatttcagaaaaaagcagatggacgaagaccgnccttacagacgtgggtttctacantgaacgcaaggactgactacgctgtatttcacaaccgagccctagngccagncagcaccctacgctcaggaagcggattttgcacgcacactactgcattcatacagagttcactgaagtctattaccaagtgtcttttatgaataaacaatacaaagtccaattttgatggctgctataaaatacttaggnntctctgcnatactttactacaaatacnnntgcncnngnggtnnggggnatgggngtgnngnantgggtanaggttctattctttgtgganatttcngcctaggantgttattcccggtacagatgtncacngtcaaaaagggttatngagctgtttgaagagttnttgangtgttctggatnagtgatntgcctgtgaactttagttncgctgaaganagttttctcagttttnatgactgtgaagtgtgataatggaacgcatccttgatcttaggtgctgctgacctactttcccaaagcaaaatgttttaaaattcaaggcaatctggaacggggactatttccaaacttccttaggcagcacttttcagtgacttccccgcacgctgctttccctgccacgaagcgcttggtctgcttactaaagccacgtatcctgattttacagaaacgtgggcaggtccagcagtgccactggagagctcccagagaagcccactcagaaggaagtgctcagaccaccctcgagccagagcggctggaagctgggactggtcccatgaggcagaaggagcaccagcgcctgctgggtggtgtggggagagcctcagctgactctggacacactg

SEQ ID NO: 598591 - DNA, 898 bp, Homo sapiens
gctcctttctccctctctttaacctttctgccgtcgcgttagcacctcgctgctccagcctctggggcgcattccaaccttccagccatgcgacctgcggcagtaaaaaaaatcactttctatttgctttgcaccatacatatcccttgacggcgagcacaactcaacttagcttttacccatgagtggccatcgtgcacttccaggctggtcatgtgtggcaaccagatcggtgcctcgttctgtgaggtgatcagtgatgaacatggtatcgagcccagcggacacctaccacggggacatgcgacctgcagctgagaccgtatcatcatgtgtactacacctagaacgccacaggtggaaaaatatgtacctcgatagccaatccatggtggatctagaacactgggaaccactggacgtctgatcgactcaggtccatttataggcacagaatctttagacccaagacaaaactttgtatccaaggtcacgtcatgggtgcacggtaaccacaatctcgggccacaagggccacatacaacacaagggcagccgaacgctggttgcattgctagtcctaggactgtcgcgtcacggacaggacggcagaagagcttgtgacatgccttgcaagggactaaccagacatgacccactccacatggtgctggtgaacaacaggtctcatggccacattggcgcgagatccacactttcattccagccacagaatccagcagaagcggaatacactcctgaatccgccagtcaatggaactacacctatccgaggtaggcaagccattcagacccaaaagacgtctggacacacgtggatccgaagcccataacaaatagacacccaatctgcggtccatacaaggggacacagacc

SEQ ID NO: 598592 - DNA, 553 bp, Homo sapiens
  misc_feature (20)..(20): n is a, c, g, or t
  misc_feature (47)..(47): n is a, c, g, or t
  misc_feature (133)..(133): n is a, c, g, or t
  misc_feature (183)..(183): n is a, c, g, or t
  misc_feature (226)..(226): n is a, c, g, or t
  misc_feature (268)..(268): n is a, c, g, or t
  misc_feature (307)..(307): n is a, c, g, or t
  misc_feature (311)..(312): n is a, c, g, or t
  misc_feature (337)..(337): n is a, c, g, or t
  misc_feature (526)..(526): n is a, c, g, or t
gattatttttcagattgttntaatccagtgtggccgattcctcatcngattcaggctgtccagtcaggccccctccccattttgggacctggagccttcatttatgaagagattctccatcctatgaaatggnatcctcatttgtaaatcttttttcttcccattttcaccaaagctgtaaangaaataatccatctcaaaccttacccttttttctctggagtcnagtggggtctttcctcgctccatcttacacagaccctgagcntggaagcctcaacctggttttgttcccctgtttgaaatnttgnnatctcccctccccatgaaagaaaanccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacantaaaataaatttggatttgctcataaa

SEQ ID NO: 598593 - DNA, 150 bp, Homo sapiens
gacaatagttccagttcttcatcacgacagtcaatgacagcctggatagatggcaagcatgtggtgttggcacagtctagagggcatggaggtggtgcggaagaactgggagccgttgtcaaccctgagggcctgttgtcaaccccgagg

SEQ ID NO: 598594 - DNA, 900 bp, Homo sapiens
tgatcaccatgcgctgctgcactgccctgggacctgccatgggctccctgcgcctggcctgcactgagctgattcatggacgctggctggctgcgcctgggcctgtcgcctgcagccgtgtggcctgccgctgtgggtgctgcccctgagtgggcctggctggtggctctgccagtgactggtggtggccatgccctggtggccctgggccgcggtctcctgtgcccctgaggggccgggcgagccgcgccagttcatctgcaacgagtgtggcaagagcttcacctggtggtcgtctgctgaacatccaccagcgcatccacactggcgagcgcccctatgcgtgccccgagtgcgtgcgccgcttcagccagaagcccaacttgacgcgggacctgcgcaaacacacaggcgagcgcccgaaccctgaccgcactgtggacgcggcttccgccagaagcagaactgctcaagcaccatgtgcacgcacctgcccggcgcccaggctgagcccatgacccagcatgcggtaagagctgacgaaggccgagccgcgctgagcgcccaccagcgcgcacaggatgtcgctgagccgacgtccgtgccggggaaccgggcgaccagacgcaggacgaggacatcccagggattggacgagaggccgaggagatccaaaggtacccggggcaccgggacgcgctgtgagtgcccggggacaagcggacctcgactgggacaatggatgagacagggcaaagttcaactttgaaagcgaagttcgggaagagaattctcagaagggagtcaggagacaaacaataacacaggaattcaaaaacgggttaaacgggcctaacacgtgcaccgagatgcgagcgacggataaagcagaaagaccaa

SEQ ID NO: 598595 - DNA, 111 bp, Homo sapiens
agagcttgtggcacacctgtgcttcagttgacaatctgtaaagctctgttcttctggtggcagctcatgactgagacactttgagtggctctatagagaaactctgtctag

SEQ ID NO: 598596 - DNA, 370 bp, Homo sapiens
cgccccgccctctttttgtgttcccggcttcccaaggatcttttagaccccttttctggggaggacctccacaagcttattgacttcctttagctgaagagaaatccgccgggggacgacttatgggcgttcttgaacttgggaagaggggccccccccccccgctccggggggttctcatcagccgcaaattccttccgaccctgatgcgcgtgggcccagcagtttggacatcagccccttttttttttcatttacattcccctgggggaaaaaacgggggggcttttcttctttttaaaataacataataaattgatctttaacatagggaaaccctacttttcttattataaaattctttttttta

SEQ ID NO: 598597 - DNA, 270 bp, Homo sapiens
agggacaataaactttaacctgaattccgtgtccatcagattcttgaccgcatcatgctactctaatagtcatcaccaatccctaatgtcacctaatgaaggccacaatcactgcgtaaggccggcgggtcctgtgactgggaaaacacgagacctttgttcacttgtttatctgctgaccttccctccactattgtcccatgaccctgccaaatccccctctgtgagaaacacccaagaattatcaataaaaaaataaataagtatttg

SEQ ID NO: 598598 - DNA, 146 bp, Homo sapiens
  misc_feature (142)..(142): n is a, c, g, or t
tgagccatcttatctaggaatgatgggaaccttcccattggaagaccatctggaaaccatatggaatccaacttttcagatgcctgccaaggaccaaccttacaagcagatctttctaaggatagaagtcttaagttgctancacc

SEQ ID NO: 598599 - DNA, 180 bp, Homo sapiens
cccgagagcaaagcattgcttgaggttgcccagagacttatttttgagctcgcgtgtggactgagaggtcacgtagtccttcctgaaaccactaagaggaaaaatgtctgtgacactgcatacagatgttgctgctgttacaagaaaaggcttctgcaagaggacacccaagacatgtga

SEQ ID NO: 598600 - DNA, 160 bp, Homo sapiens
agccccaaagatgggccttgtctttcccacataagttggtcctccgtttgccttttctctccagccctcaaaaagcgtaggctgcaacaagaccagtgggttcttgcaactctgtaaggggcagccaggccggccccaataaagcccttgaattctttga

SEQ ID NO: 598601 - DNA, 215 bp, Homo sapiens
gtcgacctggtattgtctagttctctctctgtctagttccctctctctctctaaccctctctctctttaccccccccctctctctctctctctctgtctctctctctttaccccctctctctctctctccctctctctttacctctctctctctatctctctttaaccctctcttcctctctctctctatctctctgtccctctttaaccttctc

SEQ ID NO: 598602 - DNA, 686 bp, Homo sapiens
cagcgggcctggccacctgctggtgccctggaggctctgagccccgtgtggctgccctgggcccactgcggaacgacttggggcgagatgcgagccacccctctgtgctgctcctgctgggttccctgtccaggaagaagctggttgtgagtttggatgacaagcttagatacctgatgctgtccctgtccatgaaactgagctcgaagtgggccccagcccagactgcccccctgcctgttgcccctgatgcccacctactgctccagatctgtgcaactgctgtgtgccacttgctcccgtcttggtgccctatgtcctcctggatgccctgagtgatgggctgggctgtgtgcctaccaggccctgcactgccctacatggcacttgatgtatacctgcaatggtgtaccccctgtccatggaatgccctggccgtgctggatccctattgcgcggttgcccccgcacaatgcatgttgctcggcccactgaggtcctaggctggtacccagctcctctacgcctttttcactcggacccatggggacatgctcagccttggtgcgaagccgccaccgtatccctgatcctgaggctgccgtgctcttccgccagatggccactgccctttgcgcctgtcccagcgcggtctggtctgcgtgatctcgagctgtgtcgcttgc

SEQ ID NO: 598603 - DNA, 379 bp, Homo sapiens
tgtctgctgtcgctaccaacacttacattccttaccctcctctgcccttgcccccttggcgtataacattggatttagcataagtagaatgtgcacttccctttgtcctttagccctggcagggacagaggaactactctaccaggaggtggcaaagggtgagggggttgcaggtggaaggcaggtgggtgagtccatttatctcattcagcgtgaatgcaaataggctatcctatttgagactccagaatgttagagtcacctgggaaagctttggcagagccacggcagtcgtgattcgggtttaactgttctgggcatggcctctggcgttgcacattttttacatcagattcttctgtgaagctggggttgaaaa

SEQ ID NO: 598604 - DNA, 320 bp, Homo sapiens
ggggtttgttggtgaggtctagaatgtctgggatctcttggagtatcggctactagtagaggaatgggagatctttctgtggaagggggaacgtttgcctgattaaagaggctgggtggctgagaggatgggctgggcgagttctagtcgtaaggtctcctttacatgtttgcctcagagcaatgggggtcactcgacctccgcagggacaacataaaagcctcattgacacgagaaaacaccctcatgttcaatacacctatcccccattctcctcctatccctcaacccggacatcattaccagttttcactctaaag

SEQ ID NO: 598605 - DNA, 365 bp, Homo sapiens
gactgcatcaacgcgcgtggcaggtctctcagacttgcctcattttcaacgagcatcgtagataaaaggagggcaggtcaggtgttgaagtagggacagcccttctgctggggttagcctacatgtatttctcataagtgacgggggccttgtgtatatgggaggaggtgaagcctccttatatcgctgggtccaggtccacaccctccatgcagcctgtccgtgctggccttgcttgtcaactggccggggtgtgttggtcggctcacacctgcccgtgcctcttcccccgtgctgtccatgtctgcggtgttggatgcagtcagatggcgtcagagatgcagtcagcggcgtcaggatgcagt

SEQ ID NO: 598606 - DNA, 281 bp, Homo sapiens
attctttaaaaaaaggtttatttttttgggccccctgctaatcaagtgggggaaccagtggaacaacgggaaacctttgctagtttttcaaaatgccccctaaaaacgcggctcaaaaagaaacccagggggccggagttgtttttgaccccctgatttttactccccccaggaaaaaagtttaggaaaaaccagctttttctgttttttaaaaaatacaggttccccccggccagtttacaaagaaagcctgggcccaaaaaagggttttccccccttga

SEQ ID NO: 598607 - DNA, 288 bp, Homo sapiens
gggggtgggtttgtggggatccccccccttcccaagtgggggccccccccccccccccttttttccccccccgggggggagggaggggccccccatttggcccccccccaaggcccaaaaggggggggcctttttcccgggggttggggaaaattttttttcccgggcgccccttcccccccaaggggttttttttttggccccccgggcggggcccaaaccccagggggggtttccccccccccaaaaaaaaaaaaaaaaaaagggtttttttttttttttttttta

SEQ ID NO: 598608 - DNA, 140 bp, Homo sapiens
  misc_feature (64)..(64): n is a, c, g, or t
  misc_feature (71)..(71): n is a, c, g, or t
ctagtttaatgaatctgaggggctactataaacaatcccaccctcacacgattttttaccttcnttacttngcccttcattaggcaaccctagcagcactccacctctattctcgcactgtccaagaggcccacctaatc

SEQ ID NO: 598609 - DNA, 1007 bp, Homo sapiens
  misc_feature (305)..(306): n is a, c, g, or t
  misc_feature (313)..(314): n is a, c, g, or t
  misc_feature (624)..(624): n is a, c, g, or t
  misc_feature (654)..(654): n is a, c, g, or t
  misc_feature (659)..(659): n is a, c, g, or t
  misc_feature (665)..(665): n is a, c, g, or t
  misc_feature (671)..(672): n is a, c, g, or t
  misc_feature (679)..(679): n is a, c, g, or t
  misc_feature (695)..(695): n is a, c, g, or t
  misc_feature (703)..(704): n is a, c, g, or t
  misc_feature (822)..(822): n is a, c, g, or t
  misc_feature (833)..(833): n is a, c, g, or t
  misc_feature (840)..(840): n is a, c, g, or t
  misc_feature (842)..(842): n is a, c, g, or t
  misc_feature (844)..(844): n is a, c, g, or t
  misc_feature (846)..(846): n is a, c, g, or t
  misc_feature (851)..(851): n is a, c, g, or t
  misc_feature (858)..(858): n is a, c, g, or t
  misc_feature (860)..(860): n is a, c, g, or t
  misc_feature (869)..(869): n is a, c, g, or t
gtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcnnaccgtgnntgggacagggcagcccgatgccagctggcctacctgactgtgccagggccctgcccccaccctctcaggatggcctagacttggggaacagagccgggtggggttgcagcccagacaaggcccaggctgagcaggacggggccgaagagtccgagagcagcagcagcaccaggtggagagggcccggcacaggcccaccctggtccaaaccctcacactacagaaaaccccaatggtgctgaaactgtcgcccggccacgcctggccctccccacccaggagggaggtggcacttcttaacctgtacagntttattgtaccaagagactcgccccgcccntgttnatagcntttaannggagtcnactttttaattatatntataaagnnaaatatatataaatatatatataaactttttaaaactgtgaaaaatagctatgaaattataaaaaaaaaacattctgacgtgcagaatattattttttatttcctgttagattatagngtctagcaccngcttcancngncntccantccccananaacccccgnccatccgtcaagtttactgtatttaccctccagattaaaaaatgttttttatggagaaaaaaaggagaggcttgaatcgggccaaccctagggccttgtttgggcccaaaaatcctttaacagccctaatttttttgg

SEQ ID NO: 598610 - DNA, 954 bp, Homo sapiens
  misc_feature (305)..(306): n is a, c, g, or t
  misc_feature (313)..(314): n is a, c, g, or t
  misc_feature (571)..(571): n is a, c, g, or t
  misc_feature (601)..(601): n is a, c, g, or t
  misc_feature (606)..(606): n is a, c, g, or t
  misc_feature (612)..(612): n is a, c, g, or t
  misc_feature (618)..(619): n is a, c, g, or t
  misc_feature (626)..(626): n is a, c, g, or t
  misc_feature (642)..(642): n is a, c, g, or t
  misc_feature (650)..(651): n is a, c, g, or t
  misc_feature (769)..(769): n is a, c, g, or t
  misc_feature (780)..(780): n is a, c, g, or t
  misc_feature (787)..(787): n is a, c, g, or t
  misc_feature (789)..(789): n is a, c, g, or t
  misc_feature (791)..(791): n is a, c, g, or t
  misc_feature (793)..(793): n is a, c, g, or t
  misc_feature (798)..(798): n is a, c, g, or t
  misc_feature (805)..(805): n is a, c, g, or t
  misc_feature (807)..(807): n is a, c, g, or t
  misc_feature (816)..(816): n is a, c, g, or t
gtgtgcatgcacgtgtgtgcacgcatgtgcacatgcctccagccccaccttccaacccctcagtgcccccaggacaggggcccctcttagctatcagggtatggccggaccggcccttcctgcccagcacgttgcaagcacttggccaggccggccctccaggctgctgctgcgtgggggcccgggtgcccccaggtccatgcagactggggattcggtggggaggggcgcttctaaggaaccaaactgacgctcactctgggcttcccaagcacccttagcacggagcccaccccaaggcctcnnaccgtgnntgggacagggcagcccgatgccagctggcctacctgactgtgccagggccctgcccccaccctctcaggatggcctagacttggggaacagagccgggtggggttgcagcccgcaccaggtggagagggcccggcacaggcccaccctggtccaaaccctcacactacagaaaaccccaatggtgctgaaactgtcgcccggccacgcctggccctccccacccaggagggaggtggcacttcttaacctgtacagntttattgtaccaagagactcgccccgcccntgttnatagcntttaannggagtcnactttttaattatatntataaagnnaaatatatataaatatatatataaactttttaaaactgtgaaaaatagctatgaaattataaaaaaaaaacattctgacgtgcagaatattattttttatttcctgttagattatagngtctagcaccngcttcancngncntccantccccananaacccccgnccatccgtcaagtttactgtatttaccctccagattaaaaaatgttttttatggagaaaaaaaggagaggcttgaatcgggccaaccctagggccttgtttgggcccaaaaatcctttaacagccctaatttttttgg

SEQ ID NO: 598611 - DNA, 653 bp, Homo sapiens
ggcctccagaggttaccaatttctatgtcaatcttcagcaagcaaaggtttaaaactatgaatttgtgggagacataatatgactaggaagcaggagcaggggaaccttatttcttattgcgtcagttatgggactcactgatgggctggaacatcacactgggtcacgggtcagtgtgtggctcttgtctactgaccttgtgagttctcagagcatcagcaagtgatgtgcacgtgtggtacccctgtctgctcaccatatgcttttgttttaggttctcccatggcgccagacagtgtgggaaattgcagtgtgggcaactgcagcccggaggcagtgtgggccaaaactgaacccctggagatggaagtaccccaggcaccttttcagcccttctatagctttccagaactgtggatcagctctctccaaatgactgacctggacatcaagttttagtagcgtgggaaggagtacgggcagaccaagaccgtgagcaaccctcaggatgcagaatattctatggggacctgggtccatgctttgacaggaggagctctttgggccgtcggctggagaggttaaattcatcgcaagggtaccggatgaatcgtatctgtcagaggttacaaaaggataaaaaaacagaaag

SEQ ID NO: 598612 - DNA, 474 bp, Homo sapiens
cgcccctatttatgcgttggagcatggcgggagcccccaagattgcccctatttatgcgtgtcgtacgtgatagaggtcctgcggcccctatttatgcgtggaagggcccaaaggtgggccttttctggtgtgacggcgcccctagttatgcgcattttcgaggtggcaactgctgccgcccctacttatgcgctgcgagtcacgcataaataggggcgcgcccctacttatgcgttacttggaggtgctgtcttctgggtgctccgagggagcgagttcagaagtgtgatcgtcaagttccagttgctgcttgagattcgcaacatacagggcccgcttttctgcatcactaaatgtcatgtcaagcgtaactcggccgttgtcccaatccttgatcacgcctaccaggacccccgctcgctttatcttgtcgacgcggccgcggatttagtatagtagtagtaggcggccgc

SEQ ID NO: 598613 - DNA, 626 bp, Homo sapiens
  misc_feature (79)..(79): n is a, c, g, or t
  misc_feature (272)..(272): n is a, c, g, or t
acagaggacagagttgacagctgtgagctattctgattgtagggctgataaagacaccactagctacccattagttaangcctttatcattgtacactatagcttatgccctaggatttgcaagtgttatcgttgctttaagtctctcatagcaaccatcatgatgggaattagctcttcttgtttttccacagtttgaggcaggtgtcaaatatgccacgtatgattcactaatactcgcatttgttattaagtcgagccgaatcggctgncgcgttctacgttagacaatgcttcatcagtgttattgtgtcacgatgcgcttggagagaggcctgaagggaagctcggtgttttctgcaaggactccactaggctacggctttcgctaatgtgtaggagttccttcaggccatacaggtgttctcagggcgaggcgcagcaaggcaacagggggcagccgaatccatttatgcaccgagtgggccaagcctagggtgtgctcagggctaatggccagcaatttcctagactcagcaatgcgggcgaagttcactcgcagcggttcttggccacatttaaacttctatcggggtcgtttcatggccaagatcaaatctctgcaa

SEQ ID NO: 598614 - DNA, 401 bp, Homo sapiens
tgcgaaagagcttttcaggtagtcagctcagctctccgctcgtcctcggagagaatctagtgttcatgtgacagtaaaaacaagcctattaggaagcttttttctaacatgtcctttgcgatattgcaccgttgtccttacctccatcagcacatgcagcaaaataatcaaattagagagggacaagatatagttatcacccattctttttaacattgacagaactcaggggtttattagaaaagaaaaaagaatttcagttttacactctttttttttattttataactttgaaatggcccctgggtaagggagcaaaacccgtgtctaaacaacaaaattaacaaaaccaaaaactgaacccttaaagttcacacttaatctgatgggagcacgatgcg

SEQ ID NO: 598615 - DNA, 151 bp, Homo sapiens
acatcattacattaacataagactctccatcatcaagaagactgaaacttggacaggtgcagtggatcacacctgtcatcccaacaccattgagaggccaaggatgggtggattgcttgagcccaggaagtcaaggcgcgtcagggccaga

SEQ ID NO: 598616 - DNA, 815 bp, Homo sapiens
cgtatcccgcccttggtcaccacctgggtgcccccttttgggagcccccggtcttgggtgcccccccattggctccaccgccccatcaggttcttactcctgctccacttttgatgtggggaacctgcagtcacatcgcggccacattttcattcgaagcctccgctccacttttggatcacctggattttcaggacttccagcttgccttggccacaggtcctgtcagagctcccgtggccccagcctttggaggtggcagttctgtgcctggttttggtagtccagggctcacattctcacactgctttttctaagccatcccagtgacacttttggaaatagcagcatatccacattctctgtcagcccatcaaacagcatcattgcgacagataatgtgttattccacaccccgagatataactggagccgtagaagacactggaaccatttccatcgccagaaatttactctgggaaaaattcccttagaagcctccccctctggaacttctagaatgtttaaaagggccattttaaacctaccatcaaagtaatgatgtttaaaattgcttctgagtcgatttcatacccgagatgtatatatgcatacaatgtatatattcattaacggcaatataagcttccatcccatagatgattattaaatttgatttttttcttacactttataatatttaagtaaaaagtaacccaaactctgcacagcacagggaatttttttgtactgtaattttgcaatggacactggtcaaaattatgcacgaataaagtacttttctcatgcccata

SEQ ID NO: 598617 - DNA, 170 bp, Homo sapiens
  misc_feature (136)..(137): n is a, c, g, or t
caccacttgtgctggccactttcactggccttcttgtgtttggggggaatatggatgcacagacggtgcaaacacagaactggaaaagcagatggtctgagctgtgctatgtgcctccatcatcaatgactttcannatcctactcccaagtgaaactaaattggcaatg

SEQ ID NO: 598618 - DNA, 300 bp, Homo sapiens
ctcactgtccacaccatccccattgaccaactccagtggggtgcctctgctagagactgccacgcctccatgcaaaagcttgactttctccaacacctcctggcagccttctgggccacctcagggtcaatcactgatagttccccgaccccctccgtgatgacacttagcagggccccccatagtgcctgtgggccagaagctgttcagaagttggcttcaaggggcaggctcgttactgtatctcccatgccacagccagacttcgagcttccaagctctgggggacccccgcggagt

SEQ ID NO: 598619 - DNA, 141 bp, Homo sapiens
gcggatttcgggcaggctggttgaacacgtgcacgcgccgctacagtcctttggaagtgggcttcaagaccatgccattccggctgggcgccatggctgcctacggccctgcggctcctgcgcaagccacggtcaacccac

SEQ ID NO: 598620 - DNA, 107 bp, Homo sapiens
tttattttcacataactctccatcgtagctttgctcatatcagccatccattggaaagcaacccatatgtgtggtttgattggattaacagattgtggtatatttat

SEQ ID NO: 598621 - DNA, 922 bp, Homo sapiens
  misc_feature (461)..(461): n is a, c, g, or t
  misc_feature (468)..(468): n is a, c, g, or t
  misc_feature (471)..(471): n is a, c, g, or t
  misc_feature (549)..(549): n is a, c, g, or t
agcgggatgcgctctgttggcggcctcctgagcactcgcagggctgacaggtcgccgggaccaggccgtggggccgccggccacccagggcaccttgctgtggtggacggacacggcataggtctttgagccggttccgcctgccagtgctggttctgctgcgtcccagaatgctagcgcagacttggcgtgcttgtgctgcgtcacctgtatcttgcctcctgaatgcgttgacatcctcacctacagacgagttacggacaggcctttttctaggactaggcgtccgttgcttgcacgccaccccactgttgaacatatgcgagcctgagtttcgttgagcgacgtgacttgtacactctgagcgagaggttgcgcatgcgggttggacgagggtttcctgacagagcgagggaaattgtctttcattcgaagcttatgcgaaactctctcgttgtcgnatgaccntanttaggttccgagatcgagaaatgttcgattctcactcggttagtacccatgtccgtcgactcgaagttcgagtacatnggattgtgtacctagccacttgcattattgcactccccgttgagaaggcaccagcgaaaactttggatatcgagaagaacgcagacacgttatcccaaggacgaagacaaacggattcatacttagtcttttccaagatagccacaacacggtggtggcttaggcactaacttgtagagaagattgcccatatgcgttcgagaaccgtgggaacaggagttgggcgaaaagaggaatcgcgcaagatggaacttggttgttttcagaggaacgttgttgttagatggttgcagtttcaatcaaaggtgtttagtaaggcagatctttgaagaaggcaatgttgaataaggggtggccgatccaatcgaggaag

SEQ ID NO: 598622 - DNA, 643 bp, Homo sapiens
aggacctgtatcactcatccattgctatcgtaaaaagtgctgcaataaacatacgtttgcacgtgtctttacaacagaatgatttatagtcctttgggtatataccccagtcatgggattgctgggtcaaatggtatttctggttctatatcctttaggaatcacccatgctgtcttccacaatggttgaactaatttacactcccaccaacagtgtaaaagtgttcctatttctctgcaccctctgattgctgcctgctacttcctctggaatctttgtcccagagggccactggcctgatgcctgctggagctctcctgtataaggtgtctgtcaacccctgttgggatgtctctcccagtcaggagtcacggggatcagggaccctcttgaggtggcagcctgcctcttagcagagctcaagctctactgcgctggtagaaccctctttgtcaggatccgctgctcttttcagagctggcaggcagaaacatttaaatctgctgaagctacgcccacagccgccccttcctccagatgctctgtcccagtgagatgggagtttatctataagcccctactagggctgctgccttttttcagagatgcctgcccggcaagagaatctgggaggcgctggca

SEQ ID NO: 598623 - DNA, 164 bp, Homo sapiens
taccctcggcataagggccaacggatggtacaggtcaaatttgtagactacagctgtgtacactatctgtaatccctgttactcaggaggctgaggagggaggattgtttgagcctgggagttcaatcacttcagtgagttatgattgctccactggactccag

SEQ ID NO: 598624 - DNA, 1033 bp, Homo sapiens
gattcatggaggaattgtactgccacttatgtattttgtatttcacacgaaaaaagccattcagattcctcctgggcctcctcgccccatttgcgacagcatttgctacctgcttcagttcagcgagacttccctcatatgatgaagtgcattgaagagaacaagtggtgtggacaagaggatcagcaggtttattctccccatcaggggccaccgtgaacatggacggagcagcacatcttccagtgtgtggccagcggtgctcattgcgcaactcaaacaacaatacgagctcaactgcaggacagattttcaccattctagtgactgccacagcgtccagtgttggagcagcaggcgtgccagctggaggggtcctcaacaattgcacattatccatggaaggccattgggctggctagatcatgagctgactctgatccatggatgtggactggattgtggaacggaccacaaggtggtgaatgtggaaggggatgccactgagaatgcaaggcattacacagcaactgaatacagaacggcaaaacacagaaaggcgagcaggaacttgctgagggtgaaagtggaagacatcacccaatgcgaagtctgaggaggaagacatcgaccccttggatgacacacacagaaacccgctgaaccccgtggaccaagatgacccaaggaaactggcaattacaacaggatagtaaggaacatagtgaatgggggacatgggcgataagggacatagcattgcacaggacagtgtatgttacccaacccatggaatcaaccacacagacagacgaaagcacaataggaccacacacgagagcagccagcaccagtaaggaccaccacatatataaaccacataccccaaagagcacacgggagtacgagcaccacaaaccacggaagggcacagatgagaggataatcacccataagtcgagacacaccgtgcggacataagagaggcagtcacacaacgaacagaaaaaagtgagcagcaccaccacgcgca

SEQ ID NO: 598625 - DNA, 582 bp, Homo sapiens
tggtgattaaggatcttgggcaggttgtcatcttgtctgtagtgtactgtcattggtcaggtcagtgagtcaggtatcttatagctacagagagggtggtcaggctgtactttaggctgcatgaaagtctcctggagatggaaagcattccaacccaatctggccccaaccaaaagcaaaggcggcagatgagtggggcaatgggctggaagctgtagcatcacttgcaggtggcatagtagagcacgcgcccatggatgtggtcacggatctgctccacacgcttctccagtccggtcaggtccgccgagcgcagaatgagggcctggctgccccgaagcaagctccaagtccatgtctttcatcctgtccatcatctccatggtctccccaaacagttcctcttgctctgtcttcacactctggatccgggaccctgctcacccagcatggaactctgacccaaccggtccttcaactcagcatacttttgtgtattctctcaaatccctcttgggactcaatgcctgtcgctggaccttccggaggtggtggcctggattgctttgcccctgtgccggt

SEQ ID NO: 598626 - DNA, 838 bp, Homo sapiens
gctggcgtaggcttggtggactgtcactggccacctctccgccccggacttggaccgcgattggaagtgatgtgtggagaatagccaagaagggccaagtgggtggcccttgttggcagttgtccgaacattgcaggagaatttgaagaagattatgcaagcatttcagaaaggtataagtgggttctgtcctgccgtgctttgggtgttcactccagttcaaggtacttccaagcagaagagcaaagacagtgtcacgaagctaaaggatgcggatgtagcctttggcccatttaacttgaggaattttactaaggatcgagtcgtcgaggcgaacttggagagcgtgggagcttagtagttttgctaccccccgagagtatgcctggtgacatggctgaaccagatagctggagcggaagacaagcttgctaatcagaacagatccagttagcacgacaaggacttaccaatggtagcctaggtgaattgttgcacgtgcacgggctggctgcctgggggagatgcataccacactaaactcctttttagcaagggagactcctggatgggttgaacacatggctcacatgcatgcgtgctattggaatgggtcggagtaccattccttgctatgccccgtggtgaatgggaacgttaggaacgcttggggattatgcttcatatcgtacagagtgtacccctccattttaaatcggtgatgaagcgtgggaccatggaaagtgcgggaacctttgtgggcagagcatgtggccctttaaacgttcctcgtttgcttcaggagaacagataacagctgggactaggaccagacaga

SEQ ID NO: 598627 - DNA, 320 bp, Homo sapiens
  misc_feature (275)..(275): n is a, c, g, or t
  misc_feature (316)..(316): n is a, c, g, or t
tatcctttaaagaatgaatctgaaaagctacacttacacattataacagaaaatacatgtctagattggaaaaaaagtaactttaaatgaaactagagattcttccccattattagctcctaactgaatttgaatgttttaaatataagtagtaagatcaactctgtaagtcaaagatgggctgggtgtggtggctcacgcctgtaatcccagcactttgggaggccgaagctggccgattctttgggagccctgggagttcgaggaccagcctnggtcaattatgggcgaaaccccgttttctacaattaaattnaaac

SEQ ID NO: 598628 - DNA, 936 bp, Homo sapiens
cgcgccctatgtgtcccccgggtctcacccgcgctgttggactccacccctggggtccataaccagtgggccctgctcacaatcccgcgtctgggccccccaccctgttaacgtccccacagttaatttcggggaaaggcaatttcccaatggggactggtattctctcccgcgcggaaagtgtttaacaccaggtcgaagcgccggcatatcctaggcctgggggacacgttaaacctgctacgcttgggacagcagctgccttcccgagaagaaaaattctgggacttgcttttggccgtgaatacaattcgcactcgcgcctttcaaccaggaaactatgtgaagccccccggccgcgcgccgtatttggacccgggtcccctccctgcccccgctgtcgtggggccctcatcttcctggttaaaggggtaatcctccaatgattttcaggctgctacgttgtccccggagttcactttgtgcttttggtcgcttcccgttgcccaccccgcaagccggtataatttcttctggggggccaacatcgatgctgcccgcctgttaccgcagcgcctgttggcacagattttatttttacagacccgcgtcggacccctcaaagatttcatggatcgtaaaaaacatctagttttgaggattgcaaatactatatcagcattatatgggccccgggagtggccaattctgcgctgagtaacgaccttgtgatgtgtgcagaagtcacgagaatctaggaggcctcttgaagttaaaaataatacgggctattccagatggaacggaaatagaccagacatccggtcggacccggttaccctattatgatcaattgtttggattccgtactgttttctgaaggagctctcgaccccccctatataaattccgtttaaatccaccccaaacaataac

SEQ ID NO: 598629 - DNA, 431 bp, Homo sapiens
aagctagtatactagtaacctagacactggatatgttctatgacaaatatatgctggctcctatatgtggtacagctagatcaggttgtttgggtcatacgctgtgccggtagctaagaagagaactgaactttggtgggtcccttagcttaggggggaagcatattagtcttggattcagccggacttgacgtcagattcaagttatgtgacattgagcagctggaataagccctctgagcttgccttcattcatgtgtgaagtgaccacattgttttgaatattaaatgagaatgtgtgaagcacttacccactgcctggcacacagtgggtgctcaagaaatattagtcccttccctgcccctgctctcatatcaaataactgattatcttttaataagaccctttccaaaacacctcaaacattcca

SEQ ID NO: 598630 - DNA, 159 bp, Homo sapiens
ttttcccccgggggccgccttggccctttgggcctttttgggtgcccctttggacccggttgggcccaaaagccgggtggggccgggccgggatttccgggggtttggtgcccccccgggccgggattttggaaattaaaacccctttatttccgtcca

SEQ ID NO: 598631 - DNA, 222 bp, Homo sapiens
ggctctggactcagacgctgacgatctggagcacctgacagatgaatcagctgatgagactcgctgtgcctatgcctacaaacccatcgtcgccagctctgtagatgtgcgcaggatcgactttgcacacaccacctgcagcctgcatgacgagcacaccgtggcgcatgagggccaggatgctgactatatcttcgatctccagagcctgatagacattgt

SEQ ID NO: 598632 - DNA, 231 bp, Homo sapiens
ggacacatgaagactcatcgtctccaataaaagtcagacattaggcaagaacagatgtgtcaaaagaaaatgtcagaatccatacatggatgcttagatgaggagctgtactccttccgtgatcatgccattggaaggcagttgtatgacacgcatgctttcacattagctccgcttttcttaactctccagaaggacttcagaagcctctggagtttagcgacccgcgaa

SEQ ID NO: 598633 - DNA, 216 bp, Homo sapiens
  misc_feature (152)..(152): n is a, c, g, or t
tcgtccggagcttacctctatatctatattcgttgtgggtcttagacatttggtatgggagtaaacagtctgtgtataatatatttcagatcatgcttcttggacggggaagaatggctacaaggtgatgggacaatatatacggatttgcnggactgatcaagtatttgtccaggtccaagtttcaagaagccggggagggggggggtgggggga

SEQ ID NO: 598634 - DNA, 925 bp, Homo sapiens
gcccgctcaacgtggatcatttctcttgcacccctctgatgtgggcttgtgccctgggacacctggaagctgctgatgctcacttttccgattggaaccgacaggacactgacgcattcccgacatctctgggccgatctgccatatgtcatgtgagcatcacttcccagggagtcactgtgacgaccattgcccgcgtgccgtgtgcaggcaactacgagcagacaggcagccattcaggatggagcccaccagtttgcccataatcgcacacacacatccatccaagaccacagcacaacatggatcgtgacgcagacgtcatcactcgcccatcggagcttgtcgagatggcaccattttccgtcacgtcagcctattctagatgccaccagaatggcagtcccacccactgcacctctgccagcactctgagatgactatggaggacatggacccaggccagctttcctctggtgtcccagaagcccccctactcctcatggactatgaggctaccaactccaaggggccccatctcctcccttcctgccctcccaccagacttcagatgatggggctgctccggaggacgctgacagaccacaggctgtggatgtgatcccggaggacatgatctcactagccaagcagatcatcgaacgcacaccggagcggattacaacgagaggactcgtggggctgccagaggctggagcctcactgccggaccggacaggggctgtgaggctcagtgagaccatgcctggccggcacctaacttggacaatcggggacacattcccgaggcacaaacccatccaacgacctgcatttgaaccacgccgactggtggtcatacaagaccctccggggcagcagcccctgcaccccccactggcccgcggcaccgactcagcgtgga

SEQ ID NO: 598635 - DNA, 222 bp, Homo sapiens
tctaagatcccgtgctcctcttcagcagcatgttccaagggaaaggcttccttggaggtgtaggagatggctgggtgggcagctgctgggactcagatgggggaagtagaggaaacacaaaggctggtcttggcgaggaagggcctttgtccttagggtcccagggaggccttggaggcattctcaggcagaagtggcaccggtgggtcagctgtgagtgag

SEQ ID NO: 598636 - DNA, 322 bp, Homo sapiens
actacatacttccgtagctagggaaaggaagtctcccttttgcagtttccggtctgccaaccaggaggctaccggtttcattaagctgaaatgagagaaattagaggctacacatttccccattgctatcacacttaaacaaggctgtaaagacccagtgaggaaggaggaaaatagtagggtctcagaaaggagaaagttacagccaacctcagccagctctaggaaaggcacctgttaaccaagcaaggaacaaaggacattcacttttatactaggaaacccaagccggtggtctgcatgcagactgtaaggtggggat

SEQ ID NO: 598637 - DNA, 150 bp, Homo sapiens
tacagcggcagtctgcgatgcctgagttggcttggggcttgcgtgaaggtggcactggcaggggcgcgctcggagcggatcccgggcgtgacttcacagttgcctctgcgaggagcccaggttgtctggcccagcttcaccagcagcttg

SEQ ID NO: 598638 - DNA, 141 bp, Homo sapiens
aaaggatggttgatatctggctgagacactgtggagagactgagagagcaactgagagaaagtgggcccctgaaatgaaagtgattacgcaaattttaggcagatgccaccatcagaaactgatatattctgacgtcttca

SEQ ID NO: 598639 - DNA, 180 bp, Homo sapiens
gccgcaccccgatatttgtggttctggcctactgcctaggtcactagcactgactctgttgccaggcagttcttcgctattggcctcaaagtgatgacgaatagcgcacagggtgctatgtcgccaagcaggactggtctgtgctacatagatggggcagtgtgagaccttatgcagtgg

SEQ ID NO: 598640 - DNA, 124 bp, Homo sapiens
aatctagaggatctcggcacattgggaggctctttgggtctataccactgctctctctctccccaacaccactattgaacaggagcccttgtcaccaggcgccccccaggagcccccccacgag

SEQ ID NO: 598641 - DNA, 422 bp, Homo sapiens
  misc_feature (6)..(6): n is a, c, g, or t
  misc_feature (16)..(16): n is a, c, g, or t
  misc_feature (70)..(70): n is a, c, g, or t
  misc_feature (76)..(76): n is a, c, g, or t
aatttnggaaataaanggaaaatgtttgttgaattttgacagatttctaccaagcagctaaaattaatangaaatnaattttgaatggaatgtacttaataacatttacttctgtggtatgcatcattccctaccatcagataatatagatttaacataatttttggtcaggcactattttaaaaatcaagacatgaaaaatatttttatgctttgtggatatcatttgtttcagtcttcgttgtgaaccttttaaatttgagactgtagctacatttgtgtactttatcattctttaaagaagtattatgttagaccctgtgccagctgctgaggatatggaagtgttcaagacacatctcctacccttgaaattgtgcatgatgcttctgaactagcaataaaagtatggtgttaatctt

SEQ ID NO: 598642 - DNA, 456 bp, Homo sapiens
ttcagaggatcccccacggcgggttgtactggggttggcaaaaaattacgttaaacacaaaagaataatgtgtaaaagtgtagccccttttacattccagatgttattttaaaaagtgacgtaaactttttggagatggagtctcgctctgttgcccaggctggagcgcagtggcacatctcagctcactgcatgctctgccttccgggtccacgccattctcctgcctcagcctcccaagtagctgggactacaggcgccagccaccacgtccagctaatttttggtatttggtttagtagagatggggtttcaccgtgttagccaggatggtctcgatctcctgaccttgtgatatgcctgccttggcctcccaaagtgctgggattacaggtgtgagccaccgtgccaggccaaagtgaagtaaattttacattaaaaaatgtggtgggctgg

SEQ ID NO: 598643 - DNA, 128 bp, Homo sapiens
  misc_feature (3)..(3): n is a, c, g, or t
ctngattccggtgaagttggttgaaaatcacatcaaaaagctactaaaaggactggtgtaatttatataaaaactactgacagaaaagcttttcggaatgatgattagaagaactttggaacggcctt

SEQ ID NO: 598644 - DNA, 151 bp, Homo sapiens
atgacagcagtaggcagtggtagtctaatgcaaagatctctaatgatcagtatacctactacaccgatttatagctacatccaaacctgataaggagcacttaagagattatctgcagccctagattaccatactgcttccctctggtggt

SEQ ID NO: 598645 - DNA, 160 bp, Homo sapiens
  misc_feature (15)..(15): n is a, c, g, or t
  misc_feature (154)..(154): n is a, c, g, or t
  misc_feature (160)..(160): n is a, c, g, or t
cctactttcacaggnagctggtgactatacagccttatgtatgtagtagataatgtatgatcttttcctgccttttttgcaactaactgaatacaatagtaagtttatgaggtgactttttaaacattctgaatcttacaggagacgttcaagntacagn

SEQ ID NO: 598646 - DNA, 233 bp, Homo sapiens
ttcaactgggttctcgagtacgtacctgaggcgagagcagagaatggtcgccactggctctgagcgctgcagatgcttgtggcggctgccgcaggtccgcacagcaggttggcgaccgcaggttgtactcagcggggtcccccgagctgctgcagtgggagccgggggtggtgatggagcaggtcatcttccatcctcatcctcgtcgtcctcaaccggagttgaaagacgca

SEQ ID NO: 598647 - DNA, 319 bp, Homo sapiens
  misc_feature (34)..(35): n is a, c, g, or t
  misc_feature (66)..(66): n is a, c, g, or t
  misc_feature (121)..(121): n is a, c, g, or t
cgagggacagctcataagtgacactaaaagaaanntttcgttggtttactgacaccaaccacttgnatggtactatcctgaaagcttggaaaacactcggcagttgactttggtttggagnctgggacaggagacgacgagagcacaaccctggagatatgctctccttgctcctggctgaagcacgccagaggtcacacgctaaagtcccaggaagagattgaaccgtgtgattggcagaaacccggagcccctgcatgcaagacaggagccacatgccctacacttttgtctgtggggggcgaggtccagagataca

SEQ ID NO: 598648 - DNA, 126 bp, Homo sapiens
  misc_feature (1)..(1): n is a, c, g, or t
naccccgaaggacataatgataaaagggtcaattcaccaagaagatataataactataaatatatatgcaccacacattagagctcctaaatataggaaacaaccccaggcactgtttggactctg

SEQ ID NO: 598649 - DNA, 267 bp, Homo sapiens
  misc_feature (39)..(41): n is a, c, g, or t
acgatgatgtttccaaatgatgaatttagggaagccctnnnttaactagataagagctttgcataactaagacatgattattttggagttcccattgtggttcagtgattaacgaatccgactaggaaccatgaggttgtggggtcaatccctggcctcacttagtgggttaaggatccggggttgccctgagctgtggtgtaggtcgcagacgtggcttggatcccgcgttgctgtggctctggcatagactggaggctacagggg

SEQ ID NO: 598650 - DNA, 298 bp, Homo sapiens
gttcaggaggatccgctatccgcagagaagggcttgtcctgtagagaattatcgagtttggctggcccacttgtgccatcttcatagcctttgttatgatcattgacaaactgtgcaagtaggacataagcagctctatgaccattagctcagttgccagtagacccccggtcaccctgaggctggtggtccctgctagtcagtgtggctctctcatcggaagaggtggttgcaagatcaaggaaatacgagtgagtacaggggctcaggtccaggtggcaggggatatgctacccaa

SEQ ID NO: 598651 - DNA, 255 bp, Homo sapiens
agtctagatacctgagtcagagccatcaagaaactaagaggcacttggcactggcttcggcatcatccctgtgggcggcacgtacctcattcagtctgttcctgctgagctcaatatggatcacgccgggtctgctgatgctggcagagaagagtggctacggtactgtctcagtcagatcactgccattcttaaattgggagaccgagcgtgcgcggcaatgtgcggaaacaccagcggtatgagtccatattg

SEQ ID NO: 598652 - DNA, 328 bp, Homo sapiens
atgcggttagtcgtcagccagactacatttgccgacgggcctcccggctcttccgccctcttctcccgcgaagtatgagccgaactgggcgtccttttcaaacgtcgtcccctcacgcgcgcgccctgcagccactctcccgcctctaccgcacgcgggagctgcatcgtccactccggtcggcggtggaaccgccagtccggggtcacagagcttgagaagcgacgcgctgagccccccatcacctccagcccgggcgacccctcccgggtcctgcctcgccctgcgcagccgcccgagcccccaagcccgggaggcccgtcccagc

SEQ ID NO: 598653 - DNA, 1010 bp, Homo sapiens
tcatcaaggtgcacgtcggggatgaaggactactgtacacctgcgagtgttccaatctctcccttcgtgaaaataggcccttgacctttatcgtaacttaccagaccaagaaagcctaagcatgatgagctgacgcatatttctgatcctgactttggacaaggccctttcagccagaagactgacaaatgtcatcctccgtctaccagagcgtgtacattgtgactcctaaaactaatgcttcattctccgggctgatgcccttggggttggacacggggcaggacttcttgcagctggtttaggattgatacttcctcaaaatttcacaagtgtagtagcatctctccctgtgcccctaggaggctgattctacaataatctttcagaaattatgtttcgcacttactagataatatcttctgaaaaagtctcccaatataaacacacaacaaataataaaccataacatgcagaaacaaatttcgtcgtggtgccatagggtacacccagcaatagcgttccttgatatcacacgtattcaaggtcatggcgtacctcggcacgcgaaactcaaaggaataagttaggtcaatgaggccccattaatagcgtccccttctaagagataattttcggcgagcaaaaacaacaaaaatgggtgggacggggaagattctaccccaaagccgaacaagtaaaaaccgacgccgcggggggagaagaacaacaggagagaggagcatcacggcgcacaaaccatatagcgcacgagagagaagaaaaaaactacaagaaagaacacaacaaacagctgggaagacaacagcaacaaaagagagggagatagccaacagagaggagaagcacgaccagaatatagaacgaaaagtaaacaaaggacgcaccaaccagagggatgagacagacacgagagagcagaacgaaggagggaagaggaccaggaccaaggagggagaagcagacgcgcaacatgacaaacacaacac

SEQ ID NO: 598654 - DNA, 195 bp, Homo sapiens
cctggcccccgcctgtacagttgcgctctcgcagctgcccggcgtagcagcggctatggtgcccgatccctgcctgcgccatccatttacatcgactaataagattcgagcggctgagttgtaacacgctccttatcgaactgccggctaccatggccaccgccctgcctgtctaatatcacccaacgccctttc

SEQ ID NO: 598655 - DNA, 132 bp, Homo sapiens
  misc_feature (12)..(12): n is a, c, g, or t
gctccgaggatnccagggttacgcccctgcattcaggtggatgtaaaatataaatttttgtgagatttcagagattaagattattttgataacattatttacagatctaaaagatgtggttatcacaagtat

SEQ ID NO: 598656 - DNA, 434 bp, Homo sapiens
gccccagatataaaaccaaaaaaaatttccaaactgtttagaaccctaataaaatttatgccgttataaaaaaggcctttctgcccagttttaaaatgaagcagatttttttaccgttgtattgtggggcaaaactggattttttgtaacttaaaaaaaaatcccccgttttaaaggccataatccgtaaatgttattttcaggggctgacatcctgttttttaaaaaaaattaaaagtaaatttttcccccataaaaataaaaaaatcttgtcagttactttttttttacaaaaattgctgggcaaaaatgttttatatctttagttactaactaaccccgcgggttgttcctatgtgcttttttttcattttcaattttggttaaatccaaaaaaaaataatttcccataataaacggcgggttttttttta

SEQ ID NO: 598657 - DNA, 163 bp, Homo sapiens
  misc_feature (39)..(40): n is a, c, g, or t
aaaaattttttttggggtgggggaccctggagggcctcnnctccgggagtttcaaggggcccccccctttcctttggtgggccgttggtttttttggccggggggtttacttttgcccagtccgcccaattaagccagggtttgcccccttttccttgtccca

SEQ ID NO: 598658 - DNA, 141 bp, Homo sapiens
tgtagctgttcttgaggataccccaatgctctcacaaaacaaacacctgcggctctgctgaatgataaaatgtgtggctgggaaaaaccaaacaccaatgtagaaaccagctgacctgggtacctgatgctctgaattctg

SEQ ID NO: 598659 - DNA, 293 bp, Homo sapiens
  misc_feature (235)..(235): n is a, c, g, or t
cactggaatccctttcagcgaacctcatcactcccatctaattccataataggaacatttcacgcgaaaacgaaacaaacctgaaccaaatcaccccgggaaggactttggagccagaccaaggtatggggggcggattcacggggcattctgccgggaggagccttgaagattttttaatttgtcgcgggatgattttcgacttctcgaggctgggttttgttagactaggcgnacgtctgcaccatggcttttaaccggtccctttataggtcgggacaaaaagtatagac

SEQ ID NO: 598660 - DNA, 798 bp, Homo sapiens
agcgggtctctcgctggagacggaggtcaaggtctcgtccttactggctgtgtgttctctgctcctatagtgccaggctctgtggccctatgacctgtgaggtatcggggatgcaatccacgaagtaagtactgcctaggagcccctggaagcctagaaatgggatcattgacacttgtagcggatgtcggctcatatgatagttctcttctggtaggatgttggcaatgacctggacactgcacacgcagaatctatagtagcaccatgtgatagttagagaattacagaataccctgtggtcttcctgggtacttgcgtagcgctttaatgccagagtcgtagatcagtgtttgactggaggaagggaagaaggagtctctgtgagatatggaagagacagtgagaatggtgtaagaattcggccaggtaggtgacgagtgaatgacatgactaaagattggatgatgaggtggaataagtctagtggcaggaagtccagtccttaaagtgattctggagtcagtgttccagggatgaaggagtattctgggagagactcagtggtatttattattctgtgtaacttggtcttctcaggacgagggggcatcgtacgggtctctacatcttattaaaagtatctaagaattcttctgttgcccttcagataaatcttccttcaaggtttacagtgacagtccaatagtgactgtttcatggcatacaagatgagtgcacaatctatagttgctggtagtagaggacgcacagatatgctggcatgattttaagata

SEQ ID NO: 598661 - DNA, 279 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (73)..(73): n is a, c, g, or t
  misc_feature (83)..(83): n is a, c, g, or t
  misc_feature (87)..(87): n is a, c, g, or t
  misc_feature (112)..(113): n is a, c, g, or t
  misc_feature (115)..(116): n is a, c, g, or t
  misc_feature (125)..(126): n is a, c, g, or t
  misc_feature (268)..(268): n is a, c, g, or t
  misc_feature (270)..(271): n is a, c, g, or t
aacttacatttntntnttcttgtaactacagattattatgatggttgtaatgaagattatgagtataattggngctatatgtntctnaattctgaacaactatttataaaanncnntcctacttnnctctgttgaacatatgacttctctggtctgctaaacacatacagacctttagttttggtttacatggatttaaatatatagatatatcactgtaaaataaacttcaggtgtaacagatttatagagaaagtaatcatatttntnnatggttgt

SEQ ID NO: 598662 - DNA, 358 bp, Homo sapiens
gaagttaaaggaattatggatgggtttaaaccgggtacatttttcaacggtccttttaacgaagttgtaagttaaagttaaaccggggcataggggttagagcctggattgggctcaaggggggggaaaagggaaaaaaccaaaccaaaaccggtcacgggaaattaaaattccaccacgggttaccagacctttcggatttaaattaaaaggaaggaaaaagcggaagcattgagcttcgacatcaactgtacaggcattacaaagactcctgtgacgaaaacacaattgttcaaagctttccacagtgtccacagactcagtttcagggacagcctggactactttcctttcacac

SEQ ID NO: 598663 - DNA, 377 bp, Homo sapiens
  misc_feature (54)..(54): n is a, c, g, or t
  misc_feature (171)..(171): n is a, c, g, or t
  misc_feature (174)..(174): n is a, c, g, or t
  misc_feature (183)..(183): n is a, c, g, or t
  misc_feature (190)..(190): n is a, c, g, or t
  misc_feature (193)..(193): n is a, c, g, or t
  misc_feature (348)..(348): n is a, c, g, or t
  misc_feature (367)..(367): n is a, c, g, or t
  misc_feature (376)..(376): n is a, c, g, or t
cccgttgcccccgaagccattttagggtggctgtggctcttcctcagccagggnctgaagaagctcctgcctgacttaggagtcagagcccggcaggctgcaggaggaggagcagggggtgctgcgtggaaggtgctgcaggtccttgcacgctgtgtcgcgcctctcctnctntggaaaccngaacccnacngatagcacatcctaccctggaagaccagcctcagagggtccttctggaaccagctgtctgtggagataatgggggtgctttcgtcagggactgctgacggctggtcctgaaggaaggacaaacttgcccagactttgagccccaattaaaatttnatttttgctgggtttttgnaaaaaaaang

SEQ ID NO: 598664 - DNA, 318 bp, Homo sapiens
  misc_feature (152)..(152): n is a, c, g, or t
gaccacacacacacacacacacacacacacaggcatacctacctacggaaaacatgagaaacaacataaaagtcagccggtgtggtggtgcgcgcctgtagtctcaggtaatggggatgggagggatcagaggcagaacgaccgtttggtcngtccaaagcgttgaggttggggtgatcctgggcggcagagacagaggaagaccctgccagtaagggagggaaggaaggaaggaaggaaggaaggaaaaagaaaggaagatagaaagaaaagaaaaaagaaaaggaaaggaaagaaaaggtgattcctgagttaaac

SEQ ID NO: 598665 - DNA, 152 bp, Homo sapiens
  misc_feature (116)..(116): n is a, c, g, or t
gatctcatccagcaaagatttgcggcgtttttccttttttgctatatcgggcttttatttttttcagttctattgggtttaattaacaaataaatgaaaaatcaaggtttgggccntttgggccaacatctcctcattttccctccccccca

SEQ ID NO: 598666 - DNA, 811 bp, Homo sapiens
  misc_feature (18)..(18): n is a, c, g, or t
  misc_feature (131)..(131): n is a, c, g, or t
  misc_feature (167)..(167): n is a, c, g, or t
  misc_feature (172)..(172): n is a, c, g, or t
  misc_feature (174)..(174): n is a, c, g, or t
  misc_feature (178)..(178): n is a, c, g, or t
  misc_feature (188)..(189): n is a, c, g, or t
  misc_feature (192)..(192): n is a, c, g, or t
  misc_feature (196)..(196): n is a, c, g, or t
  misc_feature (198)..(198): n is a, c, g, or t
  misc_feature (201)..(201): n is a, c, g, or t
  misc_feature (208)..(208): n is a, c, g, or t
  misc_feature (213)..(213): n is a, c, g, or t
  misc_feature (227)..(228): n is a, c, g, or t
  misc_feature (232)..(232): n is a, c, g, or t
  misc_feature (241)..(241): n is a, c, g, or t
  misc_feature (244)..(244): n is a, c, g, or t
  misc_feature (248)..(248): n is a, c, g, or t
  misc_feature (251)..(251): n is a, c, g, or t
  misc_feature (254)..(254): n is a, c, g, or t
  misc_feature (257)..(257): n is a, c, g, or t
  misc_feature (263)..(263): n is a, c, g, or t
  misc_feature (269)..(269): n is a, c, g, or t
  misc_feature (273)..(273): n is a, c, g, or t
  misc_feature (282)..(282): n is a, c, g, or t
  misc_feature (288)..(288): n is a, c, g, or t
  misc_feature (297)..(297): n is a, c, g, or t
  misc_feature (304)..(304): n is a, c, g, or t
  misc_feature (348)..(350): n is a, c, g, or t
  misc_feature (380)..(380): n is a, c, g, or t
  misc_feature (385)..(387): n is a, c, g, or t
  misc_feature (390)..(390): n is a, c, g, or t
  misc_feature (429)..(429): n is a, c, g, or t
  misc_feature (433)..(433): n is a, c, g, or t
  misc_feature (630)..(630): n is a, c, g, or t
  misc_feature (693)..(693): n is a, c, g, or t
  misc_feature (731)..(731): n is a, c, g, or t
  misc_feature (773)..(773): n is a, c, g, or t
caggcggggggggggggngggggggggggggggggggggggacccgggagggagaggggggggaaggggaaggagaagcacgagggcgccggcggggggaggcgggcgccagagggggggggagcacaggnagggcagcgggggcgggggcagcagcggccacaggngccgncngagnaaggaagggnnggnagcnanagnggggggngaagnagacggggagaagnnaggncagggcagnagnaganggnagnggnagcggnagggangccnagcgagggnaggaanggaggacanagagcgnagagacagaacaggccagggggaagaaggagagacagaaaaggnnngggcgagggcggtgagggactgaggccccnaaaannnggncccaggggaaaggaagaggccagttggtccagttttganggcnatggggaagggaatgtattagtaagcatgggggagaggatgccagcaggcacctcagaggtgacaggacaggctgaaccccccaccctgacagaaaggagcttgagagctctggggctctctgggaatgtcactgctaaaatatatatctacatatatattaaccattcgtgggagggcaggggcaaggcctggggngggatcagaggatctggcgtggcatcccgtagccagtcatgcctgcctgagacgccccgcggntggtgcccatctgtaacccgatcacgttcttgccctcntgcagctggttatccgagaagttccgagggatctccttgganttcttagggaacagttgggatcccagagaagagcccat

SEQ ID NO: 598667 - DNA, 181 bp, Homo sapiens
gcctgcggcatctagaggatcccatgctcatccctccttgatgaagaatgtcaggtgtaatgtactactatttaggttgaaattttgggttttaccctttgtattatatcttatagtgaaaggctttttttttggtacccatatatccagggctgattcctaaattttccaattcccaaaa

SEQ ID NO: 598668 - DNA, 361 bp, Homo sapiens
gggcattctcgggacactggacaagcgcgcaaaacgggggcagagaaagccctaccacaagaagcggaagtatgagttggggcgcccagtgccaacaccaagattggccccccgccgcatccaccacagtccgtgtggcgggaggtacacgaatacgtgcctgaggttggaacgtgggggaacattttccttcccttgtggggggcgtccagacaggtggttgtgtacacctcggtaaaaaacaacgagctcatccgatgttgtcctacaattgcgatctaataacgagctggttcgtaccaatgaccctggtgaaggaaattggcgatcggttgctccaaattccgggaaaccacagggc

SEQ ID NO: 598669 - DNA, 244 bp, Homo sapiens
atacaggcatacaatgcataataatcatatcaggatgaacagggtatccatcatctcaagcatttaccctttgtgttacaaacaaagcaattatgctcttttagtaatttttaaatgtacaataacttactgttggctatactctattgtgctatcaaatactagataatcttcatttatataactacatatttgtacccattaaacagtctcccttcacaccacgcctggcctggcccctata

SEQ ID NO: 598670 - DNA, 170 bp, Homo sapiens
  misc_feature (126)..(126): n is a, c, g, or t
  misc_feature (158)..(158): n is a, c, g, or t
agcccccaaaaacaacgggcctggcaacgggccgggccatgcagggagggcctccctatgttgcctgcccctttgggcaccggccagcaccctttggttaaaaaaggtcccccctttttatgtgcnctacccccccatttgtgattataataaatttnttattcctgtga

SEQ ID NO: 598671 - DNA, 1409 bp, Homo sapiens
  misc_feature (203)..(203): n is a, c, g, or t
  misc_feature (209)..(209): n is a, c, g, or t
gatgtgatacctgggaagggctggatgggtgtccccgatatatggctttcgctgtgcgtgtgtcgtgagtccggtcgctgacgaggcatagctaaatagaaggagcgaagtgttgatgtatctcgatgtactgtacgtactgaggaagatggagtggctgtggatgctgtgatgtttaactctatgtcatgagatagttttcntatagnttgtcatcgggggtcggatagagaaggggttgtgtagatggagtgtcacgtgtataggtgagcgttaattcactacggtcagggggtgctgaggcggacagaggcacacttgatcattttgtggatgtaagggtctcgtagaaatttcaaaaggaataaggcatgagattgcccttcatgtgccacttgggatagaagcggtgagtcgtatatcgtggccctggagtgaatggctaaaagtaggtatgtgcgttagataggggatgaaagggaagggaatagctaggtatctgagggggcagcaagttagctgacgcaaatacgtgcttccatgcgccgcgtgttgtgcgcacgctccttcgaagggagggacgtggctgagagtggtggacgtattcgacttgcgtaatcgatatcagaagaggagcgttcttgaaaatgatcagaagttgcatctgttagcccttgtactggaaaggcacaaggaagaaagccttgattaaagaaacgctgcgaaaggggcgtgatagtttatggtgcactttagaagggtttaccgaataggggggaaacaaaattgtgggagtttgtgtgagggttaagtttttagaacaaattttaagggaaaacaggaaaaaaggagaataaacgcggttgaccacaccacaagggtggacaacaccttttgccggtttgctcaaagcaacgatggcggattaggaggaggacaactattacaggacgtggcggttggccgtaagctccagttaagggatgaagccgcggaggttccacagataccattactaactttttacgcaacaaagggggcattatgagaggtaatgtgagcagctggatacacaaccacaatatggtgggaatggataaggaagggaaaaacttgtgccgttttgatgcacaccaccccatagattgggatcaatccttcatacggttggtgtgtgcaccttgtaacgaatgaaagagccaacttttccctctatgtaatgtgggaaggcaagccgcccattaatgagagggcaagcccagttggaggcacgaaaaaccggcatatggtgggttacacgaaactcgtgttccgggggaccgtatgagggaccccctttccttttcctattttctcccaacgttaacacgaacacaaccagtgagacaacccagggatagggaaaaaag

SEQ ID NO: 598672 - DNA, 143 bp, Homo sapiens
cgacgaagggtggacctcggttcttagcttcagaaaattgcctgtggtccatccccccagaatactgtgctcctctgctacttagtgctggccctgaaatccaaagtctgtgcctcaccctctcttaccccagctgggactcc

SEQ ID NO: 598673 - DNA, 1137 bp, Homo sapiens
gaggatctcgggctcggaacgagactgcaggcggattgttttataggaaaatggcagacaaaccagacatgggggaaatcgccagctatcgataaggccaagctgaatgaaaacggaggacgcaggacgaacgaacaccctgtgcgaccataagagaccattgtaggcaggatgaaggcggagtgacacatttccgtaacgagtcctggtacggatttcctaacccgccgtctctcttcgagaccccaggtcgtggatgtggaggacagacgccaactgctagatggacacgagccacagaatgctgcagctgtcgaaccctagtgcgtagctgcccgtgccgattgccaaccgtgcctgttgcggtcatcttgaacgggatcccccccaccaattctggacctgccagaaattctccgggttatgtcgccgcgcgactattagtaccgaacgagtgaacttttgtacttgaactacattggtagcaataaccaccaagacttcgatgggctgggacctggacagagagagaagccgcggaggctcattgaaatgtcggtgggcggatgctgggagagaccggagggctccgtgaactggggccgaacgtccacgttagcatgcttggcttggtacgctgacacctctatgggtgcgaccaccggggggctgaacgtgagctggatcttgcgcacactcgcgagatgccgcatggacatccctggattcaaggcaccggggtgacataggtcgagggctttcagcaatttcgcttggcacagcaccgaatcaaggcgttcttgagggcggtccccacttgggctcttggattcttgtcgttccttgcctgggggaaaaaccttgaatgtctccaaactttggaggcttccccccttggcacgcgggggtatcatatccagggtctgcttggacgtggagaacttgggcctgtgccctgtgggagcctgccccgctgatgggacttactggtagctgacaggtaaattggattccgctctagcaaaggggccttggcttctgaattcccaggtggaacccccgtttttaaaccacaataaacacctcgggttaaaacccaagcgggagcttcttgttgaagaacgcaagtcaccgaag

SEQ ID NO: 598674 - DNA, 374 bp, Homo sapiens
gtgcgatctcagctcactgtagtcactgcctcccaggttcaagtgattctcctgcctcagcctcccgagtagctgggattacaggcatgcgctaacacacccagctaattttgtatttttagtagagacgaggcttctccatgttcgacaggctggtctcgaacttccacctcagcctgccaaactgctgggattacaggtgtgagccaccgtgaccaggcaatgcgccttcttatagtgtctactcattggtctttgctctgcccagagataacaatgggataacgcctgctacacatgctcattgtgaaacccttcccctgagctgagattaaatgaactctgattatttagtatattttccttggcagcct

SEQ ID NO: 598675 - DNA, 142 bp, Homo sapiens
agatggagaaccgtgataacacgggatgcacaggagtaatgctgctgatgtacggctatatgtactccaactgctataagtacaatcccccagatcacgatgtagtggccatggcacgaaaagctaccgggatggaatagcg

SEQ ID NO: 598676 - DNA, 122 bp, Homo sapiens
gctatccagcatagcgacgcttggtcttatatatcttctgtatttgaaaacacctggcgacaatgctgatgacatccatgaatccagcagggtaggatatatcagtaacggaccttgccatc

SEQ ID NO: 598677 - DNA, 177 bp, Homo sapiens
gggggtagaatttcaccaacaaaggacccacggcatctaggcttcgaagcggtacattaccgagctgaaggacaggggccttccaaaaaaaacactaaaattgaaataagcactgtacttaaggattcttagatgtatttttttgttatttcccctccgccgctatcccttggctaa

SEQ ID NO: 598678 - DNA, 758 bp, Homo sapiens
  misc_feature (106)..(106): n is a, c, g, or t
  misc_feature (758)..(758): n is a, c, g, or t
ggctaagagcatcatgtccgagacgcgcaagcatgtctcataagttcccatgctcatcgcatagttaatcataatagtatgtacctcctttgtgctcttctagtantcagatcgttgagtattgttctaacacacactgaatatacaatggacctagagatgcacagggtggcagtacttgaaccaagtcctatgattggatgttctgaggtgcaagttgtgagcggatctatcaagcagggagtcgcaatggcgaggctcgatgtcaaaattacgcgccgctcgttgagatccgctccccaggtaaggcccatatctcgtggcctcagccctccccagagtaacgttgggagcctaccagggcacttggccaaccacaccgggtcctactttttgaatattttaaggtaaacagagggttcacatctattgtaaggccaggagatggtgtctaggattctccttgagacctacatagatccggcccacgcttggcctccccaaaagtgggctggggataatagggcatgagccaccggtgccggcgatattacacaggtcctaattagctgtggacccattttgcgcttgtacgttttcatattttgccaaaatccttcacctctgtccattggtcggcctcagcggaaaattctccccaccgggctttgtacaaaactttacatactgggggcgcgcactcatcccacgagacataagggcgcggcaactcacgaacacgccttaacagacatggn

SEQ ID NO: 598679 - DNA, 1219 bp, Homo sapiens
gactagttctagatcgcgagcggctgaccttccttcccccgccaggccaggagctgggtgagccctggatggatcatccccagtgtagctgagcactgttcacatggctaccgtgtccaagcaacgcgcattctatccaccgaccgacccaagggcaatggaggtcatcatccaccggctcctgagcatgttccaccctcggagcctttgtgaagacccgacttagacccatcagggagactgtggacctgacctgacatgacatcagcgacattactactacactgtgatgtaccggatccatgccgagttccagctcagtgagcctgaccgacttcccctattttggttactcccactgactcagttcaccgtgcacatcatacctctccaaaagacgaccaaccacgtaccgacgattaccgggatcttcgagacacaaccaaccacaggtctcatgaactggtggacaatggacgtggccccaaacagcaggccaagcagcacaagcagacaaccataggcgacggtggacacacatcgagaacaacaatacaacacaagactgagagcaagcgaaggggaccaagcgaggcacacccacacaatggcaggccccattcaggaggactcaccatggcgaaactgcaaggatgggacaagcaaacaagaaacaaaaaaagaccaaccaaggacacacaacagagggagacgaaccacagaagcaacggagatacagcaggaacggaaccaaacagcgcccctcacacacagagcgcaagacacaaaagcaacacacagaaaagaacccagagacgacctgggcaggctgaccagtagaccacacacaaacacacaagggtcacgacaacaaggcacggaccaccctgcaaccccacaaccagcacacaaaagcatcggaaacacaccggacgaccaacaagaacctggcaggaagatagcgcccacacaaaagccacagcactgcagaaatcacagggggaccacaacaggaagaacgagccagaccagcaacacagaaccacaccgaccaaacgaggtaaaacgacatgccacgacaacgcgaggcgcaaggacaataccgcaaagtcacaccaacgaagagaagcgaaaaagacaaagacaaaggaaggaacaggaccacaaaaccgcacaaaaccgcgcaacacacgaagagcaaacaaacgctaacaaggac

SEQ ID NO: 598680 - DNA, 395 bp, Homo sapiens
aaacagaaaaaaaatgttgaaagccaggcgtgatggtgtgcacctgtagtcccagctactcgggaggctgagctgcagtgagccgtggatgtgccactgcattccagcctgagagagcaagaccctgtccaaaaaaaagacagcacaactgaaaaatgggcaaagaacttgaatagacatttctccagagaagatacacagatggccaataagcccatgaaagatgcgccaagccgttagtcattagggaaatacgaatcaagacccaatgagatactacttttacacatactaggatggctattcaaaaacaaaaacaaaagcaaaatagcaagtgttggcaaggatgtggggacatcagaatccctgtgctttgccgctgggggtgtgaaatg

SEQ ID NO: 598681 - DNA, 854 bp, Homo sapiens
gggctcgagccagcccctggcgttagcaggagggggagaacagataggtaagctcttttagcatttccgtcttatgatctggacactttctccccaagtctcctttcaccatcttgcctctcccaacaccacgtacatcacatcaaacaagatatcgtgggtaacgcccatggacgtgtctgctgacggcgtcgtggctttctttagccagaagagatatagggagccatggtaagaccacgcagttgggtgcagaagtgccttaagttgtccacgtacccaattgtttgagttgttggcctctagttcgtttcccgagttcatctgattacggtcttgatatcttaagtattgacatcgtcttagtggcctatcccgcttattaaaatttcgagactctaactttggggggtagtaacgcttggatcgagtggctatgggaattcgccttgggatatggcgaacgacggtttgtaccccgtgggggctcaaaccccgtttttaagggtggccttaaacggaattcggtacttttggagtgacccatggggggacacctttattgggggggaccactgggaagtaaacctcgagtgtaagtcatttcacgaatagtataccaaattcgagaataagtcctttagatgccacttgggtttaatacaggttattgaaagatcgtgaaaagattatccactctctaatatatagttttacaatgcactattgaagggcgtttagatagaattccgtgagttaaattaaagtacagggttgatcgaattgcgttggcgggacctgggataaaagtaagaaacagttaggttagaccttaagaggggtttaccatggtg

SEQ ID NO: 598682 - DNA, 445 bp, Homo sapiens
gtgattgatgaatggaattcacgatactgttaaatgctgcgagcaacaaggaaacggctttgggatcaaccggggcaggtaatggcgtggagggctctttgagtttgggagtcaggaacgacctctctgataaacagaggcgtgcactgaactgacggacgcaacccttgcacattggtggggaacagcattctacggtgagggaacagtgagtgcaccggtcggaatgacgcagtataaaggccaccgtggctagactggagacacggggatgcgagtggttaatgcaggggtacgccaggtcatgagacgggtcatggaggccactgggaaggggtagaggatataataaggtttagagcagaggtgtaagacaggatccaatttaccttttaaaaggatcccctggctagctatgagggaagaatcgaaataagaagcatgg

SEQ ID NO: 598683 - DNA, 449 bp, Homo sapiens
caccctgctggactacagcctcccagacctctgatgggatgtgtgtgtgtgtgtgtgtgtgtgtgtgtgtgtgtgtggtgtgtatatgtgtctagaccaccccacgaggtgctatgcatgttctctatgcatgaaaatgcattctatagggcacagggttgttcgccggggtgatgtggcaccacattcactatgcatatcacacatttgcttcatgtacattgcatttgtcctaaatgtagagtgtacattgtatatattgtatgacatgtgtcgtgtatatgcatggctgttgtctgcatgcaactcgtatagcaccttccctctgtctcacatttatgctgcatgtgccctgcatgtgggttattgtatatgtgtatcatgggtgcggcattcctgtagaatgtctattgtgtatcgcacatatcttgggtactaacgctttggca

SEQ ID NO: 598684 - DNA, 196 bp, Homo sapiens
cccaaggaacatctcaccaatttcaaatcggatctccttggctcaacagctgaagactgacgctgcccaatcgctttggaagctccgggactatcacggaccccgagcttcgagtaactcttacagtggagggtagcaccggtcaaagacttcttgtgtggtaaacacttaggataaagtgcacaggcgattgctt

SEQ ID NO: 598685 - DNA, 1831 bp, Homo sapiens
  misc_feature (1009)..(1009): n is a, c, g, or t
gcgcgtgctcatgacaggcgcgatgggagttcaggtggtggatcctggaacgtactaacacgagtctggacgtcgggcacggtgcatcacgatgtgctagagagaccgtgcattgctcacgacagaggttagcaactcccttgctgacagcgaacgcacagtgagctacaagcgtgaccacattcgtacattaactacagtagcatgcgctctgtgtgctacagtacagggccccaacgtgctacgagcctagcgatggtagctcctggaacctaacgcgaatctggagcacaattgtcatcagagccagcatacggggcggaataccacaatcggggcacacggcagcatgccccaagtggcctccaagtgcagcgagccctgcgtggcgatgggcgcactaaacgaatgggtgctgacaataccaaggcggggacacttcgagcggatcacgtgcgcaggccaagcaagcgacgaaagcaacccgtcagaaattgccccccgctcgccatcgacccccgttcggaacacaccgcggcacccccacacggttgacaagccaggcggcctccgaatgccacaacggaccccccctggtgagcgcggcctaacccacccgcgcactgacggggcatccccgccgggggggctcgggagcaacttgcggcccacaaagaagctcgccccaacagaggacctcccagcgccaacgtcgagccaacgccctgcggacagagctaattgcccgcacaccacgcaaccggggcacacacctacggggccccgcccaagtacgacgcgaaaaaacgccggcgatcagcaggatgggagccccactcgaactccgctcccccggtcaccaacggagccaacccaagcttccggcacacgtgccctccccctgcacacacaccgccaacggacacggcgtcgaacacccatctggacaccctgggtcacccactccgccgcaacaccgacggcccccatcccgcacaccaaaacacgncaggggcgaccacacagaccctctgcgcacgcgcgcagccccccaccctgcccgcagcgccccacccacagcgaccctgccacagcgcctcccgccaccgccgcacgccaccacgccccccggccacagcacagcgcacccccacacaaccgccgccacacagcccctgcggccccccaccacggccgcacccctcccccacgacatcacaccaccaaccccctgacacagcccccccccaccaacgccgacgaccagcggcaaccagcaccagaccggtcgacaaccacgcaacgaccaacgcccccaccaccacaccccgccccccaccacacagccgcacacaacagcgccccagcacccccggcacgccccagcctcgcccagctgccccacccgcgcgcaacacaccaccacaccgcacccccacgcctcacgccgcccgcgccccgccccacgcgcagcgcacttcccgcgcaccaccacccgcagcgctcccggccccctcccagctcactgtcaagtatgttcacctcgctcccctccgacccacgaccacccaacgcactcactcgcagaccgccacccacacgccaccgccgtaccccctaccccagcacaccgccccccgccacccaacacactagcacccgactcaccgacgaccgccaccgcgacaccacgaccaccgccacgccacccccaaccgacgaccacgccgcacccaccgcaccgaccaccgacaacccccgctacgcgcacagcagccacagcaccaaccggcagcccgccctccaccaccgccccgactgcccaccgccc

SEQ ID NO: 598686 - DNA, 124 bp, Homo sapiens
agtctatactgtggtgtaccgtccccttcttctaagacattcccatctctcctccatttgttcccatttcattccctgccgagcagaataaaaagacaccagatggatcaaaaagcttctccac

SEQ ID NO: 598687 - DNA, 537 bp, Homo sapiens
ggcgcatcgcctcccacaggccagcgtgaaagggctggggctggcacgagagcggcttggccaggctaggctggcctcagggactagtgggccaggagaacgcgcgagaggcatgtggctgtccatagtagacattaatcgaaagcaagaaaatggctggaagagctgtcttgttgggaggacctcctggaacgtggcttagaaaaggttctggctctggctattgctcaggagacctgggtagtaagggtccccttctgcccaaatggttgggggcagtgtaaagctttactcaaactgtacgtatcaagaagcatcagagagtgactgatggagcaacttccgggagggttcattggtgctgcgaagtaatcggagagccaacggcaaggtttatgaagggtgaagttcgcaggaagctaagctccgaggtggaatcaggaggaagcccggtgggaggatatggcaaagccgttaggccattgtgatcataggatctcgaaaagagccaagggaagccagacagttgatgctgga

SEQ ID NO: 598688 - DNA, 169 bp, Homo sapiens
gggggttttttttttttgaaaaggggcccccccggggggggggggggggtccctctaaacaaaaacccccccccgtgggggggggcccccccctttttcccccctggggttttttttgggggttttggacccccccctttttgggcccaaaatgggcccttttttttta

SEQ ID NO: 598689 - DNA, 706 bp, Homo sapiens
taatgggcttgggtgagggaggtaggtggtagttggtgttaaatattttaagtggggtgatgaggaatagtgtaaggagtatgggggtaatatggggggtggtggggtaaatgagtgaggcaggactcccgaggaggtaagtggtggcaattaaaaagtgattaaggatactagtataagagactcaggttcgcccttacaggtgtgggtgtatggttactcattggtttggaggtacagttggatatagacatggtgggggtggctgatatagccggttcgtcgatgagatattgggaggtgggggaccaatagagggaggctgtggcagtgtgtgcaagaacaataactttaaccacaacagcctgtcaggccccctttggggcacccacctggccttgtgaggacacgccggtgaaggacacccttgaggcctcacttggtccctgccccgtttcccccaggcaggtctcaggaacgtgccaatgggttccggggccccgggtcttacagagcaagtagccgccatgaggccctcagtagatgtcggcttggccacgtggcgctccaccagttgtctctgatgcaggtaccccctataaacccgcccactgggggcccttaaccctcttccttcatgtccccatttctttgggcctcttcccccaactcggggccatccccacgcttcctcctctcttcccag

SEQ ID NO: 598690 - DNA, 244 bp, Homo sapiens
tagatatggggtcttgccatgttgcccaggctggacttgaactcttggcctcaagtgatcctcccacttcagcctcccgaatcgccaggactacaggtgcctgcaattgtacccagctcgggacacaattcttacattttcttttcttttctttatttttttgaggcagagtctcgctctgtcacctaagctggagtgcagtggcatgatctcagctcaatgcaacctccgcctgcgtcgacgc

SEQ ID NO: 598691 - DNA, 389 bp, Homo sapiens
tagctctgcttttggctggtacgttcctaggatcggggctgcttatgcctttcgtttatccttggggtttgagagcgctgtatttgggagagagtttaaaaatacattaggagagaggaaccattaaaaggttcgctgtcagagatattgtaggtggtaagactggatttcgtctcgggtttaatttcttttatgggtctgtgagtcattcaacagatcccataagtatgggttaatattttaattgggtaaaactcattgggtactttgcagcctgtaatagtgggtctgcgttttcaacctggtgcaataactgtgctggaatattaacgcattaagaaaacttttcttaagcgagaagaaaaaaaaagagaaaaaaagggaaggtg

SEQ ID NO: 598692 - DNA, 155 bp, Homo sapiens
tgcggcgggttggtggtacgcgagtgtgacgataacctgaaggccctagcgacagccctttgctttctacttcctttctggcaggtggcggctttcccgtaagctataatcggggctccttaggcgtccgatttagtctttcggcacctcgcccc

SEQ ID NO: 598693 - DNA, 187 bp, Homo sapiens
caagctgattcttgagtatagacgactcatttcagatcgagaacggactgatacagcatccatcataaaaatgtattaatgaacatgatgacaactcttgaaacaaatgagggctcagggcaatataaagaagaaacaaatggctggctcatgcctgtaatcctagcaattttggaggccaaggtgg

SEQ ID NO: 598694 - DNA, 118 bp, Homo sapiens
cccaggcatcttgctcagaagttttctcatgaggagattgcatggcgaccgtcacagcgctgcgccgacagtgcccccgctgtcactgggatcaccttcctgccattgggccagcggg

SEQ ID NO: 598695 - DNA, 317 bp, Homo sapiens
cttttttcccctaaccatttaaaaatgtagaaaccagactgggtgcagtcgtcacgcctgtaatcccagcactttcgggggccagagcgggtggctggcttgagcccaggagttcaagaccagcctgggcaacatggcaaaaccccgccatctctaatcaaaatacaagacaatgagctgggtgtggtggcacctacctgtggtcccaactacttgggaggctgaggtgggaggatcacttgagcccaggaggtggaggctgcagtgagctgagatcgcaccactacactcactccacagagcaagaccccatctca

SEQ ID NO: 598696 - DNA, 187 bp, Homo sapiens
gaggactacagttcctgatttccaggccagtccctgatccctgacctaatgttagtcgcggaatgatgaggctggccagtgcccagcagtgagggagctgacctcaggggccgagactagagaggcactcaaggaggatccaagagctgactatgcctgcattgctgataacaaacccatctgagca

SEQ ID NO: 598697 - DNA, 259 bp, Homo sapiens
ggatcccgcgatgacttctgctctcaacttggacacatctagtttgcctgggggccttcatttctcaggaccaaaggtggaaggaggtgtgaaaggaggtcagattgggactccagggctccctgggctggaagtggtggtctggggcccttcaagggtcaacttgggaaaaggtgggattcttgggaacaaaggtaaacaatttccccttaaacaatggaaaggattcccccaagaatttttaaccctttcttccttg

SEQ ID NO: 598698 - DNA, 191 bp, Homo sapiens
acagctcgatttgttcgaccacgagggctatcacaatctgccggaggagtggatagaagagctcagattcgtattcgaagagccgcaccgcacaatcgtcatgcacaacgtgcccttcgatattcaagttaccttcggtgaggggttcgatttcaacgcgaacagcttctgtacgcaaattcttgcccacc

SEQ ID NO: 598699 - DNA, 771 bp, Homo sapiens
  misc_feature (38)..(38): n is a, c, g, or t
  misc_feature (41)..(41): n is a, c, g, or t
agcctgctgactttgcagtggctcccctgcctcagcgnttncgcagagcctcctcttttctggacaagatggcaacccttaaggagaagctcattgcgtccgttgcagatgatgaggctgccgtcccgaacaacaagatcactgtagtgggcgttggacaagtgggtatggcatgtgcatcagcattctgggaaagtctctggctgatgaacttgccctggtggatgtgttggaagacaagctcaaaggagagatgatggacctgcagcacgggagcttgttcctccagactccgaaaattgtggccgataaagattactctgtgacagccaactctaagattgtggtggtgacggcaggagtccgccagcaggagggggagagtcggctcaacctggtgcagagaaatgtcaacgtgttcaagttcatcattcctcagatcgtcaagtacagccctgactgcaccatcatcgtggtttccaacccagtggatattctgacttacgtcacctggaaactgagcgggctacctaagcaccgtgtgattggaagcggatcaatctggattctgctcgattccgctacctcatggcagagaagcttggcattcatcccagcagctgccacggatggatcctgggcgagcatggagactccagtgtggctgtgtggagcggggtgaatgtggcaggagtctccctccaggaactgaatccagaaatggggacagacaatgacagtgagaactggaaggaggtgcataagatggtg

SEQ ID NO: 598700 - DNA, 1329 bp, Homo sapiens
  misc_feature (781)..(781): n is a, c, g, or t
agcggaagcgcagcccgaccccgcgcagcgggtagagccaggagccagcgcagcctacggccccgcagctacaagcctacgtaccccgccgccgccgccgccgacgcgccctcggggcatggcctgtctgatggcccgcgtaactcgagtctggcaccagcccctgacatagctattcttttgtatcgactttctctgggaaaatctgtcgctcgcgtgctcatcgtatttcacgacgctggttcttaacgcgtaggtgggtgcgtttcaggtgatcagtcccggtgatactacgggggcgagttttggggctggtcatctgccttgcaattactgatggatattacaacttctcgatggccaaaatcttctctaattctacattacaaccaacccatgcttcccgcccaggctaaagctagtctaatatgcaccattttacacattcatgctaaccttataccaatgtgctgggacctgctgtaaaatttcgaagttttatttctacgcgccacttaaactttaacctaaagggcttatccaatcgctataatatgggacgcatatattcccgattctacactgggctctgcaactacaatattatgcctaacaatgtgcaatgctccgaaaaatacttgcgggctcacacgcaatataactgtctctttaaatgtgtacttactttcgttatgaaaagcgctgcgcggaggagccaaagaggcgcaacgcggttaggggttctcacccttttttttccacgttttatattgtacgacanaggctcccggatttcccaacgtggaccacacatcgtcgttcctcgttccggctcctcaattgcttccttcatttgtgatcgcgcttttcggcgttgccagttggagtcacagtcggctaagacttttagcggacactctttcacgggtctattggggatcattcactcgatcggttgcgataacccggcggctgacacgccaaccctattctcccgcgtcgctactccacccgcacgatcacgtcatgcgacacctccatccttccccgggcggaggatcacgtccctttccgcactgccactctcacacttaatctctggcggcgctacatctcaatcacgcgtcattacgcctggtatacgcgtcttttgtccaattcttccttggcacccgcgtttgcctttgcgttgccgccacttgccttgggggctcatgcacagactactctcgttctgccggcctcttccaaacccgcttgcggctcgcggcgcttttatacgtcctggcaaccttctctacttctccacatctctactacttcgtcatc

SEQ ID NO: 598701 - DNA, 190 bp, Homo sapiens
taaaagggtcttaaaaggtatttaaataggtggaggcgggacgaaaatagggcaccatcagaataaaggcaggcaatatatttacggtcagatgaaacaggggtgtccataaatcaacaaaaagaccatctcctcctttgagggaaatacatggtatggcttacgccagtcaccaataaggtaaacggtc

SEQ ID NO: 598702 - DNA, 102 bp, Homo sapiens
ggaatgactgcagtagctggctctactgcgcgtttttctgcttgctggggaggctttgcattccagtataacagcagctcggtttcgatcaggccgttgcat

SEQ ID NO: 598703 - DNA, 371 bp, Homo sapiens
ttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttca

SEQ ID NO: 598704 - DNA, 342 bp, Homo sapiens
  misc_feature (339)..(339): n is a, c, g, or t
  misc_feature (342)..(342): n is a, c, g, or t
aataggggtggtggtaatgctttgtacatcatcagttatgagtagggattggctagtgtagttctgtcaggccaatgattataagagagacatttaattgtttggacactcagactgtatacataaacttattttttgattgagtgtgaacgcatttatatgtctgtgatcgagaaagtaatcatattctaaacttattatacctatagtcaataccatgtctgatgtgactcaaatcacgtcttcttgcttgctgaggactgtggatagactgatgacaatatgcttgacgctagtgttgctgtgtcttttagcagctctgtgagatactttcgctgngtn

SEQ ID NO: 598705 - DNA, 342 bp, Homo sapiens
atttaaatttaaaggaaatgggatgaaaaattcattttttcaattgcattagccccattttggggattcatgggggggggagattttgtattagcccaaaaaaatggaacatttccctccccccagaaagttttgttgggcagcccggcattagaaaattttcaaacgggttttccccaattaatttttggggttaagggggaggttttcattggaggggtcaaaatgttccctgaaccctttcaaggacccaattggatgttttttgtatcccctcccccaaaaatttcgcttgggtcattttttttgcggcttcctaaaaagtttgttttcctcctcaga

SEQ ID NO: 598706 - DNA, 1068 bp, Homo sapiens
  misc_feature (220)..(220): n is a, c, g, or t
gattcctgtaatgggtgcttcctagaagcgtaatgtacgaactcgtctccaacaggatacttaggttgcaccgagtgtatttggtagaacaggagcatgattcctgtaatggctgcttcctagaaggtcgtgtcacgtggaacctcttaatctcagcatccggagctccaggaagggaacaatttcaagtcagatagaattctatatataccatttcttnggaaccttcagccctcaagattccaacatcatgacctcagtttcaacacagtgtgtccttagtcctcatgtcactgctttggtgctgcctgttgtggaagcagtagaagccggtgatgcaatcgccctttgttaggtgtggttctcagcattacaggcatttgtgcctgcttgggggtatatgcacgaaaaagaaatggacagatgtgactttgaaaggcctactgagtcaaacctcaccctgaaaacctttgcgctttagaggctaaacctgagatttggtgtgtgaaaggttccaagaatcagtaaataagggagtttcacattttttcattgtttccatgaaatgggaacaaaacatacatttataaattgaaaacaagaatgttttctttacaacaaataatgcacagaaaaatgcaggctataattggctagttaggtagtcaaagaagtaagatggctgaaattaacataagtaatatttcataatcttagaattctctcaaagcatgtgacataggaagaaggagagttcttgcccagaatcttaggaaatcacactggtcggttataatcagatgcctcctgaatcgttgaggagtcttcttgaattagatttttgttttggttgtctccccagttaatatgtatatttagatatccagagagtcagcgcgatcaaaggaacaacttttatctctagggaaacaacatctagagaaactgtattcagtgtatctaatactgtaatgcggtaaaatatgtcaatgttacacaactaaactatagacagtgacatggaaaagagatgtaatgttttgaagtaaaacttcatattcactgagt

SEQ ID NO: 598707 - DNA, 401 bp, Homo sapiens
  misc_feature (250)..(250): n is a, c, g, or t
ggcctggtcacatgctctccgtgcagcagcgtcacggggacggggcgcatggtggtaacacgtctatcctgagcctgtggccgcgaggacggagggaacaaggctgatgctacaaacacggcaacgacgctggggacgggacgcgacggcggacagccggcgaacggacggacacgacgcgaccgcgacggggaccggggacacacggaacggggggggaacggcaagcaaaaaaggggacctccaaggntctcccgacgggaggttaataccaagaaccatgtgtgccgagcgtgtgggccagttcatgaccctggtttgggtgtgggccaccttttgacccggcgcgggggaccgatgccaccaaaccacccgagggtccccaagacaggagctcccag

SEQ ID NO: 598708 - DNA, 911 bp, Homo sapiens
taacaaggtctgactgcgaaagaagtatctgtgtgataagggcgtccgctgcgccgaacaggcttaccattcatgggcatctactcgatcaaggaagattaggactgactaaccaagcagaggccgagacagggtgggccgtggcgcaatacgagagactactacatccgtgtacctggagcatccaacgggtggacacaccatggctcctggtgcgcgagagtttgctgggagcacgtgagccctccaggaggcaggaagagttcgcgtcgcctggcatgccctcccaagatgtcatatgcaagtcaatcatccgacagagcatctgccctctctatctttgggggggccacagacatatgcagagaaggtcattgccatgcctgtgctgtgggggctcccggaaagaagcttcctggatggatttactcgacgcagatggcaggactatcaaagctgttgcagtgctgacggcgcgtaccctgcgggacatggcaacgctctcacagactctctggaaggttcgatgggaggaagtgtttctcccagttgggggtgataccacgttctgtgtgaaaaacgtcgggacaaggacaagctggacgtgacacgggctcggttgatgaacgggaacccttgcgtgcccggatagttgtcagcatggtacggggcgtggagacgattgtgatcctgggccgactgggtggttggtcgtctgttgtgaccgagattgagacgaaagatgcgatcaagaatgaccggggtggctcactccacgaaggccatggagtgagcagaacatgtctatggcgagggcggggatcaccacaggctgaatggcgtgctccggacggggtgctgcaataatgttcgcgcgggatgcacacaggggagggcccttgtgtaggcaa

SEQ ID NO: 598709 - DNA, 262 bp, Homo sapiens
aggcattggcgtgggccgccgtgatatctagggaattgtgcgtcacactgagccttgtctggagtgcctgtgggtccagggcctcatgcctgtgcccttatatgacccattgtttgcctgtgtcccaccattgaccctgtttgtgcccgggcttggaggacaaggcgtgaggagagctgggctctgagagtggcgctattcagctgtgtctcgtccctggaccccttgatttctggtggcagtgtggggtctgcacgtggtg

SEQ ID NO: 598710 - DNA, 310 bp, Homo sapiens
gggggggcccccccccccgggggggggggggggccccccccccctttttggggggaaaacccccccccttccccccccccgggaggggggggcccccccccgggggggggggggggggggggcccccccggctttccccccggtttttttttttttttttttggggggggggggggccccgggggggccttttttcccccccccctttttttttttttttttttttttttttcccccccccccggggggggggggtttttttgtttttttccctgttttttttttttttttaatttttttttttccccca

SEQ ID NO: 598711 - DNA, 546 bp, Homo sapiens
  misc_feature (154)..(154): n is a, c, g, or t
  misc_feature (168)..(168): n is a, c, g, or t
  misc_feature (215)..(215): n is a, c, g, or t
  misc_feature (224)..(224): n is a, c, g, or t
gagtcccaggcttcctcaagcatcatttctctaggatactgtattatcccctgtagggccttattttctatctctacttaactcccctaaaacatgttatgtcagacagcatctaagataagtcacatagtgcagtatttatgatgccgtgatngctgtcattacttntttatcaattacagaaaaaaacccttcaataaaataaaccaatctgnatatacttngttaacatcaaaggtttttaaaactgatttttttctcctagaatgcatcctaagcattaacttcttcaacctaaatgatgcctcaagtcatgcaattttctctacatatatgacaaaataaggaatatacatacagataaacatacataataagtgaagacaccatacacacgctcctaaaaggtatgcagacagacatttcctaattcacatagacttcttacaaatacttacaaaggtacactcttcaaaggccaagtaacaaccaccattacctttaacaaaaaagcttttttttcaattataggaaaggcttattata

SEQ ID NO: 598712 - DNA, 222 bp, Homo sapiens
ggagttaaagcccccacgtgccagcggggctttaggcagttacagcaggacaaaatctggtatttgtgaatatttctaaatgtgcaatacaacatgggaggagagcgtgtccggctccagcccagcccgctggtcactttccaccctctctccacctgcctctggttctcaggcctctgctctccgacctctctcctctgaaaccctcctccaactctgcag

SEQ ID NO: 598713 - DNA, 851 bp, Homo sapiens
tatgcgtctgagctatgatatcaatgggcttcctaggcgtcgatcgtgtgaggcacggccatatatttacagtcaggaatagacgtagacgacacgagacatattgtcacctccggtagcataatcatcgctatccccaaccggggtctcagtgttatagctgactcgctacactcgcacggaagcacagtatgaaatgatctgctgcagtgtgtctgagtcctaggcattgcatctgtatctgtttcaccgtatcgtggcctgtagctgtgcatgtgtattacgcaagagctcatcactagacatcgtacttagacgagacgtactacgttgtaggcctcagttcgactatgtcctatcaataggagctgtattggccatcataggaggcgttcgttcactgatttcccctattctcaggactatgaccgctagaggaaacctacgccgaaaatccgatttcgctatcatcttcatcggcgtagatctaagcttactgcccacaaacttagctcggggtatccggaatgcccgacgttactcggagtacgccgatgcatacagcagagtgaaacatcctatgatcttgtaggctcatttcatttcctcttaacaagacagtacctatttaagtactccacatgattttgagaacgcctcggttccgaaggcgatgagtcctaatagtagaaagaaccgtccataaagctggagtgactattttggttgccccacctacagagatcgagagaacccgtttggtaagtcttgcacgacagaatgaggagggccaaacgctggggcggtcggcacgaaacttacacaaattcggcggcccgggtcaaagcaca

SEQ ID NO: 598714 - DNA, 714 bp, Homo sapiens
tattggcggggggggtatgcgaattgtcggctctgactgtgttgccagcctgtgttgttttgatgatctccctctctggatgttcgggaaatttgggttcaaaaaaactagtcgtgtgggtttagtttgaacaacctatcgcgcaataaagccgcgcgcgtagtccgcctctatggtggccatacgaagctccgaggtaggataatcgtgtctctcgtgttcgctctaacgcgtaagttgacgtgtcgctgaggtgcacatccacctccattggctattcagaggatggtccccacatctaagtgagtcgtccacgtcttacatagactcactccctgatgactccacacacgctcgttcagtatggtaagccagtaacagagccgggcgggcggtgttcggatacacacgtgaacacattcccacactgggtctcgagaataggaggttgccccaagatagaggcacttcagtggggtgctctctcctcgtgtttatctggtgaaactataacgaattgaggggtgcgggccgcaatagaattatctctctctcttgcgggtgactctttgttatcacgccgcgcgcgcggctaggttgagttctccgggtggcatccccacatacttctggctgcatccaccacctgctctgctacctgcgttaacgtcggttctaatgtaacccaaccggaacaatacaatagaacgaaaa

SEQ ID NO: 598715 - DNA, 591 bp, Homo sapiens
  misc_feature (43)..(43): n is a, c, g, or t
  misc_feature (85)..(85): n is a, c, g, or t
  misc_feature (427)..(427): n is a, c, g, or t
ctgggccctgctgctcatgatcctgcatccagagtgtgcagcncagagtccaacaagaaatcgatgaggtcatagggcaggtgangcatccagagatggcagaccaggcccacatgccctacaccaatgctgtcattcatgaggtgcagcgctttggggacattgttccactgcatttgccacgcatcacaagtcgtgacattgaagtgcaggacttcctcatccccaagggacgatcctcctccccaacatgtcctctgtgcatatggatgacactgtctgggagaagcccctccgcttccatcctgaacacttcctggatcccagggccactttgtgaagcatgaggcctttataacattttcagcaggccgcagatcatgcctgggggacccctggcccgaatggagctcttcctcttcttcancctgcctcctgcagcgctttagcttctcagtgcctgatggacagccccagcccagtgaccatagagtcttttctattatggttgccccctccccctaccagctctgtgctgtgatacgtgagcaaggacactaattccatacaggctctgcagggaaggctgtg

SEQ ID NO: 598716 - DNA, 148 bp, Homo sapiens
ttcagccggtatccctgcactgatggagcagaagcaggcactgctaccccggctggctgtctgctggctctcacgccaggcattattctgggcctggctgtcgcagatagtgggatcacataacgctgcatgtccatggcatcttggc

SEQ ID NO: 598717 - DNA, 193 bp, Homo sapiens
gcctagaggaccggtcattcagtcatctttcatactatgaaggtgcaaacagctatataattgctacgagaatattactgacaacaaccctacataatataaaacacacgcgtagaagtggttggagttgcctgtacaggatcctaaatagttctgctagtgtttttgtcccacggctgaagttttttacttc

SEQ ID NO: 598718 - DNA, 326 bp, Homo sapiens
aggagtaggcaggcaggagaatatttcaacctggtagtggaggttgcagtgagccgagatcgagccattgcactcaaacctgggggataagagtgagacttctctcaaaaaaaaaaaaaaaaaaaaaaaaaaaaaaaaaaaaaattaaatttcggggcgggctttgggggcccagggttgtatccccagcttttgggaaccccagggtgggtgactctcaccctgtggaggccaggaaacagaacacctgtgcctgcgggggattcccgaagcttcgaattccgaaacttctgtggccaatagcttgtttcccgtggtatgacaat

SEQ ID NO: 598719 - DNA, 894 bp, Homo sapiens
  misc_feature (1)..(1): n is a, c, g, or t
  misc_feature (106)..(106): n is a, c, g, or t
  misc_feature (108)..(109): n is a, c, g, or t
  misc_feature (113)..(113): n is a, c, g, or t
  misc_feature (134)..(134): n is a, c, g, or t
  misc_feature (150)..(150): n is a, c, g, or t
  misc_feature (156)..(156): n is a, c, g, or t
  misc_feature (168)..(168): n is a, c, g, or t
  misc_feature (184)..(185): n is a, c, g, or t
  misc_feature (192)..(193): n is a, c, g, or t
  misc_feature (198)..(198): n is a, c, g, or t
  misc_feature (200)..(200): n is a, c, g, or t
  misc_feature (208)..(208): n is a, c, g, or t
  misc_feature (228)..(228): n is a, c, g, or t
  misc_feature (254)..(254): n is a, c, g, or t
  misc_feature (263)..(263): n is a, c, g, or t
  misc_feature (275)..(275): n is a, c, g, or t
  misc_feature (295)..(296): n is a, c, g, or t
  misc_feature (308)..(308): n is a, c, g, or t
  misc_feature (315)..(315): n is a, c, g, or t
  misc_feature (322)..(322): n is a, c, g, or t
  misc_feature (332)..(332): n is a, c, g, or t
  misc_feature (336)..(336): n is a, c, g, or t
  misc_feature (374)..(374): n is a, c, g, or t
  misc_feature (378)..(378): n is a, c, g, or t
  misc_feature (380)..(380): n is a, c, g, or t
  misc_feature (417)..(417): n is a, c, g, or t
  misc_feature (462)..(465): n is a, c, g, or t
  misc_feature (492)..(493): n is a, c, g, or t
  misc_feature (854)..(854): n is a, c, g, or t
ntctatttttcttttaatacaatgaatacaaaagcagttgaaatagtacccccacgattacacagctttgaacaagtgaaactatggttaccaaacagctattttnannatancatctacagtgtctggaaaangatgtaacaataaatncctgtngacgcatcacgngacatccatttacttnntcacagnngtggntnttgctacntagttttctcaatgtcttcnttcttcagattctccaggcttacgantgtcatcantcttcaaaatcnttctaaccatttgtgttgcnngggatatctgtngcttttngccaatnaaggtttctntganatgctgttgcttcatatcatttgtgcccttgtgcaaanggtngntgccaagggcggggttcatctccttcacctgtttggntcgggcttcggtcatagtctggttgggttttatgccactgttttnnnngggggccatggggttgacctccagtgnnttggcaaacgctctcatggcatactgttctttggtggggcacttatccgcctcttggctaactgccagggcacaggatatctcagcagcccctcctccatacaccacacgattatcgcggatgaggttccggatgacacacaaagcatcgtgaagggatcgtttcgcctcctcaatgatcatcttatttcctcctctaataaaaatggttacagctctggagttcttacactgctcgatgaccagcattttatccttagttgtccaaatgagatctcctgtacaagaccagcaaagcccagcttctcggctgtgagctctgagaacctggggacgatccgccctcctgttgcgatggcatnagctcaatttcaggtctcctacccagcgaacgcagcaagt

SEQ ID NO: 598720 - DNA, 381 bp, Homo sapiens
atgcctgaaccagctaagtcagctcccgccccgaagaagggctccaagaaggcggtgaccaaggcacagaagaaggatggcaagaagcgcaagcgcagccgcaaggagagctattccgtgtacgtgtacaaggtgctgaagcaggtccaccccgacaccggcatctcgtccaaggctatggggattatgaactccttcgtcaacgacattttcgagcgcattgcaggcgaggcttcccgcctggcgcattataacaagcgctcgaccatcacttccagggagatccaaacggctgtgcgcctgctgctacccggggagctggccaaacacgcggtgtcggagggcaccaaggcggtcaccaagtacaccagctccaagtaa

SEQ ID NO: 598721 - DNA, 292 bp, Homo sapiens
agccgcccccatatttgcggagtgtatcaacctctgcttctagtgttgtctacatctaattcagggtcgccataagtgcgactcaatgcgttcttggattgcatatagcatcttccactcagtgtccactagctggacttgtaaattctcaatctggtcagttttcacttgcttgtctaccttcatttcctttgctcccagtatcatagcatcaaccgtggtcttggtatccttcaatgactggatagtgtaattaacttgtttcatgtagaatgactcttgggtgcgatcg

SEQ ID NO: 598722 - DNA, 122 bp, Homo sapiens
  misc_feature (79)..(79): n is a, c, g, or t
  misc_feature (113)..(113): n is a, c, g, or t
tctcgacgactcccgggtgggcgcacgcacggtgtgacgtgacctgcaccctctttttacgacggaccaccacggaccntgggcttaacggacacgggaccacggccactacngcgcccacc

SEQ ID NO: 598723 - DNA, 576 bp, Homo sapiens
  misc_feature (176)..(176): n is a, c, g, or t
  misc_feature (248)..(248): n is a, c, g, or t
  misc_feature (273)..(274): n is a, c, g, or t
  misc_feature (276)..(276): n is a, c, g, or t
  misc_feature (278)..(279): n is a, c, g, or t
  misc_feature (296)..(297): n is a, c, g, or t
  misc_feature (319)..(319): n is a, c, g, or t
  misc_feature (355)..(355): n is a, c, g, or t
  misc_feature (370)..(370): n is a, c, g, or t
  misc_feature (550)..(550): n is a, c, g, or t
ggtttccctttaaaccagatcctggagacagtgagatactcagggcgtgttaacagggagtggtatttgaagtgtccagcagttgcttgaaatgcttgccgaatctgactccagtaagaatgtgggaaaaccccctgtgtgttctgcaagcagggctcttgcaccagcggtctccntcagggtggacctgcttacagagcaagccacgcctctttccgaggtgaaggtgggaccattccttgggaaangattcacagtaaggtttttggttanntngnnttttgtttttaaaaaannggatttcacagtgagaaagttnggttagtgcataccgtggaagggcgccagggtcttngtggatggcatgtgngacattgaccgtgagattcggttcaaaacaatactgccttgtggaatatgacagaatcaatagcccagagagcttagtcaaagagatatcaggtctaccttaacaaggcactttcttaagcagaaaatatgtgtgaggttaccttgtgctgtaaagatccaatcttctaagccaaaaagnatagcaatcctaggataatcacctct

SEQ ID NO: 598724 - DNA, 255 bp, Homo sapiens
aacgggtgatgcggttggcagtatagatattcattaccctaaaactaaaatgtttcagttcctaaaaatgactacctaaattttacccaaaataactagttccattccttgtggagggagccgtaactatctttactgatggctctcagaatggaaaagcagcttatacaggaccggaagaaaagattattcaaactcagtttcattctgcacaaagagctgagctacaaagcagttatatctgtatgggaagat

SEQ ID NO: 598725 - DNA, 366 bp, Homo sapiens
atattctttgaaaggcagttagttcaataacttatgagtagatatacactattatcgggcagctttacttattagaaattcttactttcggccggacgcggcgggttatgcctggaatcccagcactttgagagggcgaagcaggaggatcacaaggtcaggagatcgagaccatcctggctaacacggtgaaaccccgtctctactaaaaatacaaaaatttgctggacgtggtggtgcgtgcctgtaatcccagctactcaggaggctgaggcaggagagtcacttgaaccagggagtcggaggttgcagtgagccgagattgcgccactgcactccagcctggcgacagagcaagactccatc

SEQ ID NO: 598726 - DNA, 868 bp, Homo sapiens
cccgaggttaccccgttcaaaggccaatggcacattggtccagtgtgtaatgggatagatttggctcccaatttaggtaaatgagactagaagatttaactagaccgatagtttaggtggatatatttttaaaactcagaaccagtatattggtcctgtgttacccagtttaaaagtgaccgttgaaaaagaaattcccctgaaatgatcatgaggttaaaattttcggtcaataggggacttggagaacccgtagtcgtaagattagttgatagtttcactgccccagccatgaattgctttctgtgtgtttcccccgtaggactcccatagtaaatagctgtctgtcttacaccatttataaggagccctgcacagacgacgacccaaggcctcttggcctgtggctactaaacccagagagcctattagaaaattttctttctttaaaacttgtttttttctcctttccacgctaagtgtcaccactttggaataaattttataaaaagaaaaagtaaattaccccgttgtgttttccacgaaccacctataaattggcggtgtattcttaaattcacgttaaaatattaattagtagaccctggatttttcccccttgaccccactcacgtctataaaaggttaaaactgccaacttttatgaaaatggtctttaatatttcccaccaataatccctgtgctataatttgttttatagaacaccaagtaactcttataccacttccaagacctttacgaggattttttaaatccctgtattgttggatccaattaataaagatgcccaccaaactttatagagatgttaaaaccaaactataatggatctcctatttttcttta

SEQ ID NO: 598727 - DNA, 388 bp, Homo sapiens
agcagacagttgtaacaagaaagtgctcagatagggtctagcccggctttcacagttctagaggtggacaactgatccctgtagtagctgactggcacagtcaagcaggctttggcaagagtgccccccgacagctattaggattacccacaggcactccttgtcataaggccatcgtctcagtcagtgctggcaaataaagggtttaatattttggttttaatctggagttacaatcttagttttaatttggacccaggttgctaggtgatgcctgccacaggagttcgggacatccgctggccatcctttgacttgcatgtccggccagttgtcagctggagaagcgcagcagcttgtgcacaattcggcacgagctcgtgccgaa

SEQ ID NO: 598728 - DNA, 121 bp, Homo sapiens
ggtggcatgtgctgtaatcccagctactcaggaagtgaggcagagaatcgtttgacccagaggtgaggttgagtagccaacattgactactggctattcctgggaaaagaggatctctgct

SEQ ID NO: 598729 - DNA, 117 bp, Homo sapiens
gaacagaatgaagagggatctcacaagacacctgttatcctcttctatacaccctatctcttcccacccccagcttccctttgacccacaaagttcccatgtgcctgtaccctcccc

SEQ ID NO: 598730 - DNA, 332 bp, Homo sapiens
  misc_feature (134)..(134): n is a, c, g, or t
cccagggggaaaagggggggggggttttgggcccggggaagggcccaggggggcaggggtccagggggacccgctgaggtcttttttggggagaaacgcccggttgggccgggcgggggggggccggttttttnaaccccccccctcccggggggggggggggttccccccccctttggggggcttgggccccttttagacccgggggggggggaagccccccggcccttgggcccccggggggggggttgggtcccctccggggagggggggggggggtttttttttttttttccttttttttttttcaataaaagggttttaaaccccca

SEQ ID NO: 598731 - DNA, 210 bp, Homo sapiens
gagaatccgaagatctggtgtgtcttattttgtattctctgtgtaaacagtgactataactaagtgtagtggattgattaaagaactatcaggcagacaggtatgtagtatccatgactactcttaaccatgcagactaataatattctggaggtatatagctcggcaccttcaccctttatttcactgggtatttcatgtaacggcatc

SEQ ID NO: 598732 - DNA, 424 bp, Homo sapiens
  misc_feature (400)..(400): n is a, c, g, or t
ctgctccgcccctctctggagacggggatcaatagtgtactggtgattgaccaggcactcagcacatgcgtggagcacacagtgcagggctgtggtggggaggtgggctgagttcctagggagtcacccatgtgtgcctgccgttctgaccagccaccaggccctcagggcagagcccactaccagcagcagctcacaccccaagaccagctcagaggcggcccctacctcagcagcagggacatcacagacactttgagctggcactagggtggcttctccagctcccacggggagaggggtcccagctgagtcccactcacgtggagtctcatgcccatgaaagtgccattcaccactggccaggctcatgaggccgcatgagaggggggtcactggngaggagatatcgggggaacaagag

SEQ ID NO: 598733 - DNA, 252 bp, Homo sapiens
ataagctctgtttttgtgcctgattgccattacagcggatgccagagaaagaaagagcttgggtgagcccatgatgaacttgcacacgagtaatgggaactaaggcagtgcctgttcccattgtgagtgggggtagagagcacatgtatcacctggaagatggcaaagaagacaggggtttagaatatacatcccagctgtggtgtggaggaagcacatgtggaacagggtgattgaatatttggtggtagg

SEQ ID NO: 598734 - DNA, 111 bp, Homo sapiens
gatacttagcattctattgggagaaaagcaaatcgcacaatgacatattttgaggtaatagccatattttgcaccaggggggacaatttgggccaataatatctgccatct

SEQ ID NO: 598735 - DNA, 349 bp, Homo sapiens
  misc_feature (2)..(2): n is a, c, g, or t
tnttatgagtgttactatgtgccatagactgctttagacattttctatgtattaatagattcaagtttgaaacaactctatgaggtagataacattattgtcctgtgtttaataagggaaactaaggcatagagaggttaaattacatgccccaaatcacatcccactttatttttaaagcaaggtttagaaaacatatgactgatttatcatgttcgtaagccactgagttctgtcatcctcaagacacagttaacaagcaaaagctgccagagagaaaagggaaggagagagagtatgttagtagaaggacggtaacaccacagtacgacggtaacaccacagtacg

SEQ ID NO: 598736 - DNA, 370 bp, Homo sapiens
tctaatgtttcctcatgattagactgaggttctgggttttggagaggaagaccagaggtcaggtgccattcttgcacatcttatgaagggtcatgctgactttgatcacctgactgaggtaaactttgccagacttctccattgtaaagttactcttttttcttctttctgtactggaccctttggaaggaagtcactgtgtgcagcccacatttaagaattggggaattatgttctacctccttaagggcagaatatctacacaggctttttttttttttttttttttttttttaaacccttggtggaacccaacacttttccccaaccccccgggttgggggtaagggccccaaatcaagggtctccc

SEQ ID NO: 598737 - DNA, 928 bp, Homo sapiens
  misc_feature (771)..(771): n is a, c, g, or t
ggcgctgcagtgatcgtaagccggtgggatgtgacaggtgaactcgctctagggcgatgctgcaagcaatcactatgtcaacagaaatgaggtgtttcccggttccttcatatgaggaaaatcagggctcaacactcattcgaaagagctaaaagaggcaccatccgtagcccgttgaaagtagcgggttttgcacgccaatagtagcatatggagtcataagtaaactgaatgagcaggggaaattactaaaatgtccatttcatctgatccacatgcgtgtgggaaggcccacaggcttggggtggtcaggagcaaggactgtctgggtatggggctattccagtgtatcggggaaattctgggcaaaacctaagccttaggaagaagagagtgctgtcgtatggtcttgttggaggagcttgctttaggacagatgtctgattattaaaggtgtacctatttattgtgttggaaataaactaatttgtatggggttagatggtaacatgggatctggaatatttggttcctttcttgcaggttgggattttgcttgtgtgaccgaaattactagtgactagtttactaactaggtcattccaaggaagtcaagttaacttagaaatggtcagctaaatgacttgaggtgttgaaatgtccaccttccttaaattttaagatgaacttagtctaaacgaagctacagggcaatccgaaaggtctccgcttgctgcacaggtccgaattggggttgctagatccattgcncagtaattcacattggctcctatgtggacgggactggtaaacctgtcacaggcggggacatatgtgagtcccatgtatattggtttcccacacactcacggctgttttacaaccaaacaacgcgtcagatgcgaaacaaccatatacaccggtttac

SEQ ID NO: 598738 - DNA, 173 bp, Homo sapiens
gtcacagaaaatgaggatataagagccaagcccgaatttcgtgtactcaatcacagaggcaatacactatggatgtcatgaatttctaaactccatttaagtcttttgtctctcccatgatgtaaactgagaaaaacagcagcaacctatccctacaaaataactcttataat

SEQ ID NO: 598739 - DNA, 239 bp, Homo sapiens
gaggttgcattatcgaaggaatcacaaaaaagaatagcctcatcagtccgccagcatcatagccagcatcagcctccttaagctctactgctagctacgcgtaatctactccacctcaagtcacactactccccagtatctaacaacgtaaaaataagatgagagtttgaacatacaagacccagcccattcctccccacactcatcgcccttaccacgcaactcgaaagccccaagcg

SEQ ID NO: 598740 - DNA, 166 bp, Homo sapiens
agatgcccagactaaagtctacatgtttctaggactccatttatataaattctacaaaagggcagaactctgcagacagaaagaagatcagcagttgtcaagtgcaaagggtggggagaggagactgacacaaatgggacatgggagaacctcgtcagaagtgacg

SEQ ID NO: 598741 - DNA, 703 bp, Homo sapiens
  misc_feature (10)..(10): n is a, c, g, or t
  misc_feature (59)..(59): n is a, c, g, or t
gttttttaangccccccaggggggggtgccagtgggtggcaggcgccaggggcttcttnactttaaaccacccctagcctctcctattatgcggggggtccccattgatttggattatcctggaggtgaatgggaccctaggggctgagaaattcaaggcttgatttttgaatgccatagaatagggatttttcttccaggcccctctgggaaaaaaggggtggcctgaatccccaaccgcgcatttttaggatttgggaaatggggggtaaagaccccgtttcttttgctgaaaagtttccctttcccctatgggtcataacccatgggagggtccgggggagaacctcttttaaaagaaatttataaaccttgtttgtggggcaaaaactagtttttcccggccaaaaccaggttggttggggtaaaccctgtttttggccccccccctcccaaaaagaggggggtccaaagttttagctttttttcgggttttcccccccaattggtaaaaaaccgggttatattccctttttggtttttccggtttggggggttttttttgcccctcttggggaaaaaagggtttccttttttccctttcccttcccccccctttggggtcccccctttcttcccccccaggggttttagcggttttgggggggctttaaaaaaaaaccccccggggggggtttttcca

SEQ ID NO: 598742 - DNA, 736 bp, Homo sapiens
cacggtggttcacacctacaatcccagcactttgggaggctgaggcgggtgggtcatttgaggtcaggaatttgagaccagcctggccaacatggtgaaaccctatctctactaaaaatacaaaatttagccgggcatggtagcaggcgcctgtaatcccagctacttaggaggctgagacaagagaatagctcaaacctgggaggcagaggttgcagtaaaccgagatggcaccactgcactccagcctgggcaacagagtgaaactccatctcaaaaaaaaaaaaagggaaaaatcatctaatatctgagattttctcaatttaaccaagaaagggcagggctataggttaaaaaaaaatttactaatagatttttaaaatctattactttcttcatgtctgaaatttttccatgatatgctttttaaaaaagaaggtatcggggctaggtgcaggggctcatgcctgtaatcccagtattttgagaggcccagcaggcaccacagcttttgagccccagggattcaaagagttggcctgggcaactttcgcagaaaccctggtccgctacaaagaaacaccaagaataatacacaacagtccactgtgtttacacgcagaaacaacctttgtgtgggcgccttgtgcccctctagaaaaggttttttacacccacatttgtgtggcgcggggggccccatatggtatgtgcaccgtggcacatacaggtgtcc

SEQ ID NO: 598743 - DNA, 421 bp, Homo sapiens
  misc_feature (182)..(182): n is a, c, g, or t
tattcattttttaaaaagggctataaacaagtagcaagatgaataatctggttttctgtgggttaagttacatatcaaaaaatcctaaaatttttcatcattttgatgcactattcttaatttttaaaaactcatggtctgaaagcaagacagatattttaatgctaatatgtaaaaataanccggatttccggtcttgggtctctgtcgttgcctatatatctagatgtctccaaaatattccagattttctgcttttcttaatttcaaatggtccaaatggctaccttttctagaatatttacctattagctgatggtaatggtaaaaagaaaatccggctaattttggcaggattgtgccctacccacaatcctgtcttttctgtgagagtggagaaaaattaaatttgccgaatttc

SEQ ID NO: 598744 - DNA, 439 bp, Homo sapiens
ggataccttgacccagacggggtcactctgatgccttctgaagtgagaaattgatcacgttaccacagctagtcaccactcactgggtgacttcagacaaagaaaattgacgttgtcaccgttccaaagaccagaagtctgagatctaggcgtgagcagggctgcgctaccctggaggctctaggggaggatccttcctgcctctcccagctcctgggggttccaggtgttcctgggcttgtggccacatcactccaatccctgcctccatctccacgtggccgcctcctctgtgtctccaaatctctatctccttgtaaggacactagtaattggatttagggcccaccctaaatctgggatgatctcatctcaagatccttcacttaagtatgtctgcaaggaacctatttctaaataagatcctgtttctacattt

SEQ ID NO: 598745 - DNA, 148 bp, Homo sapiens
tcctgactgaaaaaataaggaaatattggtggcatgtgtatgtataggtgggcatgtggtctgtgtgtgactgcacaagaggggtgcacgtgcaatgcttgcgtgtgtgatgatgtgtccttggacgttgaggaatcccgggggccga

SEQ ID NO: 598746 - DNA, 645 bp, Homo sapiens
caagctgaacgtagaacgatattcctaatgggtgtgtttgcctttttcccccttttgagacagggtctcactctgtcacccaggctggagtgagtggcatgatcatgcctcgctgcgtacttgacctcatgggctcaagcgaccctcctgcctcagcctcctgagtagctgggaccacgggcacatacaacattcccagctaattttttgtatttttgattgatagagatggttttgccacgttgcccaggctggtcttaaactcctgggctcaagtaagattgccgtcctgggattagaggcgtgagctgctgcagcggcctgcttttctttgaagcctgagaaatgttgagggccgggcacagtggttgacacctgtaatcctggcgctttgggaggccgaggttggtgaatcacctgaggttagaagtttgagaccagcctggccaacatggtgaaaccccatctctactaaaaataaaaaaattagctgcgtgtggtggtgggtgcctgtaaccccagctgcttgggagggtgaggcaggagaatcgcttgagcccaggaggtggaggttgcaacgtgagccgagattgcgtcattgcactccagcctgggcgacaagagtgaaactctcactctccctcg

SEQ ID NO: 598747 - DNA, 319 bp, Homo sapiens
  misc_feature (53)..(53): n is a, c, g, or t
  misc_feature (286)..(286): n is a, c, g, or t
  misc_feature (308)..(308): n is a, c, g, or t
ttttgagatgaagttttgctcttgttccccaggctggagtgcaatggcacgantctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgacatcgggcgcccagnctgtgcttattttcttaaaatnaatttttgtat

SEQ ID NO: 598748 - DNA, 396 bp, Homo sapiens
ctggtgcatccagggctgcagcgcacgtcaccggggagaacctgctgccgggcatcgactggctccctggatgacatattccagccgcattttcacagcatgactgaacacactccagactgcccccacgcacctacgcatgtccaggtccctcaacctctcagccaaacactatccatggggggttgggagtcagcacgggacataactaacactccccctccatccaccccagcctgctgcgtgctactgctgcccagctgctgctctgtggccacccaggctcaccatggcgggagggctgtgccctggctgtctctctggctcctgacctggcctttggctaccatacacaagaagagagggctggcggggagaaattctcctgctgctacg

SEQ ID NO: 598749 - DNA, 180 bp, Homo sapiens
ttgggggggcccaggaaccccctgctgggggtggaggctctattcatgacctgcccctttttattgagacatcccccaacctttgccccttggggccctttcccagggcccccccctgttttgcccccctccccccattcccccctttaagaataaataagttttccttttgttttccca

SEQ ID NO: 598750 - DNA, 325 bp, Homo sapiens
  misc_feature (1)..(3): n is a, c, g, or t
  misc_feature (6)..(6): n is a, c, g, or t
nnngangcctagcgtgtctgcccactagcctatgctatagatttgaaatgactttcactttgacatgacacacggtttatattacacaaattgaatgaaacaacactgtctagaaaaaaatgagacagcctgccgacaaaaagatgatgactgcttctttgctcccatcagagaattactcaaaaaggcagtatttaaaggaaactcaaatcagtagaacacgtagtcatcgagatttcagggcaccaagtccttagagcgataacacttttcaacccaagccaggcttcagatgcaagcccactaacagaccctaatttccaca

SEQ ID NO: 598751 - DNA, 195 bp, Homo sapiens
ctgtgataggcttctttgacttaatgtttcagaattcatctatgttgtaacctatatcagtacttctttcctctttatagctgaataatattccattgtgtgggtggaccacaatttgtttatccattcataagtttatgggcactgggttgtttccctctttcggcaatcgtgaataatggcgctataaagatt

SEQ ID NO: 598752 - DNA, 192 bp, Homo sapiens
ggataggggcagggaatacataaggaaagtaggtaactagtcaccagagaactggcaagggaaaaaggacgggggaggcatagaagagcgagaatccaaaaaaaagtagaaatggttaggggagaaaactcccaaaagaccccggcagtacgtacggaggtgagtacgacaactagcaactctatttccttc

SEQ ID NO: 598753 - DNA, 3389 bp, Homo sapiens
ggcacgagggcggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcacggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgaccaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagggtctccccatgagctggggccccagttcccctctaagggctacagcctcctgggtcctgggagccagaactccatgggggcaggaccttgtgctccagggcacccagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactc

SEQ ID NO: 598754 - DNA, 1713 bp, Homo sapiens
ggcacgagggcggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcacggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgaccaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctgtgagtgagacctcatgccacggcctaacttcatgctctggtcttacccgtgaaattttatgtgtagttttgtactgagatagaacataacacatagcaacaattcatgcagtacactgatcctaagtgtgcagcacaatgaatt

SEQ ID NO: 598755 - DNA, 1707 bp, Homo sapiens
  misc_feature (272)..(272): n is a, c, g, or t
  misc_feature (459)..(459): n is a, c, g, or t
tgtggtgaaatccaaactaacacctaaaaaaactgggtttctggaaactattccttaagtctgggggtctcacctataatataatctccctcacctcaaccttatattcagagaggataagggatttcgtgtcgtgaacctcaggatctccatttgggatctcgggtggccataccttatgtgggcaagtgaaaggaattcattatttaaccgtggtcacgtggtcacactcctctcgtgagtctctgtgggatagtgtggagtagataaanataaccatatagcgtggctcccatatatatataaaaatgtggagaaatgtgtggtgttataccccctataaaatgtgtgtcacgatataaactgtgtgggtgtgttctctcccacgagagctctctctcgcgagagctctccatagagagaaaaactctctcgtgcgcgtggggggatatctccccnctttttatatgtgtctcctgtgggaaaagagagaaacaacggtgtgctcgagggctctctcggtgggagataactcctgttgggagaacaccccgtgggttgtgtgtccccccctataaaataaagcagatcttctaataggagttataaggtggggacgcattatgatcgggagctcatctcttataacaccctattaaggatttatacggagagggggaaatattacccccttattctaccggtgtgatcaggggacaccattttttacacgagaaggtgtttataacagccaccggcgaggaaattatcctttctgagcaaggaggaagggggcgacaacaacgaagaagttgttctctttaggagcgacaacacacgtcttctttcatgttggtggggacacgcgaaaacccttatttaggggggggggcgcacccacattcatggtggcgggaacaacaagttgtttctcccaattgtgctcccaacacagccaacaagcaggcaggtagttgttcgtcgacccaccccccctttttttaaaagcacaaaaaaaaaaaaaaatttgccgttactaataacgggggtgggcgaccccacctgtgggggggggaataaaacgtgggggggtgggaataaaatctacagtgggggggagttgaggagtggtgattggaactggaagttaggagtgtagtcaaaaaataggggggagagcaataatgatgggggagttaatcatattttcacacggaattcttatacggttattattattttcgtgttagttcttcacgcgcagatctctatggtttggttataacatcggtgggggaaaaacacactgacggggcaagatcggcacccaacagatggggggaccacaaaagagacatattggtgggtgtgtgtatctatatatgatctccccgcccgcaaaaagaagagaggtgtgtttctcaccacaccgttctccgttgggggacgacaataaatatattgatccgtaagtatagtgatacgatgatagttatgggcaccgcccctgtattattgattcgttttgaatagaaaaaccactcgttgatcgagaagaggagagcgaaaccaagagcagaaacttcatctggggggagaaacattttgtttgtttgccccccacaagatgccgttcggtgtgggataattaaattcaaccaagggggggggggacagctggtatccacaacagaggagggatagtac

SEQ ID NO: 598756 - DNA, 3123 bp, Homo sapiens
ggcacgagggcggagacgccgggagccagtggcgcctgtggctccgggcaggggccgcggccgaaagatgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcacggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgaccaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctgcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcaagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactc

SEQ ID NO: 598757 - DNA, 564 bp, Homo sapiens
gggagagccagcgcgcgcgtacgcgcccgatgcgagggcggccccgtgaccctagtcggccgtggagaggcgcgcggagtctgggccgctgccgtctaggggtcccgtcccgaggtggtccccggcatctccggcccgaatcccggagtgccgggtcgcgcctgctccgagggtcccggtatcctgtgccctcccgtgcaggacgtctaggggaccgttcccgcaaggtccctctttccgctcagtgcagggtcctcgcggcccatgctggaccgactggggacccgcgcagcccagaccgtgtcccgggccggcgcagccggacaccagtggtggcccgtgagtgcctgtgcagcaactccagcggggactaaagggctcagagtgcatggccgaggggcgcgagggtcccgggcctgagccccgcgccatggccggggcatcgcttcccgcatgagcttcatctctctcacgaggaggcaagccaaggacgttcaccgtgaggatcgtcaccgatggacgccgagatggagttcaattgcgagatgaagtggaaggggaagg

SEQ ID NO: 598758 - DNA, 515 bp, Homo sapiens
gtgtggtgttctagaggatccctcacgcccagtacacaagcagacattctttatgtttaatgtacacattttggtttgtatatgttctttttatttacttttctagagacagagtttctctcgttgcccaggctggagtgcaacggcgtgatctcagctcactgcaacaccgtcccctgggttcaaacaattctcctgcctcagcctcccatgtagctgggattacaggcacctgccaccatgcccagctaattttttttttgtatttttagtagagatgaggtttcaccatgttggccaggctggtctccaactcctgaccttaggtgatccacccgccttggcctcccaaagtgctgggattacacggcgtgagccaccatgcctagctatcttattttctataacttatttaaatatattagcccaccaatcagtaacaattaacaaatatttatttagcatcaagtattagatcagctttttccatatctccttcctactctctgacacat

SEQ ID NO: 598759 - DNA, 265 bp, Homo sapiens
tgctgtacgctcgtactgcctggcacacgggatccagcccgactggcagatgccaagtgacaagacattggggagaggcgatgattccttcaacaccttcttcagtgcaccgggtgctggcaagcatgtgccccgggcagtgttatgtagaccttggaccccacacggcatttgctgccgttcgcccgggcacttacccgccaactcttccaccctgacgcaagtcctcacaggcaaggaacgactgctgccaatacactactgc

SEQ ID NO: 598760 - DNA, 417 bp, Homo sapiens
  misc_feature (170)..(171): n is a, c, g, or t
  misc_feature (178)..(178): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (195)..(197): n is a, c, g, or t
  misc_feature (199)..(199): n is a, c, g, or t
  misc_feature (201)..(202): n is a, c, g, or t
  misc_feature (204)..(204): n is a, c, g, or t
tggacagcacagaggagatggacagcacagaggaggtggacagcacagaggaggtggacagcacagaggaggtggacagcacagaggagaggaggtaagagtcagaagcttatgttgtttatgcggggaaacgccatatcgggggcaccgattattaggggaactactcnnttgccanagcctccnctntgntgnnnantnncnatgtcagaagacctattatctaatcgcatgggctgcgacgattactttgttgatgtggtcgttaccttaaagattgcctggctgactccaactcgtctcgcataaggtggcttgagacctgtgcctagtattacgagctcatgcgccggattatcggtatagtcttgctatgtctttgtcccttgctagagcatcatccacggtcgactcaca

SEQ ID NO: 598761 - DNA, 152 bp, Homo sapiens
ggcgcattgagcttggagtcctaggcacagctctaagcctcctttattacgaagccgagctgggccagccaaggcaaccttcataggataacgaaccacatctacatcgttgatcgtcacagcccatgcatttgataataaatcttacttca

SEQ ID NO: 598762 - DNA, 247 bp, Homo sapiens
ctacatgcacaacagcgcattccatctgtccatccaagaccgtaccaaaccgtagcagcttcttccctccggtcaccaaactgcttgcaataggatctcactgaaatgtgggtgcaccagcaataattttaacttggaccagtcacaacgtctcgtcgaacattcttctcctagactacatgtccataataccttacaccttgccaatcgctctagaacacacgccccatgtagctctcacactttc

SEQ ID NO: 598763 - DNA, 170 bp, Homo sapiens
catcccatctccagaaagaacaaccctgtgaagcaaattactagtatcccaatttagaggagtgcaggtggacgctcagagaggttaagtgtcttgtccaaggccactcagctacaaagaggaagagatgaaactcaaaccccagcctgatcccacagaccaagaccttc

SEQ ID NO: 598764 - DNA, 141 bp, Homo sapiens
tgtgtgtcatgcgatgactgctttaagagcattatctaggatcatatccgcaagtcatatccagaacattcagggtcactccagctcccttagtctccatgcgcttagcattgtccatctgatcaccaaacaagggcatca

SEQ ID NO: 598765 - DNA, 989 bp, Homo sapiens
cgggggacctcccttgggagatcaatcccctgtcctcctgctctttgctccatgagaaagatccacctatgacctcaggtcctcagaccgaccagcccaagaaacatctcaccaatttcaaatccgatcttctcggcttagcggctgaagactgacgctgcccgatcgcctcggaagccccctagaccatcacggatgccgagcttcgggtaactctcacaatggaagatccccagccatatgaagacaacctagctggacgatcagttcttgttaagaatctgacccctcaaactctacaacctcgatggaccggaccctacttagtcatctatagtaccctgactgccgtccgcctgcaggatcctccccactgggttcaccgttccagaataaagctgtgtccatcggacagccagcctaatccctcctcttcctcctggaagtcgcaagtactctccccaacttcccttaaacacactcgtatttctgaagaacagtaataacccttatgagcctaatacatcccttcattctattagatctgttcatccttaccctactttttgcaacagggctttacgaagtcaccccaccacttaggccgagccccaaaaaactagtcatccctactatcttctgtccggtcatactcctattctccattctcaactacttataaatgccctactcttgtttacaccgccggtttacactgtttctccaagccatcacagctgatatctcttggtgctatccccaaactgccactcttaactccctcttagagtggatagatgatctttgctggcaaggcaccctccaatacttccaccctgatgaagttctattctttacttttatactcactcttattctcattcccattcttatgtcaccctctacctctccccagctatctccaccacactatcaaccttacccattctctcctagctgcttctaatccctccttagcgaacaactgc

SEQ ID NO: 598766 - DNA, 339 bp, Homo sapiens
agacagcaggcggcttaatatgtaactgtggagagaggaggcaacctactgacttttttcccaggaggaggcagatttacagcagagcccatttgcctaagcacagtgacagatgatggataccatacccacttacacacacgcctggtaggccttggagcttcctggctccatagacgctgtgatgtaggatgtcgccaaggagcattatcagacactaatgtcgaggaagtaaacggatcgtgtaacattagtgaacgtagggctatcctatgtaggaaccaagggcccattaacgaacaaggaaagggacctgcgtgtctgctggcccatttgctc

SEQ ID NO: 598767 - DNA, 396 bp, Homo sapiens
actaagcagctatacaccgagaaatatctcaagtgagataaagatatgcgtactatccacacagaaatgttatttgcgttggcaccagctcacccatcacgtaacattaaggggaatcctctccaaagaaggcggagactgtagcaagtaaggaatagagaacacttgctcttataccctagtggtggcggtcaagctaacaagtgtgccaatgcctttgcgctattcgcacaaaagtgcaaacaataaagcagagttcctcaagaatgcgtaagttaacagccagagacagacactgtgcaggcattgcacatagatggaattacagcaaaatgtgctcaatgtatatgcctgctttacaacactgggagatgtgtttgccagtaagtggctcat

SEQ ID NO: 598768 - DNA, 124 bp, Homo sapiens
tatccaccaccaccacggctgccaccaaagccaccacgaccactgaagtttcctcctccacgaccaagccgctattcccaccgaaaccacctcaccaccaccaccaaaagtatcagaaccatga

SEQ ID NO: 598769 - DNA, 636 bp, Homo sapiens
catggacgccagtcccgcttatctggtgctcgattatcacgagtagactcgtacctcgtctactgggtaaatcttctctacagaattctcgttagatcatcagattccactagtcagagaacataacttattatgacatattttctttgcgcaactactgttattgccacctgggataatcagctagcccgaggagaagaatccatgtcttgaaagccaagaacagtgaggctccccaagattccgtatgatatacttctaagtaaggttgcttgtccccgctaggtcaatcagcactgattatatatgttaccaagcaagcgctattggtacaataatacattctactagctctatttcaatattgaccgagaagtatttgagatctcctgaagcgcaaatgaaactatattattgcctgagcattacgaccagaaggcatgaaactgacggaagaaacgaaacccatcgtgttaaaccggagcatcgatgtaatagacctcgccgtaagaagcccgtgtctgatatcccacgagacgtttgagtacacctagtatcgtagcctgcaggtgcgtctaaacactaggcggctatggtataagaagggtcatagtcatactgatgaccctgaccatt

SEQ ID NO: 598770 - DNA, 148 bp, Homo sapiens
cggtatccacccgtgcttttgatctagcacagacccttaaccctcacttgatgcagcagtagcttggattcttgtggggcatgactcataagtcggctttcaaggctaacgactggtgctcgagcgtctttgggcggcgttgaaccta

SEQ ID NO: 598771 - DNA, 143 bp, Homo sapiens
tccactattgtaggcacaatatttatgaggacgtaagcccgtgggcgattatgagaatgtctgcgccggtgaagcttcaggtttcatgaataagcgatgctgatcgttcaagggctatgtggctgattgaagagtatgcaatg

SEQ ID NO: 598772 - DNA, 313 bp, Homo sapiens
atggggcttagtaaattgaaattaccagattagataaaatttaaaattcagtttttcaagggaaacccaaacacgtttcaagcactcagtagtcatgaggcctgtggctcccgtattaataaagacccagaacatttccttcatcatagaacatttttttggaaagccctgttttacaagtgttttgttaacagtatggttttggccctaatgttaaaagccacttttgtggttcttaagtcaaccccttttttgccctgagggtcattaaaggggttgttaaaaagaacttttgggtttttttttaaaacta

SEQ ID NO: 598773 - DNA, 414 bp, Homo sapiens
acaggtatccccacgcggcgccttttttgtgttactagcttggtctttaagtcatttggctactgatttgagtcctcctccacagttgataaaacttcatcggtagatatatgtgtttaaatgccccacttcatgtgccgtttcacagcttgattttaactcgggatttataacagtaaagcatgttgtacgttcactgtggaaagctaaaaattcgaacttgtttatgatgcactgaccatcttctgcttcatgctgatgaccagggtgataagaaaaggaactatcccatacttattgatcagcaggcagaactgtaagacgaaactctctaccactgcgccctcgaagctaccaccaaagttaattaagatgtttcaatgttccctgattatggggctgcaactctgaagc

SEQ ID NO: 598774 - DNA, 147 bp, Homo sapiens
ggccaaacagtaaatattttagggctgggggccataaaatatgttgcaaccacccaattctgccattgtagtgcaaaagcagccatagacaacacatacatgaacgaacgtggctgtattccaataaaactttatttatggacactg

SEQ ID NO: 598775 - DNA, 974 bp, Homo sapiens
tctcatctactctaccatctttggacggacactcatcacagcgctaagctcgcacttgattatttacgctgagtaggcctagaaacgaagacatgctagcttttatctgcccagttgctatacccgagacaaaaatagcagtcctcgttccacagaatgctgccatcaggtatctcctacacgcacagcattacgcgcgatacataagtcctgtctatatagctatcctcttcacatacattatactctcccggaccaggatgaaccataaccaaaatactagcgcaatcaagtacttcatcagttaagtacatcagtaactggctgatagcaattaaaaccgtgaggaatatgccccctactcagcttctgagctcccggaggttcaccgcatggcacccctctgacatccgggcggcttctgctcacatgacggaacactagccacacagtctcgacatcatagtaccaaatcatactccctcacctaaacgtcaagccttctcctcagactcgcaatcttgttgcatcataagcaggcagcttgacgtggattaaaccaaaacccacgtcacggaggaatcttagcatcctgcgtcaaatacccacgtagcgatgaatactagcaatcctaccgtgcagactaagtcacacatatcatgaattaacctattatattattctgagctactaaccgggattccgtagatcacataaactccagcacggcgacctactagtatcgcgcagctgcagcacgtccgtgactaacacctttactcgatcacactcctttcctaccaggccgccctcgcaacggtttcgacaacgagcaaatgacgatcccaaacaacctcccagcgcacaagctgcacagcccaaccaaccacgcgcttcaatcctatccacccttccggaaacagcttacacaacgcgaccagaagcaaccacgcactacacaacaacacgccccc

SEQ ID NO: 598776 - DNA, 956 bp, Homo sapiens
  misc_feature (564)..(564): n is a, c, g, or t
  misc_feature (836)..(836): n is a, c, g, or t
  misc_feature (848)..(848): n is a, c, g, or t
  misc_feature (896)..(896): n is a, c, g, or t
  misc_feature (946)..(946): n is a, c, g, or t
tgaaacttcccgggggacaggatctctctctgtcaccttggctggaatgcagtggtgcaatcagcggctacactgcagccttaacctcccacctcagcctacctgagatgggactacaggtgtgcaccaccaccctttgctaatttttatatttttttgtagagacgggttttgccatgttgcccagtctagtcttgagctctggggctcaagtgatctgcccgccttagcctcccataacggtgggattacaggcatgagccacccacacccagccctttttttaaaaaatgggtttgtaagagtattttgggaaagctgagtaagcagaggaccctaaattgttatttaaaataattatatgtaatatatttgaagcacttattttgtgccaggcactgttgctttatggtcacttgtttcagttaatcatcgtgaataccttcttatccagtgtgagtggactccagcttaggtccattttacagttgaaactgacactctagtaggattaagagactttgaccgaggtcacacaagttagggcggtgctagagccaggantgtaacttgttctgtatttgttcatttaccccattgatgtattgagtgcctgctttcttcagggtgcgctgcagggcccgtgctcttaaatactgttgttggctggtgtgaaaagaaccctgaatgttgagtcagtaaaccagggcttgagtcctagctctgccacattcccgctatgaccttggacaaataatttctgttctttgaggctgtcttttaaaagacgtctcgctctttattagatagatggcatacatggcgaggctttatangcggtaaagcantatcaggtataaactacgaatgtcttgcaatcagataattctagctgntcttgcttgtagttatgttttaagcaataattttgaggtgagagagctgncagtttgtag

SEQ ID NO: 598777 - DNA, 138 bp, Homo sapiens
ttttggaaactggggagaatagattccccttagactgcgagtcagctagtgtgtttctttacagttgactttagcaaaattcatactaaatagtagttacaatgatcttctttacttgttaagcgtcaccaggaaaca

SEQ ID NO: 598778 - DNA, 1065 bp, Homo sapiens
ttgcatactggctatataattctctgtctctctctgtttatctctcccctccactacccctcccctatacatactaccatcatccatctttgaattcctcatacctaacatctcaatcccagtatcataagcaccccaccccacaaggaaacacaaagaatatcaataaaaaaaaggaaaaaaagagaaaaaaaaaaacagccatcacctacacaacctctggtaactcacaaacacacccgacgatcaaaggacaataagcatcccacaccgctacaagaaagaacgaaaaaagaaaaccacacaaaaaccacgcacacacacaccaaacacaaaacaaccaagacaacagaacgacgaaacagtacactccaaccacaggacccacacgaacaaacgcaccacaagagaccacaacagaaacacagacgtacccacacaaagagcacctacacgaaaacacgcacaagaacaaactcaacaccaccacaataccaacaaccacaccacaccagagacaaacgcacaccaaacccacacggccaaacacacggagagcaaagcgatccaaacaaaccagacaggataacagacaaaaaaacaaccaacacagacactccaacaaagagaaaacaagcacacacaaaaagacaaaaaccacacaccacacgaggacaaacacaagcacaaacacgaagacaagacacgaaaacaccagcaaacataaacaaacaagaacaacacacaaaaaacgataaaccacaggcaactccgtacacacacatacacaaacaaaacaaacaacaaacccacaagaaaaagcgaaacaacgcacacgacaaacgacaagccaacacaacgcacaacaaaaacaaagcaccacacaaacacccgacaaaagacatcggacacaaaaacaccacacacgaaccaaacacccgcaagacaccaaagcacaaaaaaacaaaacgaaacaacccgataagcaacaagacaagacagcaccaagcagaaagcacaaacaaaacacaccaacaaaaacaacacacaaacacaaaaaacaga

SEQ ID NO: 598779 - DNA, 164 bp, Homo sapiens
ggggtgccccccccccccctttgggggggtggccctttttttccgggggggcccccccctttgggggggccgggggttttttttccccccccccccccccccccctggggtttttttttgtttttgggggggggggggggtaaaaaaagggggtttttttgcca

SEQ ID NO: 598780 - DNA, 303 bp, Homo sapiens
actatcgactcgcacccgtcagacgctgaactatgtgcagagaggtgattataatattctctgatggttgcttgtatttctgtggggtcagtggtgatatcccctttatcatttctgattgtgttggattcttctctcttttcttctttattagtctagttagcagtctattaatttttttcaaaaaaccagctcctggatttgttaatttttgaaagattttttgtgtctctgtctccttgagttctgctctgatcttatttcttgtattctgctagctttggggtttgtttttggttctct

SEQ ID NO: 598781 - DNA, 254 bp, Homo sapiens
  misc_feature (57)..(57): n is a, c, g, or t
  misc_feature (122)..(122): n is a, c, g, or t
  misc_feature (236)..(236): n is a, c, g, or t
tcgcagtgcagcttaggtgacgtcacgttgcactatatacttctcagtctgtacatntcgcggtcgtgacttagaatacctgtcggccagctgcaggcggcgcatatgcatcctagcctatnatattccggagtatacgtagccggctaacgttaacaaccggtacctctagaactatagctagcatgcgcaaatttaaagcgctgatatcgatcgcgcgcagatctgtcatgatngatcattggcaaatttgg

SEQ ID NO: 598782 - DNA, 882 bp, Homo sapiens
cccagaggggtgtgtggcgccagccaaggtgtggcgcacaaacatgtggttgccagtcacacatgtatttcccttgtagaccgtgtcgtcctaatttggaaagaaaattcggggttcatttttccccgggcgccagttgccccccgcgacctcgtctctcaccctgggggggccccgttgctgagttcatccagacttctgggatcctcacttgcataagggagttgcttccaacgggtagtctttttttggatgccactccgcaccccgcagtgtctgtcatgtttgcctcccacgtgcccgcgcgtatgtgtcacccaacacaggttatagcaccacttcgcctcatgctactatcgcgcacctcgcctgcgtggcgcctttcttgagagcccgcttggcttcgcaccgtattgcgtgtcgtgcccgccacgcgaagttgattctcgctcttcacttagttgacgccgcctggctgccaacacacgaagtgtttcttgcccaggatagtctctctcctttctgactcgcccccggactattgtggagtcgttattcgtctgagtggtgtaataactcgttgcgtgggtggttaatatgtgaggcatttatgtccccgcttgggggagcccccccagtaataatcagctcctacctacttggctcgatatgctacgctacgacgagcgctctcgcctgcgagggaccggcgatgcgagtagacgagccgcctcccctcagctggagcttctcttctttctatgcgctgccccacaacagcggcatgattttctcctccacagaatagtcaagaagtctctaggaactccccactactccttggccacagaataaaggcaccccccaaagaacaaacataac

SEQ ID NO: 598783 - DNA, 883 bp, Homo sapiens
ctctctgaaacatgtgctgtgtcaactcagagttaaatggattaagggcggtgcaagatgtgcttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgactgtcccccagcccgacacccgtaaagggtctgtgctgaggaggattagtaaaagaggaaggaatgcctcttgcagttgagacaagaggaaggcatctgtctcctgcccgtccctgggcaatggaatgtctcggtataaaacccggttgtatgctccatctactgagatagggaaaaaccgcttagggctggaggtgggacctgcgggcagcaatacggtttgtaaagcattgagatgttatgtgtatgcatatctaaaagcacagcacttaatcctttacattctctatgatgcaagactttgttcacgtgttcgtctgtgacctctccccacaatgtctggtgaccctggaaaatccacctcttcgagaaacagccacaatgatgataatactagggaaacagaagctggaggatctcatatgggacggcggtcccgggaccttatcttaccaaaggcgcgggctcctcccaagccaatcccctaaaacccaggtttggggcccccaaaagaagccgaccgggggggcgcacagcgccccagggcgaggcacaaggcgcacacgacagcgcgcacaaccgacacgccgcaccacagaacagtggcgcccggcaagcacacactgccgcta

SEQ ID NO: 598784 - DNA, 354 bp, Homo sapiens
attatcccaagcttttaccgcgacagtgatgcaggctgacacccccaggtgtgggcacattcgtacatgcagtcaagtactctgactaaagcctgaatcatgctaagctgctaacagggagtgggatgtagagaaagagtagaagaaggggatcagaagaggctgacaaggccatagacgcaggctcctctttaccctgtgtgtgctgggattttgtaataagcattacttaaaaagtttattatcccaaatattaaccattacatagtaagtgagaaaatcagaaaaggaggttctggttctattaaagaaagagtatacaaagctagtcatggaaggtttaaagggcggtaa

SEQ ID NO: 598785 - DNA, 287 bp, Homo sapiens
cggactcaggtcggctcatgccacgtctccttccctgtcttccacaggtatgtaaaagcgtcatgtttgtggcaagtgtggaagtgaaacctacctaagaactatagatgtatagattgaacttctactagaagtactattcaggagagctgtattttgaaggataaaatgtttataattggggagtggggagagaagaagaaattattgttcatggtatatagatatttatgtcaactatggtattctggattctgagagatttttagtacacatcagtgctatct

SEQ ID NO: 598786 - DNA, 221 bp, Homo sapiens
tgctctgacgagctcccccgttgtgtcctgcctcgtagcaggccattgcagtggtcctcccaggtcatgggtggcatgggggtcgcccgcagcgtcgctgcaccgctcttggccgcccgcgcagctgcctggggcgctggccggcctgggctggtccggcctggtcatgcctctcccttgcggagcctgggcgcgcgtctccagcctgaccaggggtaccg

SEQ ID NO: 598787 - DNA, 135 bp, Homo sapiens
cctgcggctgttggatttgggaatgcccttggtgaaagtctccctgctccagggtctctttttggtccaaaggctagacctataaagttggatccctttttttctttccggtgaaataaatggtttttcacctta

SEQ ID NO: 598788 - DNA, 755 bp, Homo sapiens
  misc_feature (533)..(533): n is a, c, g, or t
  misc_feature (673)..(674): n is a, c, g, or t
  misc_feature (721)..(722): n is a, c, g, or t
attctttgattacttatgctgaaaaataaagaatgataagcttttatattcccagtcacacccccattcccccactccagataaagcttcagttataaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaggaaaaaaaataaaaaaataagaaaaaaaaaaaaaaataatggggtgcgagccccctggcggaacccaaattaaatttttggaagcttttttaaaaggggcaaaattgggaaaaaccggggaaccccccaataaagggcgttgaaaaaaaaaacaaagggggaaggttaaaaaaaagggaaaaagaaaaaacccggtgaaaacaaaaaaaaatgttctggaaaaaaaagccttttttaaaagaaagtgggataaaaagaaaaaaaccccccgaaaactttataaaaagnggagatcgttttgaacaggggggcaaattgaaaaaaaatttcttttataaaaaaaggtggacctattgtgaaaagggggatttttaaaaaaaagaggaagccccctaaaaaccccttgaaaaaaaaaaaacccggggaanngggggtattttacaaaacaccccaaaaaaacctttttaaaaaggggnncaaacgggaagagcgaaccccggaagggataaa

SEQ ID NO: 598789 - DNA, 386 bp, Homo sapiens
  misc_feature (88)..(88): n is a, c, g, or t
  misc_feature (280)..(280): n is a, c, g, or t
gacgtatcagctcagtgatcacagaatttcagcacactctccaggcccctgcttggtgccacatctgagagttgcgcagcgtcacagncagttctgaccaggcggggctgttgctggtcaggtgcttcgccgaggcctgcatcccaccagcctccacaatggcaggcttattgctgggacacacggatagcaccttgagcacacgactggtggtccagagcagcttttcataactgtagttacgcatgatctgcacgagggccctggggcccaccattgnccaggatgatcagcttgctctcctggttgccgtaggccaagagctgcaggcagccggtggtgatggcaggaactttggggttgctctttgtagagcaggggcccca

SEQ ID NO: 598790 - DNA, 272 bp, Homo sapiens
gtggtagggcgcttgtgctaggctgggtggatgctgctgtgctggccccgttctgcccagctcagcagctcactgttctggaaccacagctggatctcccgctggggcccctccacggcagtcgctagcgtggatgacattcctgctgatgtggacgctgaagtcaccccttatggttgctggggcggtctcagccgagtcggtgtgtccaatcatggccctcgaggcgcgtgcgacattgtacccttcccagaccacggacatcccctgct

SEQ ID NO: 598791 - DNA, 118 bp, Homo sapiens
tgctagcaactgtcgggctctcgtctctgctctccgacctcctcctccagctccgggatatctccatgcagagcacagtggctgccagtgggaaggacttgacggtgcgttggcccaa

SEQ ID NO: 598792 - DNA, 419 bp, Homo sapiens
  misc_feature (6)..(6): n is a, c, g, or t
  misc_feature (55)..(55): n is a, c, g, or t
  misc_feature (290)..(290): n is a, c, g, or t
  misc_feature (338)..(338): n is a, c, g, or t
  misc_feature (415)..(415): n is a, c, g, or t
cctgtnagaccgccgggagcccgacttcctggcgctttgccctttgggagccggncaagcgaacagcgccaacctctctccacaagccagggaccctacaacccaccgcctcaggccagaaccagcagctgatttagataccatcaagacacctaaaaccttatcatgagccagatgctgtggaagagattctgggagaatcctgaggaccccccagttgcagccatgtcaagactgatgctgaggaggaccccaactgtcacgagcaacacccgtcgaacacagccacntattggggaaagatcaagaagctgttcacagatggtgggaagaaaacntgagggaaagcggggacaaccattcacattgagttattttaattgttagctattgaggagcggttgttccacctttngttt

SEQ ID NO: 598793 - DNA, 511 bp, Homo sapiens
tttattactaatacaaattaaagttgcacatttattcatacttgcttttacctaatgtatttacttcttcatccagtgaacactttctgactatctaccaaccaagcctttactcaacatctgctgcatcatacatgttctcaaagcgcttcccaaaacagacttgataattaattggaaaatgatactggaagttatggggattaggtgcagagttttattaccttatacagcagtatttatgattacaataaaccatacataaatgttgttatattaatataatactaaagaagttcactgcttgcaactattttaatgggcttgtgacttagagaaaatttacttatgtacaatatcagagtaggaattggaatcatagttaactaaaatagaacataaacttcataggttacgatttatatgaagcccaatagttcaattctaatgaccgccttgtgttttacgattaaccttatctgctcctttatgagttctctggccagcaaaa

SEQ ID NO: 598794 - DNA, 238 bp, Homo sapiens
  misc_feature (27)..(27): n is a, c, g, or t
  misc_feature (73)..(73): n is a, c, g, or t
  misc_feature (152)..(152): n is a, c, g, or t
  misc_feature (173)..(173): n is a, c, g, or t
  misc_feature (215)..(215): n is a, c, g, or t
  misc_feature (222)..(222): n is a, c, g, or t
ggcacgaggacaccacggccagtgctnctcctggggtcctgtacaaccttgcgaggcacccagaataccaggngcgctgccgacagaggtgcaagagcttctgaaggaccgcgatcctaaagagattgaatgggacgacctgggcccagctncccttcctgaccatgtgcgtnaaggagagcctgaggttacatcccccagctccctttcatctnccgatgntgcacccagggcattt

SEQ ID NO: 598795 - DNA, 154 bp, Homo sapiens
  misc_feature (121)..(121): n is a, c, g, or t
attagaggatctctgggtcagtgatctcggggtcagtgatctcgggagtggcatctgactgtgggcgactcagtagcatgaacctgctttgtatgctttctgcgcagatgtcatcagattntgaagagttgagcacagtggattggaagaatca

SEQ ID NO: 598796 - DNA, 520 bp, Homo sapiens
  misc_feature (1)..(1): n is a, c, g, or t
  misc_feature (81)..(81): n is a, c, g, or t
  misc_feature (210)..(210): n is a, c, g, or t
  misc_feature (254)..(254): n is a, c, g, or t
  misc_feature (426)..(426): n is a, c, g, or t
  misc_feature (505)..(505): n is a, c, g, or t
nacccctcacccactccacacaacctcactctccccccctcctccccacccatcatctcttaactacccaccccccccccncccacaccatcccttactttctcctttactttcacaaaacacacacttcccctccctttctttttcttttttctttccttttctttttttacccatacctccctcaacctccctccatcaccccccatncaccaacccttccaccaaccctcacttccctccacaccccaccnccctctccccactctcaccaacaccactcccttcctccaccaactccactccaatcctccaccaccaaataaacccaaacccaactcctccacacccacccaaaatccttaaccaccccccccctctccacttcccatgcccccccctacatcaactcctctccaccccacnctcccatctacacctccctccacccacccctcccccactttctcctcttacactccttccatttcttctcttccttttntcccatccccctatt

SEQ ID NO: 598797 - DNA, 842 bp, Homo sapiens
cgtggtggctcacgcctgtaatcccagcactttgggaggctgaggcaggcggatcacaaggttaggagatcaacaccatcctggctaatatggtgaaaacccgtctctactaaaaatacaaaaaattagccaggcatggtggcacacacctgtagtctcacctactcgggaggctgaagcaggagaatcacttgaacccaggaggtggaggttgcagtgagcctcactgcactctagcctcggtgacagagcaagactccatctcaaaaaaaaaaaaaaattcctcaagagaagattttacttatcaaggtaatttccagggtccgtggccccaaggaaatccagggaaacaaccacattattcctctggagaattctcaaaagaattcttaaagagaaattctcaaagttaaacgcaccaaaagaaaataacacttcacaggagccaggcagggggggcgctcattgcctgtaacacccacttgggggagcgccaaggcaggaggatcatgagctcaagagatcgagaaccatcctggaacacactgggtgaaaaacctggtctctactaaaaattgtcacaattaacttggccgggcgttgaaggcatacggctgggaacttcccaggcaaactcaggaggctgaggcaggcaaaattggcttgaacccaagggagggcatctttcaagttgaccccgacgaattggtgcagctggcacccccaggcttgacgagaccccaggggagaaccctggtccccccaaaaaaaagacacaagcagtaacaacaacaacacacagtgtgcgccgccctcgcgcctcacaagaagctctccaagac

SEQ ID NO: 598798 - DNA, 350 bp, Homo sapiens
  misc_feature (146)..(146): n is a, c, g, or t
  misc_feature (149)..(149): n is a, c, g, or t
  misc_feature (199)..(199): n is a, c, g, or t
  misc_feature (256)..(256): n is a, c, g, or t
ggatttaaatggtctctaaagccgggggtagggggcagggtgggttgtctttgcccctcaaagtcacctacctagaaaccaagcccacggtcttggccgtgaccctgataattgggctctctcagaggcgccagcccctccttccnagncggaggcgtcattctcttctgtccactagagggagctctgatgcagctgnagaagcagcgctcaaggtcttcgccctcccttcctaacccttacctttagtctcacnagcctgaagggcttctaggggtcctcaggcgggccccaccagggcacaccctactggccttgggccttacgcccccctccttatctgccccctt

SEQ ID NO: 598799 - DNA, 184 bp, Homo sapiens
caagaccagcctgggcaaggaagaaagactgtctacaaaaatttaaaaattagcctggtgtggtggcgtgtgcctgtggtcctagctgcccaggaaggtgaggcaggaggactgcttgagcttcagagtttgaggttgccactgcattctagcctgggtgacagaatgagactctgtctcaaag

SEQ ID NO: 598800 - DNA, 487 bp, Homo sapiens
gatgttatcctcaacaaccccacagcatcgtacagcccacatagtagtagggggtccgaagctatatgtacccaaatctgacatggctcctgtacaatactggcgatagtagccttgagtatgtagggagggcttctactatagtgacttgaggacctgattcttccatcacaggtgtgaatcctacaaattggcaagtggtcttcaccgttttccccagtctgtgtccaagtgctgtagaatcgtatctttcacggttgtcactcgaggtagatttgatacctcagtgaattacagagaacaactcccacgaactttcggataccacttgcgcttcacatattgccgtccatggcagtccgtgtagctgtgatcatgtttgaaagcgaatgggatccagataggctcaccgcctggggccctcacaacaagcagaggattatctgattcggtgacaaatgagaccgaagtgctgataggtccgtag

SEQ ID NO: 598801 - DNA, 327 bp, Homo sapiens
taccgctcctgaatgacagtaggtcactgaagaaattaaggaaaatttattaaaacaaatcataatggaaacacaacataccaaaacctatgggatacagcaaaagcagtaccaagagggaaacttatagctataagtgcctatatcaaaaagaagaaaaggctgggcatggtggctcatgcctgtaatcccagcactttgagaggccgaggcaggcagatcacctgaggtcgggagttcaagaacagcctgaccaacatggagaaaccccatctctactaaaaatacaaaaaattagccgggcgtggtggcacatgcctgtaatcc

SEQ ID NO: 598802 - DNA, 461 bp, Homo sapiens
  misc_feature (25)..(25): n is a, c, g, or t
  misc_feature (83)..(83): n is a, c, g, or t
  misc_feature (123)..(123): n is a, c, g, or t
tcctaattgcttcctacatgggccnaatttggaccttccttcaacttacttcgccattgcccgagaacggagagcaaagcccngcgtgcggtttcaacctgatggagaaaaattgcttgcaanccaacgggccgcccgcggacaaagcccgaggagaactgaggtgagcgctgcccagtcttccccgtgtgccggctgcgagcctccttgctcctgcatctcgaccattccgtgttggctgtgtcgcctgacctgcgtacctgtggaggattcggaacaagtcatggagagactgtccgggtccgctccttgtgaactgtgcagaaggagtgatcccagcatcggcaagcgagggagaagactgcacgagagtgatgcgcatttcgagtctgcttttcgatagttgatgtcttcttgcctttttaaaaaaccatatatatataaagtttagggtttgctct

SEQ ID NO: 598803 - DNA, 571 bp, Homo sapiens
  misc_feature (482)..(482): n is a, c, g, or t
  misc_feature (519)..(519): n is a, c, g, or t
  misc_feature (555)..(555): n is a, c, g, or t
gtggcgtgcacctataatcccagctactcaggaggctgaggtgggaggattgcttgagcccaggaagcataggttgcaatgagccaagattgagccactgcactccggccaagacttactgtaaaaactcaaagcacggtggctcatgcctgtaataccagcactttgggaggccaaggtgggtggatcacttgaggtcatgggtttgagaccagcctggccaacatggtgacaccctgcctctactaaaaatacacaaattaggggctgggcacagtggctcatgcctgtaatccttgcactttgggaggccgaggcaggtggatcacctgaggtcaggagtttgagaccagcctggctaacatgatgaaacccatctctactaaaaatacaaaaattagctgggcatggtggcgcacccctgtaatcccagctactcaggaggctgaggcagcagaatcactggaacccaggaagctgangttgcggtgagccgagatcatgccactgcacttcagnctgggtgacagagactttcgttcaaaaaccaaacanaaccaaaaaaaaaaaa

SEQ ID NO: 598804 - DNA, 114 bp, Homo sapiens
tatagaggatccctcacactgggttcgagttcctgaggtgcatgcatttgatcagacaagcaccaccgcaaaggcacagtatcggtccttggcgaggaatcatccagggggaga

SEQ ID NO: 598805 - DNA, 200 bp, Homo sapiens
agcctgcacttcgggctggtcaacggcgtgatccgcgacggcacggcgccaagctggatctcggcctggcgggcaacgccaccctggaagacgtgcgacagatcttataaccctaagcatcaggctcaatcggacgatagcctgaccactattcggagaataacatggccttttctcaggcagtcagcggcttgaacgcg

SEQ ID NO: 598806 - DNA, 824 bp, Homo sapiens
atcctgcgctccccatgcaccaccatcccaaactcaggcttcaggcagaaccaagtcatcttcttcacgaccagaagcagcaggaggagtaacacgaggcatggggcaatggaccttccaggtctcatgcgcagttgagcagccaatagtgattggcctggcagcagactcgggatgtgggaaatccaccttcatgcgccggctcaccagcgtgtttggaggtgctgcagagccacccaagggcggcaatccagactccaacacgctcatcagcgacacgacgacggtcatatgccttgatgactaccattccttggacagaaccgggaggacaggagaaaggtgtgaccgccctgtgacccccaaggcgaaacgacttgtgatctcatgtatgagcaggtgacaggcaatcaaggaaggcaaggctattgagaagccaatctacaaccacgtcactggcctcctcgacccggcggagctcatccagccccccaagatcttcgtcatcgagggtttgcacccaaggtatgatgaacgtgtgagagagctccttgatttcagcatctacttagacatcagcaatgaggttaagttcgcatggaagaattcagagagacatggcagagcgtgggccagtcttgaaagcatcaggctagcatcgaagccaggaaacctgatttgatggctttattgatccgcagaagcaatacgctgatgctgtgattgaaagttctggcgacccagctgattcctgatgaaccacgaaggaagggtgccgcgtgttaattgatcattgaaagaaggccttaaggtcttcaacccgg

SEQ ID NO: 598807 - DNA, 353 bp, Homo sapiens
agttaacagggtgcctctttggggccaaggaaggagtgcgaccccgagaatcatgccaaggctcccccctatcctgcggctgctccaagcgcctgcgaagttcacagtggttcccaaagcccatgtctctgccaagccagccaaaactcccacttccgccgtggtaagtaacttctgaggcggcattccctgggcttcagggcaacagggaagattaaagtgataaaggagaggggaggacgtggtgctaggtatcagggttttatgcaagaccgtgtctgggtgccagaagagggctctggcaccactgcctgtgggccgtagacgcgcccgcgaatttagtagtagtaggc

SEQ ID NO: 598808 - DNA, 433 bp, Homo sapiens
  misc_feature (86)..(86): n is a, c, g, or t
  misc_feature (420)..(421): n is a, c, g, or t
cggatacataaagaccagggggaaaagctattatgcatgttggaatttgtgatgtgtaatcgtgttaatttactgtttgagaaganaccccgctatgtgttagtgattatatagtaatcaggaaattatacagatatttagatcatagaaattagtttatgaatggcataaacataatgctacctcagcaacgaaatgagataatcagctaatttctcaaacctgatcatatgaagcagacccgggaagaatacttttcagtggtaagtgggaaaaggtgtagcaaataattgctaaacttccaaaattcttcttcttcagggcctacatgtgatattccataatttcgttcatctgttctgatgcagtgaagtgcaaaaacatcctccaaaccaaaatattgtgaaaacaaaatttctnnagatgacttggc

SEQ ID NO: 598809 - DNA, 130 bp, Homo sapiens
cctggtgatagctggttgtcaagatagagtcttagttcacctttaaatttgccacagaccctctaaatcccttgtaaatttactgtagtccacagaggacactctctggcactagggaaaaacctcttag

SEQ ID NO: 598810 - DNA, 116 bp, Homo sapiens
agtcagattgaacacatatctagtctcatcaaactctccaaggccgacgtgaaaaggaaattatcacagatggttcttgacaggaaatttcatgggattttggaccagggggaggg

SEQ ID NO: 598811 - DNA, 155 bp, Homo sapiens
tgagagctgcactattgtgacctaaactccttacacttcaccctataaggaaaggttagctgatccctaggctagaactcaggttgtgtgcatcatatggctcttcaacaaagcctggcattcccacagctctatcccagagctctgccaaaggg

SEQ ID NO: 598812 - DNA, 1012 bp, Homo sapiens
gccagatccccggctggcaagaacttcaggaagaggctgcccgccttgaagagccatttccagggctcagttacagcgaggtaaatgacgaaatgacagctcttgcagaggatcaactcctgtcgagctatctcaggtatcaagaacagacgggtggcagccctgcgatgaatcaccagtatcccgacggtgctctgagcgtgctaggccccgtacggagaaagccgagcggagaggaccagtctgtggcattcatgaagctgcaatggagctgcattctgccagctgtgatccttggagtaactagaacggacatctggcatctagtcagccttccaggcgatggtcccctgtttagaacaggccagtggtagcacggagtccagatctggaatgttcatacgtgctcctgaataagactacacgactggacgaagcctgaaggagagcatgcgtgcagaggtagccgggccacggaaagagccatgcgttgaccccgtggagtgctgagaagacccgctcgtgctagacctggaccactaatgcctcagcctcgtgaggctgctgactggggacaacgggtaacggtgcacgtctgattaccgaacagggagctggaaacagtcgtgagacgaaggcagtgtggagcaaggcttacataagagtgacgcaagtccccaaggggtaggatccgtcatcaatgcgtagggaatttcctcaggagtactaggctcatcccgtgggtgcaaacggagagcatgcggagagcagaccccagggcagccgacgctatgggcagacagcccgccacggggccccccgaattatttccccaatgcagagcgtcttccctgaagcaggggaggccacaggaagcgagcgaatagacccccggcacgtgaacgcgcccgcatgcacctgggcaaccccacccgaaggcatgggacacccgggactagaagtgaagagtacaacacgaggcggagaacgctaggagccgggcgaggcaagc

SEQ ID NO: 598813 - DNA, 894 bp, Homo sapiens
agaaaggttgtgatggcggctatagctgcatccgaggtgctggtggcacaacgcgcggatggaggggtccctcgcttgcggcggcggagctggccgctcgagaagctgcgatacagagactgcgcgtattccgggagctgcacctgatgcggaatgaacgctcgtaaattcaatcaccaggaagttgtggaagacgatactcagactatgattacctgccaaatgtgcgcgaagccaaaaacagctcgtttggagtgggcactagtaggaagaggacatgaacacggtaatgtgctggcataggagaacgactatgagacagtgaactagcatgcatgatcagtgcatgatacgatgctgaacaggatgggagagcgaaaaagaagaggaaaaaccctgatctgggattttcagattatgctgctgcccagttacgccagtatcatcggttgaccaagcagatcaaactctgacatggaaacatatgagagactgagagaaaaacatggagaagagtttttcccaacattccaatagtcttcttcatggaacacatgtgccttccacagaggagaattgacaggatggtcatagatctggaacaccgagttgaaaaacgagacaaatatagccggagacgtccttataatgatgatgccgatatcgactacttgatgaaaggaatgcaatttcaacaagagagccgtaagattctatgggaaatacacagtgaaatttaccccgaattgggaagaggatcgctgctaattcccttcacgcacctgttattggaagcttgagaatggggtaaaaatttctgctagccaaacacagtcctttggaattgaccagcatccgaacattggtcccgccttccctccggtttaactcacg

SEQ ID NO: 598814 - DNA, 367 bp, Homo sapiens
gtccggatcattggttttagaagatagagcaaaacttgagagttaaaccctagggttttttttgtttgtttgttttgttttgttttttagctctgattctactagaagtagtcatgtcatctttggcaattctcttaatgtaacattttggaacttggtttccttgtctatatgagagagttgatgataccttacaagttgtactgaggattacatgagccctccatgcaaaatactaaatacactgatacagatatggttggtactcaagaaataatggcataattttttttttcttgctatgttgcccaggccaggagtttgagaccagcctagccaacacagcgagaccccatctctacgaaaa

SEQ ID NO: 598815 - DNA, 1110 bp, Homo sapiens
gcgttttttttttggtgttgtttgtgtgttgtgtgtgtgaaggagaaggagaaaagagagaagaagaaaagaagagaaaacgtatatgcttgttatgcttttcagttttgttgatggtttttgttgtgactttctttcctcgtatttctctcgcgtggtgttggtacttgatgttacccctctatgtggtttgtttgccccccttttccgcgggattttacacttaggcgcttttttcggcgcgagacaccctggtcccgggtatggtgtttggtcttcggccccatgtttagggggaccactggcgcgtgttgtccattgcgggtccgaggcggtattttggcaaatttctgggctttcttagggcacacctgcgggcgacacgagttccaccagaccaagcccaaccttgttgtcacaagcgaggagccccgccgtttgggacccaactgagggggggaccaatgtatcccggtcgggctttcccccgcgctgtcttgacccttggcccaaggtggaccgagaaccccctccacgagtttacttctgtccgaattcccggcttttggaacattctcggtgatccccgctgtgatgaacctcccttgggttcacccagatcactttgtgatgtgaccgtgttttgagttggccccgttactgacacgccgctgggacaccctccccgcccccgctgtgctgtgtgccgctgtgtggaggagacttatgaaactgagctgttgccccttattgttattgccagatccaccctcacgagatcccgtttaccctcgtgctgttccacgctttctccctctgggaaaaaatctctcctgtttctctctcctccttccaccctcccctccctccatcaccctcacgcctttctgttccttgtcctcacccttactcccctcacggagccctaccccacccctctttgaaaagacacaagctctgcctaacactagaagacatttttttattttaacccaagattactgttgtttaccgatgagatttgggggaaaaaaatataaatataaaatggctttccccgtcccttgcatccacgggatgcccaccatttcataactgtttttaatggta

SEQ ID NO: 598816 - DNA, 310 bp, Homo sapiens
gctcgacctgctgaagatacaaaattagccaggcatgctggcacatgcctgtaatcccggcccactgcatcctccgcctcccaggttcaagcgattcccgtacctcagcctcccgagtagctgggattacaggcatgtgccagcatgcgtgctaattttgtatctcacagaagaagcgggtttccaccgtgttgccaaggggctgcactcaactcctgacctcaggtgatcggcacggctcagcctcccaaagtgtcgggaccacaagcctgagaacctgcgcccggcctttttgtgtttttttttttta

SEQ ID NO: 598817 - DNA, 107 bp, Homo sapiens
tgactctacaggatcctccccagctactcaggaggctgctaaagtctgtagagcaggaatcatttgtcagaagaacacagaagcccacctagctaggagttctatct

SEQ ID NO: 598818 - DNA, 161 bp, Homo sapiens
tatttgctctctcctactctgctgaacatccactgtgctcgcttgtgccatgctgacgcgcactggtgccacgtgcgcgtgtggttgtcttgtgcctgcagactgggacatcatgcccgctcacttgtgagacttgtgcgctccactggattgtcgctgcc

SEQ ID NO: 598819 - DNA, 135 bp, Homo sapiens
tgttacgactgcatctgtgctcaggtctcagtatcaacctcttcacccagcttctagaatcaattctcacatgcaaaccttggtcagtccatgcctcgctgcttaaaacccaacagtagcttcccactggcttca

SEQ ID NO: 598820 - DNA, 1521 bp, Homo sapiens
  misc_feature (296)..(296): n is a, c, g, or t
gaattcatctacgataaagacctgcacggacactggtgcttcatcgccgctcacgggtgcgacgcgttgctcctgtgtctgaggcctagtgtcatccttttgagatccatcattgctcgagatataaccttgggtctgtcgaatcggtagatgtgatatgtatcactagactagaggcgaatggggctcaattaggagctcatctgacacatcatagagcgatggggaggaacaaagagctcaatagctctctttgcgagatcgatagcatctcgctatggcattctatccatagnactatgcaattgctcctcaataaagtctatcgctagcatcgaagttggcacactaacccaaaaggaaacggtaattgttccctaagatgataagagcattgagacaatgaaaaaggggcccaagaaccaattccaatagtgtagcaatacattccgggtggcaaatgaacgagggatcgtagtggggggcgcgataacgtagaagtagtgtgtataaagccacgatgtaagcataaaaggggaagaaaatgcctcggaggaatgggaagcgaaggaatattggtgcagattccaggttttttgtacaaacgtctctaatttgaaatcgggcgaaacaggggaaacaatttgtaaggggatagccatggaccaatgaaaatgcaataaaggaaggttaggaccagttataaagaaaatggcgtaattatataattgcggcagtggtttccttacggtggaaaatacagtcgtctcatgcacaccaaaaaaaagagggcctattcacttcgttgtttacctaaagcggggctccactgagcatggactatagattcgcctcgtttaggcctcggggtaggcctagggtggactttggttggtctcttgtgtgcaaaccggttgctcctaaagggagaaactgtaagcaatcccaggatgtcccaggcagcaagaataacacagcattccgttggacctaatgtccctagtgagggggttacactttggaaccctaggtaaaacggcccagacaggggccaagggaataggccaatctggccctggatgggcgaaaaaaagcgtccaccgaaaggcggggggccaaaacgcctacccaggacacccttggacgggtgccccggctggccgcaccaagcacctacgggtgcacgagacaacccctcaggcggggagacgctggcaaaacaggagcagaggcgggccacaaatcaggacgggggcggcccgcccagaaggaatataaccccccgtggagtaaaacaccgccccggccgaagacccacacctacggcagcagagcaggagcggagacgaagacgaagcctcacccccacaaacaaccacaccggcaagacaccacccaacgagcacaccaacaaaccacacaaacaaccacacaagaccactgccgcacacagagtaaacaaccaaccatccggcgcccacacacaacaagacacagacccccgcacacacgagccgaaca

SEQ ID NO: 598821 - DNA, 875 bp, Homo sapiens
gattcgagccgttgagacgcctctgcggcagctggtggcgcagtgtggcttgcgtggagcgcgggtagaggcgacctggccagcaaccgcagcgtcgtgcgcccgctggcccggcaggcgcgtcgggacgccccgatggcatcctccccctggcctgtgggccggtagctgggccctggtccggcgcctgatccccgtgcgcgaatctcctcgccgctcccgggcttctggacccccggtctcgcccccgaaaaatgattcgcgatttcaaacctggcagaccttcatattcgccaagatgaacaggttatcccacatggggccagctcgagtagacgaagttcctgatggagctgtaaaaggcaaacgcaaaacaaagatacccattttacgtttagtggaactcatgagaggtgatttatgtagagaccaaaggatataattacccttactcagaacaataaggaaaagtatggcaaaacaaataaaccagagaagggtttgaattgaaggtaaaatgggagatagataaacaaatcgcaaaaagtgaaaatattcaagtcagacaggcaagaaaggtaaacacaactcaaaaatgcatacatctgatgtatgaaacgttgaaacgaaaacagggaaaactagtaggttcacaaacaggacgaataacgacaatgaaggaaaaaaggccaggcaaaaggaggaatgtgactaaaagcaagggtggaaataaattaaacacaaaaaggttgtcagaaagggggtgagaatacagaaaacaggggacgaaaaaaatcatagttagaacatgcaggacgtactagaatattatacaaacaagaagacagagtttgttcatctaaaatgatgataac

SEQ ID NO: 598822 - DNA, 1708 bp, Homo sapiens
cgtgacgcgtgggtcgacccacgcagtcggccgccgaggattcagcagcctcccccttgagccccctcgattcccgacgtttccggtaccccccatgaccgcactacataccgacgaaacgcacagacggcgacattccgcaggccgatataccaacgaggaaaaggaatctgtatcagtatgatccagcatatcgcagaagctcacaactctagatcagacacccataaggcaagaatgcagacgacaggggcagacagacacatgaataccctgacatggacacacaatgaagagactaacactccaactatacagaactaccaagcaagagcaaaacgggcaagagaaagaaccacaagaccataactagatccacaagagcgaaactcagcacacggacaatgcactgacacggcactacgaaacaagacaaaccccaggcagcaaagacgacaaccaaaaaagaccacaccagacaggaaccggcccaaggccacaaaagagaacaacacaggcaacaaaacagcaagagacacataacaggagaaaacataacagcgcaacgcaacagaaccaacgaccaggacactaaaccaccagcgcgcaagagaccaccaaacaagcagacaccaacaaaccaagtagacaacccgcaaagaaacaccaccaagaaaacacagcacatacgcgcacaaaacgcgcctacaaagagacaacacaacatccacagcacaaggaaaaagagagaaacaagaggcaagcgcacacacaaccagaatagaaaaaagagaaagacgacgaccccaccatgagacaccagccaaaaaaaaacaatgaacacggaaaaaaaacacacctaagtgaagcaagatgaaaagacacggaaaacgagaaacacaacaatacgacaagcaacacacacaagaacggaaacacaccacagagaaacacacacacaacgacaccaaatcacaaacccagagccaagcgaggcaagataacagaaaggatcaaaccacaaaactacagacggcgagacgacgcccaagaaacaaagaaaaacaaaacacatgagagaacagaaaacgaatgcaaccacgacacccaatacacaacgacaacgaaaaaaacaacgcacgaacacaaaacaacacacaacaaagacgagaacaacaagaaagaataagaaacgcgaacagcaccacacaccaaccaccaacacagagagacaccaaaccaaaaacaagaagcaaaagagaaccacacaaaaaaaagagcaaacaacacacaagagacacaaaccgagaaacaaaaaaaagacacaaacaccaacaacgcccaaaacgaaatcacaacaaaacaaacacaggacggaaggcaaccaatcacaacacgaccaccgaccgaaaacaccgccgcaccacagaacgaaaaacaacacaccaaaaaacacacaacacacaaccacccagcaagagcaaacaaaaagcaacaacgaaccaacacaagccagacacgaggacacacaagcaagaacacaacaaacacgaaacaacaaaagagaaaacaacaaaagagaagaacagaaagaaagaccacgcaaaacacagacaaacacacaacgacacacaaaaacaacgaaacacagagcaggaaaacagaaccacacaacacagagctcgaagcataaaaaagacacacaaca

SEQ ID NO: 598823 - DNA, 613 bp, Homo sapiens
cacctgccaccacacctggctaattttttttgtatttttagtagagatggggtttcaccgttcaccatggtggtcaggctggtctcgaactcctgacctcaggtgatccacctgtctcagcctcccaaagtgctgggattgtaggtgctagccactgcaccagcctcaacagaactcttttagggtcaatatcttgagacccacaaggaatttcctttgagcaaattctgtgggaggtatgtagccttttatctttatagttatgtagtttaggaaaaaaaaaaaatgtgagagacaggtttgggtgtgacacagtttcccagctagccttttcccgtgtagcgtaggtggtgtctgagaattcccaagaatttaattttttctttaattaatattaaccattgaaattactcaagacaaggtatattcggtaagatctggagagctacagtggtacaagaacattaccacagaaaaagaatacacatcactcgcacatgacacacttacgacacaaacacactttttatggtctctgtaccctgtctcctggtgcacagctcctgaaaccctttggaatctcccaagtgatgtgtcttaaggatgctattga

SEQ ID NO: 598824 - DNA, 386 bp, Homo sapiens
  misc_feature (281)..(281): n is a, c, g, or t
  misc_feature (316)..(316): n is a, c, g, or t
  misc_feature (386)..(386): n is a, c, g, or t
agcagaagaaaagtgaatcgccaaagagcatcttcaaatatattatttttaaataaaacttaaaacctaaacaattctaaatcaatttgtgtaagggatatattagtggtttctaaaattattttaaagtgcataagaggatgataaacacaaaaaggagagaacctacgggaaattccaacacaaccagggaatactctagttatgagttgttatgaaggttcatgggtaaccattattattacttattaacgtttaactcacatatattcttaaacttngggggggaaagtctcttattttgctttgggaggtncatggctttattttgcctaaacttgttttatgttttctaatccttttaggtgggggaggaaaccctggan

SEQ ID NO: 598825 - DNA, 521 bp, Homo sapiens
  misc_feature (7)..(7): n is a, c, g, or t
ttcattnagcaaatgggggccgttaataggaaatggaagggatacattgtatttttctgcctctggtagtaaacatggtatatctttttccaatcttttaactttcctgctttttgtatttaaagtgttttttttcttattgatagcatatatttggatattgctttttatgccgtctgacaaattcgacttctaactacagtattttgcccacttatagttaacataattattgataaaattaagatttaaccaaccactttcctatttatttagttttgtctcataaaatgagtgttctaatttcttaaaaaatgtgtagaattggcattatttcttatgtttttggtagaatatgccgataaatccttctaggcctgatgttgaacttgtaaagtgtattgtcaaggaatttttaattaaaaatataatttctttaatgtactttagtcctattcatactttctgtattttaacgtccactttgtcagtttatgtcttctaaggaatttgcctatgaa

SEQ ID NO: 598826 - DNA, 380 bp, Homo sapiens
tagagacgcatcttcataaacaggcatacaggacaaacagtgaaggctgtttgggttgaaatcatatttaattgccgttatgttatgaacccacaaaacagccactatttaatttagcccttaacctcctactaccagattgccaggtgacatcttttaggagaagaaaatggtttattttttaatgtttcttacctaaacattactttggcaattcacacttatatgtgagagagaaaaaaacaaatgtttacaacacaaatctctgttttgtgagaatactttgcattatggagtaatagacaaattggagctctcatatatgtcccaaaagttgtttagagtgagttctacctggccccaatgttctgatagtgtgt

SEQ ID NO: 598827 - DNA, 92 bp, Homo sapiens
ccccccttttttcctggtccccattttccaatctgtatgggggctgttttttatggcaaaaggttttggggaataaaaagcgtgaaatgcta

SEQ ID NO: 598828 - DNA, 478 bp, Homo sapiens
  misc_feature (474)..(475): n is a, c, g, or t
ctttgaaggaggaaaggaatgtgacagagggaaaaaccaaccttgtcccaccggggacatcagaacaatagcagtgttctagaattgggcatgtttgtatcattctcttatatcttgcattcattttataacctttgaatatggccaatatttaataaagttaattacatttaaaataagtgcacgaccccagcttggtggctcacgcctgtaatcccagcactttgggaggcccaggtggacagatcacttgaggtcaggagttcaagaccagcctagccaacatggtgaaacccatctctactaaaaatacaaaaaattagctggatgtggtggcaggtgcctatagtcccagctacccaagaagccgaggcaggaggattgcctgaaccctagaggttgaggctgcagtgagccaagattgtaccactgcccctcattctgcacaccagagtgagaatattatctactatnnaaa

SEQ ID NO: 598829 - DNA, 398 bp, Homo sapiens
cctgaccatgctctcttctcgttggtgggcatgctcctttagctcgggcgctgcgtcccgtgaggggccacacgtctccatttcagcgtcgttgcttggcctggcgaccgggctggggtggtatgccccgaggaccttgttgtgtcaagataatgactttccctgcccttgccgttgtggtcgcggctgtcctcccagccgggatcacagtgggcagccggcacccggcaccactattggcgagcgtcctgcttccgccctcgccctcatctacgctgctccgctttcctcagacccctttttgccgtgcaaagggaattcttgacattaaataacaggtatccagattgcagactgcatgttcacagagctgggggttctccagctatgcctacagt

SEQ ID NO: 598830 - DNA, 159 bp, Homo sapiens
aacgcagccatggctcgtggtcccaagaagcatctgaagcgggtggcagctccaaagcattggatgctggataaattgaccggtgtgtttgctcctcggccatccaccggtccccacaagttgaggagagtccccccccccaacaatttcccgaggaca

SEQ ID NO: 598831 - DNA, 310 bp, Homo sapiens
  misc_feature (125)..(125): n is a, c, g, or t
  misc_feature (132)..(132): n is a, c, g, or t
  misc_feature (136)..(136): n is a, c, g, or t
  misc_feature (164)..(165): n is a, c, g, or t
  misc_feature (180)..(180): n is a, c, g, or t
  misc_feature (185)..(185): n is a, c, g, or t
ttccttaatggaagactcagatgacggtccttcgctacccaccaaacagaacgaggaattccgccccttcattcgaaggctcccagagtttaaattttggcatgcggctaccaagggcttcatgngggtatngcgnactttcttcgacgcttcacttttttttnnccggccgattctggngatgnacttcatcatgctcttctgtatcacgatgaagaggcaaatcaagcacatgattaagtaccggtacatcccgttcacacatggcaagagaaggcacagaggcaaggaggatgccgctaaggtctcc

SEQ ID NO: 598832 - DNA, 367 bp, Homo sapiens
  misc_feature (316)..(316): n is a, c, g, or t
  misc_feature (348)..(348): n is a, c, g, or t
aatgaataaccagaccccattgtgcagcccgtggaaaaacaaccaactcaaacaacactgggactgttagaaatatgcttgtgattggcagcttggagagcctccaaaattagtttcctttggcttccctgctgctccctgttctccaagcctgggcttaatggggtttgagttttcttttaagtgctcactttaacccttaaactgccgggctgatggcctggggattctggggaagagctgccgctggacccacaaagccagtgaagcccattcccctttctttgtctcttcattttaggactgtaggctgttntaaaggggcgtgataataagagggagagggtngttttagcttcccctggga

SEQ ID NO: 598833 - DNA, 370 bp, Homo sapiens
cattctatgcatgtgaggctttataaagtacaataaattcatttatgaaatgaggttactttcttgactcaattaaaatcattgtgcaccccttccttatctgttaaaatgttagaagcgaattgacttgaattaaatgttgtaaaaagagtggagtggaaatcagagattgagtttggttggaaattagcagctgagagatgaaggtgccaggatttttatttaaatgtggtacaacaagattttgtcagtaaagcacatcattagaatattgagtttagaactgctaatttttcctttaaaatgagcatacagtcatgtgtttcatggaccataataaattgccattgtgttatcattgaaaaaaaac

SEQ ID NO: 598834 - DNA, 107 bp, Homo sapiens
catcgctttttcatgtgatctcatccatcaaaggagattgatcctatttcctcctcacgggagttggggtgagaataagtatggtcctgcagtgaaacacccacgaa

SEQ ID NO: 598835 - DNA, 723 bp, Homo sapiens
ggtctgttggagccatgaaggcagagggaaagagggctgccattcctgacagcctcccagccaggctggcgataaaggaccgagatagatggagggggcgagtagggaagtcctcttctaaaatgagagatagggatttggtggggtatggaaggaactaaccccttccctcgtccacctctgattcagcccttaattcgttggatctatgataaataaagttcagtagtctcacattccccatctattaccctaggtgtgtattcaaggcagtcagcggtagaatccatgtagttcccagcagttgccttcccctcagggatggaaggaagagggtctcttgggctggttgagggcacattgggggtgtctcatcagagggacctcgactgggttacccagtcagacgtggaggccagcaggcctaccctgacgcatctctttagctgtcaccaaggacacacataaaacccgactggtctctcgtagcttggccgctggtctttcccgttgctccctggccataagcatgtgcattagggcgattccttcctccccttcatctcaccaggggaacgggagacggacacgagtcgtcctcccactcgaacggggtactggcccttctgcaggtgaccatcccacgacacgctgtcccccattcgcctgtctcctttagactgctagaaacaccatctcggactctgcatcatggccgtggcg

SEQ ID NO: 598836 - DNA, 173 bp, Homo sapiens
gtctagagatccataggcgcgtctggtacttattaaaggcttaagaaatctatagaaatctgttcagccaggcacagtggctcacacctgtaatcccagcactttgggaggccaatggtgggtggaccacatgaggtcaggagtttgagatcagcctggccaacatggtgaaa

SEQ ID NO: 598837 - DNA, 189 bp, Homo sapiens
atacgagtcgagccggtaccctggattaggccgcatctagttagggtctcgacctgttgctcctatattatcgcgacttcctgttgttaggttgcttatcctaaacaatgaatctgaggaggctactcagtagacagtcccaccctcacacgattctttacctttcacttcatcttggcccttatcgag

SEQ ID NO: 598838 - DNA, 349 bp, Homo sapiens
cccatcattatgccccagggcgtgcagcacacgtgaaaggtataccataatacatattggctgggtgcggtggctcacgttggtaatcctagtactttgggagggtgaggcaggtggaccacgaggtcaggagatcaagaccatcctggccaatatagtgaaaccttgtctctactaaaaatacaaaaattagccaggtgtggtggtgtgtgcctgtagtcccagctactcaggaggctgaagcaggagaatcatttgaacccgggaggtggaggttgcagtgagccgagattgtgccactgcactccagcctgggcgacagagtgagactccatctcaaaaaaaaaaa

SEQ ID NO: 598839 - DNA, 284 bp, Homo sapiens
gccttcgatacgcgttcagctgcgacatagatgaagctgaacatctcgttcccagtacaatgtgggtgcaagatagcgtcatcgaagtggactgcctgaacgtcgaaatgttcgagatctttctattgacgaacgcaataatggccgagcagacagtagcatgtctgtaccagctctgtgccctgaagatcctggaatggccttactgttcgttccagatggtcagctgagtgggatacaacgataagcacagtgtatgcctccattggaaggaacgcggtagt

SEQ ID NO: 598840 - DNA, 694 bp, Homo sapiens
ccctgtagggccaaaaagaaatggcctagttaggctgtaaagggtgcccttactcatgcctgtaatcccagcactttgggaggccgaggtgggcggatcacgaggtcaggagatcaagaccatcctggctaacacggtgagaccccatctctactaaaaatacaaaaaattagctgggcatgggccgggcgcggtagctcatgcctgtaatcccagctactcgggaggctgaggcgggagaatggcgtgaacctgggaggtggagcttgcagtgagccgagatggtgccactgcactccagcctgggcgacggagcaagactcagtctcaaaaaaaaacaaaaatttagcctgggcagggcattggctgactggtgccgtgttaatcctagctacttgggaggctgaggcattgagaatttgcctgaacccaggcaggtggcagcgttgcagttgagccgagatcgtgccactgtactccagcctggggtgacagcgcgaggactccgtctcagaaaacagctggcgctgttggggaccaccctgtggtccccagcctattctggagactgaggccgggaggactgctcgagcccaggagtcctggctgcagtgagctatgatcctgccactgttttacagactgggtgcacgagtgagagcgacctgtctcaatcatcaacaactccgcccgg

SEQ ID NO: 598841 - DNA, 1322 bp, Homo sapiens
  misc_feature (722)..(722): n is a, c, g, or t
  misc_feature (739)..(739): n is a, c, g, or t
  misc_feature (745)..(746): n is a, c, g, or t
caacatttaattatgaatgcccactccccagcatctagatctaaaattattaacattagccacattctgatgctctctctgtgtatgtatatgttctctcgtgtcctaattcaacaagtacattcgcaagacatcatgaaacttgagtccctgaaaggtccatgcctgcatctcctatgagcttagggcatcgttccttacactattgggcccagatatcacagtcaaccaagacgtagcaagtcttgtttctcctagacgaatgatcatgctatcctaatctgtgattcataagtcccccgcaatagtctctccagagctcaacgttatgtgtctggtgttgttggtaatcagttgatccagctgcacggtgcaccactattgctttggctaactatgttcataaaacctcttttgaagtgctgactacggtctttcgccctctagctgcaactgtgtgagctttattaaatgagcatctgtttatgaggccctaggtctgactgtgcttttatgaagccccacattctgaagtttgtcacattgttgctcatggtgtccgcatgaagccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcangagctctgggggggccnggaaanntctccctgagagaacggccgtacatatcttggtgccttggacaggaacggacacagggctctggacaggacgtgagtgctgcatgcctgacatggctggtcgccttcgaccctggtggactgtggtgccacctgtggcacccaaaacacactcatatgtcatcatcctcgtcttactactcttatggggagtccacacgggttatatccatttcacttgggcaagaccctgtgagtcatcgatgtagcacctcgcgagcatagatgacagtgctctcagatttgcaagcaagtggacacatagccataccattgggggaaccttagctcctcagacaacaacctgttggatgcatgaaggacagcacgcccactgcgcttggcgcacgccacgagcaagcctcgatggaacggatcagccttcccaccagaccggggtggccattatacagtagcagtgacctgcacccgatccttcctccccaaggacacctcagtctatcattcactcctgtacgacatgaacagtgactagggagacacaagcaggagatttttcaaaacattcacccgtggg

SEQ ID NO: 598842 - DNA, 125 bp, Homo sapiens
  misc_feature (19)..(19): n is a, c, g, or t
actctcaccctgaggcgtnctgccgtggagttctgccgggctgagctcctattcttgtcttatgcacaacgatgaccgggagggcgatagtcacgccaccttcgttattgcctctgtgaagagag

SEQ ID NO: 598843 - DNA, 307 bp, Homo sapiens
aagagcaagctacgagctactccaaagggagtatgtgccaaccagggtgcagaccacagctccctctggcctactcattcaaccacatagcccgtgcccgtacgcctcacccgggctcaggactgcaggccacctactcatgcacctaattggaagcgccaccctagcaatatcaaccattaaccttccctctacacttatcatcttcacaattctaattctactaactaccctagaacgtcggtcgccttaacccaagcctacgttttcacacttctagtcccattcaacctgcccgacaccacat

SEQ ID NO: 598844 - DNA, 216 bp, Homo sapiens
aatccttgttgagctgcatatgaggtgttgctcggtccctcgggggatcgcacttcatgctctttcgactctcgagacagagttggaaggaggcggagagtccggttttcagaaacgcgggcagctcatgggaaatcttctgtcctttcccctcttgtgtctcgtcaactatatcacgttcaagttctgtgtacccattgagcactaagcgaggtc

SEQ ID NO: 598845 - DNA, 313 bp, Homo sapiens
  misc_feature (207)..(207): n is a, c, g, or t
cctcagacttttcccagggccctccctcaaattgtctcatgggaaacttgaccagtggcaagttgcactttggtgatcttggtggtctacacacccgttctgtggagagtcgatttacataagctgtgtatactcactcacacacactcacacacacacacacacacacacacacccctaccccacactgactgtctaccgagaaanactgtatttcctggcaaacggcctcctgaactctgactttgtgtgtacatacttgtacacacggatttctctgggttttggtttgctttttccttgtgtccccctg

SEQ ID NO: 598846 - DNA, 259 bp, Homo sapiens
gaaacaaattgagacatagttcaaacagtttctttcgatagaatttgaaagcagaactatttgggtcatgtagaaacctggggcacagaggaaatacatggggtaaccatgctggaatctctcaacagtttttatttggctgaaacgtgctgggactagatccaagtgcaggtggatggtgggacaacgggaaatgaataaccgtgaccagatctctacgcaggctatggcttgactggtgcatgcctctcaagtgata

SEQ ID NO: 598847 - DNA, 186 bp, Homo sapiens
aaaaaaaaattttgcccccccggggggggggggggaaggggcccccccccccggggggccggcccccccccttttctttttggggggggggccccctttttttgaagggggggggggccccctccccccccctttggggttttttccggaaacaaaccccccccctttaagggggtggcccctgga

SEQ ID NO: 598848 - DNA, 1209 bp, Homo sapiens
  misc_feature (684)..(684): n is a, c, g, or t
ccaaatcgtttaggcaacctcggaggcaattgggaaccctcggggcccctggcctcggtggcttcaacctcttgcctccaggcatctttgatcttaagggattgttttgccccaaatcatttcaacccaagattttagtttgaaagcaatgtcctggccggttttgccggccccaaggaaagcaaggcgtgtggtgtggaaacaattcttttcctttcgttcatggaatgcagtatgccaaggtttcatccacgtacgacaagactgtacctatcgggacgccataacactggctttgtctttctttcaatcccaagcaacaatggaacaaccttagattatggtgcacccgtttctcaatggcccaattaccgttcctggctagatgtacaattgcggttgttcccaagctagattaaagcagcggctcttttgagaggcaaaccgcacaagatgtgccgtgcccagcatagactagggcaatggctaactgcaccataggtgtagtgtgggacttctgttcacctggcattccttgcatgctcgaagcactcgcgtacatcggtaaccctcgcaaatgtctgcttgactggcctacgcacgatcgccctcaatgttgatggttgcattttctcgagatcgtaggcgagccaagggcggaacctcatgagcggcgtcccccanatgtcgcctaccttgactacctagtgacatcacgtagagataacgacatactgaagcatcgtcaccaggcgatccaccaagcccgtcccgcaaccaaagtggtgtaccaaagacaggtggaaaggggtcctcggactaggtggtccacgcgagcatgcttcagtgcaatgtctcttcgtatgtgggtattcggaatgccacatgacgtctagaatctgcctgtgccacacgggaacacaagatgcagaagacagtcacgataatcctaaaagtgattgctagctcacacatctttgaaatgggtgttgttattacagagcagcatgctaggacgatgaagggagtacaaggggacaggtgcccaggagccacacaactcccattcctcactttcggactgctgcatatgcatctatagctctctcgtgacctctgaaaagctgtctcggcgattttgtatttactaaaacctctccccaccccccaccccccaacttcctggatatttctcattgtctatgttga

SEQ ID NO: 598849 - DNA, 111 bp, Homo sapiens
  misc_feature (105)..(105): n is a, c, g, or t
tcacacgaacccccgaagagcccgaaaaagtccaagatctcggcgggcacaggagcctcatccccccatccgatctgaggtcagtcctctccagaatcgcgacangaggtc

SEQ ID NO: 598850 - DNA, 171 bp, Homo sapiens
tagaagtcaagaattgaggtttggcaaacttctcctagatttcagaggatctatagaaatgcctggatgtccaggcaagagtttgctacagggcgtggggctctcatggcagaatctctgctaggcagctgtggatgtggacaatgtgggcatacagagcccgcccacaca

SEQ ID NO: 598851 - DNA, 265 bp, Homo sapiens
cctttttgagatgaagtctcactccagcctgggcaaccagagcgaaactccgtctgaaaatatatatatgtatatttagagtagtgcttggcacatagtaagcctttgttgttgttagcgcttactgtgtaacaaatcgctgcgggctcaaaacaacagtcatttattcagctcataagtctgcaagttgaggacagttggccctcggtatctgtgggtaccacacgggagaattcagcaacggtggatagaacatattcttaca

SEQ ID NO: 598852 - DNA, 174 bp, Homo sapiens
gatccccaagccgaattaccaagcgttggattgttcacccactaatagggtttcgatgtgtcatcgaaaccctcttggtgctttctggggaatccttgttcaaaagggtcagatctttgaaagatttccgcacaccacttccaagaataaccactttacaatagggtttgatga

SEQ ID NO: 598853 - DNA, 1156 bp, Homo sapiens
  misc_feature (467)..(467): n is a, c, g, or t
gccgcccttttttttttttgtcccactctcataaaaatataatattttcacaaaagaaatataatacatgggaaaatcacgtggatgggcgtgcttcttcggtcttttttcccggggaagtgtggtagggtggtaggaggtctctgggtatttctttctttaacacagggatatggggctggttggaaaattattctcaatcaatcttttatcaatcaactctatccaagtccaagctcacactggagaatttcgcggcctctccaaaaagaggtggggtggtcacaaaacggggtgggggggcccggggttaatccacaggagtctctcctcaggggtgtggctcaaggatgtcaccgtggaacactatgtttctcttctctttcttaacacgtgtaaacaccgtgggccctcttgtggtgaagacgtgtcgtggacgagattaaaggtttttggagagaataatntttctcgcggtgttctcgtggtgcaaacactccacacagagacagggagagacatatcatataagtgtcaaaaatctccctatatatttcaacacgctctaaaagtatctctatctcgcgtgggagtaaaactctttacctatctcctattatacaacatctcgggctcctctcacatatcccgtgaaagcgctttggggtgtgtcacaggtgtgctccgagaatcacgcgagattatatacacgcggttacaccacgtgggatcggcggatcaatgaagaggggggctggggctaaacaataggggggaacatataattccccaacggccctttacaaaaacaagaatgcacccaccggggggaacccagagcgcgcagagggggggacgcggagacaacccccggcgggcggcacagcgacgacaacaaacacatccgagcagacaggcccacagagtgcacatttccccaaacgtggtcgtaacagggggtgttccccaagagagcaaacggggcgcaccgaccacgacgacagaaaacatttttgtctcacaacacagagcgaggaaaagaccagcacacacagaacagtctaactcctgcgaggaacggaaatagcggccggaaccagagggggacactcctgcggattctcgtgggacacagaagaagctcccccgagatggg

SEQ ID NO: 598854 - DNA, 1357 bp, Homo sapiens
ggttctttgcccgtgctgtgtgtgtgtgtgagtgagagagcgagtgagtgagtgagtgagtgtgtgtgtgggggggactcggctatgtagttgtcggtgacttcccgctcccacttaccgaacgcgctacacctccccgtgccgcagccgtgtccgactcccatgcagccggtatagaaactgatctttatcctactgatagtcgtagctagtagatctgaccgtaaccacaccaactcgcgtgttacccatcctgtcgatatgatctacaactgtgtctcactcactacattgctctctggacactgaaacactctatgctaccacatctcttacaccacacaccatgccatcttcaccgcgcatctagctggtgtactctacgcttacactacttatacatatcgccaacgtgtacgacagtatacggtgatactacacctgatgatcacaccacacctctaaacatacgaaatcaaaactgcgtctacaaagtacactacattctatcccccagctacatactcgacagtacaccgacacacaacctcctccaaccaaccacatctacagtctcaactgcatcttaattcctgacacatcatcatcactatgcaaacagtcattgagacattcagtcatcagaaatgacataccataaacaatttggtgcaacgctcatatgtagcactaagttctactgaaattgaccgtcacatatgttacactcaatatagtccgaacaccaacatacaccatagtactcagcatcgctcacttcgcatatgacctatcggaacactccgtactacatatactccgctccacttatcccatacaaagcatctccatacttataatcaccttccctatgccatctcctaaacactagtactcaaccacgtgtgttccctgtagctaatccatagatcatcatgtttaccttttatatccgactatttgctatgcgctactattgtcacgtatccaaccacgatctatttaatctaatcacacttcgtcagctaaccgtgttactggtatgataactacctcatagtatatgcgactcgttgactagtgacctacatactatttcgactttctgagtcactatgtacccatcactaagtagcttcatgatcatccacccttacatgatagagtatactatcatctatcttaggctccacttattaataccgccatcctactctggatatgtctcgtatacctcttcgcgtacgtggtagtcggtcaaggtattaccatatctcctctataatcactcattactcttccccagatggcaatttatgtatccactatccacaagactatacactaatattcaaat

SEQ ID NO: 598855 - DNA, 229 bp, Homo sapiens
  misc_feature (44)..(45): n is a, c, g, or t
aaaaaaaaaaaatcccccccccccttttttttgggggcccttgnnttttaacccaaaaaaagggggaaaaaccggggggggggggggcaaaaggcacccccccttttggggttgggtttttgggcccccccccttttttttaaaaaaacccagttttaaaaattgggtttcagggggccggggggggaaccaaatttgtttcccccccagggggcccctttttttttta

SEQ ID NO: 598856 - DNA, 440 bp, Homo sapiens
tggtggtgctgtagaactagaggataccggttctcgagtcatccaagaagagttaacaaagtcagagcaagagttgaaatagtggtatatgctgaccattcatacgcgtgtatcgaatgatctcgaggactccgagacccaagtagtataacctgtactgaagctgtgtgatgcaaaggattcccagctgggttgtacagaaagtgagactccaggaagctgaccagctactgagtactcgcacagaagcattagaagccttacagagtgaaaaatcacgaataatgcaggatcaaagtgaaggtaacagcctgcagaatcaagctctgcagactcttcaggagagactgcataaagcggatgccactctaaagagagagcaggagagctataaacagatacagagcgagtttgctgcacgccttaataaagtggaactg

SEQ ID NO: 598857 - DNA, 900 bp, Homo sapiens
ccagtagtagcccttgcttacacaattcaccatgccctctataacttggccaaagaccagatgcttgccagtctagccaggctgtcttgaatgtcgtgatgaagaactgggagccgttggtgtctatgtctgcagttggctcatgctcagcccatgcctaggcccgtaagtggctttcagtatatgaatgctttcttcatactgaggtgcaatgacgctactacctgatatgcatgctctttcgctgggaagaacaagatcacgagctaaggtcatggggcgctgcgcatagctgccaagacaacgcgagatattcggggccaggactgaaggggcttaacctgtctctctgttgccacggctaggctggtagtggaactacaaggaccgagtaacaagcagcgtcctgtacctatcttactggtcctcagagccaagaccatgctgacatgaggccaagtggggcatcaggccaggctgatgtggtgaacacgactcacagaacgattaccttcgagaagatacgtcaagtggacttttaaactaatggcgcatgtaatcagctccgcttatgctatggtccaggacctgccactggagggacctattgctgccgggaagtgccggtgccgtaatgcagggggagtcaccagggttcgtgaaaactgctgccagatcacgggaggcactgctgcggactgaacagtctgtatcactatgaagcacaaacaagacagcaggcagtggcatgccgaaggcaaaaagcaagccccgagatgtgatggggacggggccaccctaagaaggggcttgcccctagggataccggaaaagtcaaagactcttcaaaagggaatgaccagcactccaggacaccgtaactgttcaacaacaaagtct

SEQ ID NO: 598858 - DNA, 489 bp, Homo sapiens
  misc_feature (86)..(86): n is a, c, g, or t
  misc_feature (95)..(95): n is a, c, g, or t
  misc_feature (264)..(264): n is a, c, g, or t
  misc_feature (269)..(270): n is a, c, g, or t
  misc_feature (274)..(275): n is a, c, g, or t
  misc_feature (277)..(278): n is a, c, g, or t
  misc_feature (281)..(281): n is a, c, g, or t
  misc_feature (284)..(284): n is a, c, g, or t
  misc_feature (336)..(337): n is a, c, g, or t
  misc_feature (425)..(425): n is a, c, g, or t
  misc_feature (437)..(437): n is a, c, g, or t
  misc_feature (447)..(447): n is a, c, g, or t
  misc_feature (452)..(452): n is a, c, g, or t
gccggtcccgtactgtcgcgggatatagtaccgtaaggcgaaatgatgacattataaccaagcatgattatcagcatacggactanccccgtatnccttctgcatatgaattaactagaaataactttgcaaggagagccaacagctaagtacccccgataaccagacgagctacctaagaacagctataagagcacacccgtctatttagcaaacatagtgggaagatttataggctgaggcgagcaaacctaccgagcctgnttatnnctgnntnntcnctntataatcttagttcaactttaaatttgcccacagaaccctctaaatcccctnntaaatttaactgttagtccaaagaggaacagctctttggacactaggaaaaaaccttgtagagagagtaaaaaatttaacacccatantaggcctaaaancagccaccanttagnaaagcgttcaagctcaacgcccactacctataaaatc

SEQ ID NO: 598859 - DNA, 140 bp, Homo sapiens
  misc_feature (61)..(61): n is a, c, g, or t
  misc_feature (63)..(63): n is a, c, g, or t
ctgctgtgtttggtgccatcatctcttactttgaacagttttttgaaacttttggaatttntntggcaaatcaacagtacgtttcaggagacggcagcgaggcttaccttgcatggtgtggtggacgagcttgttcggtt

SEQ ID NO: 598860 - DNA, 850 bp, Homo sapiens
agggtgaatggcgcggtgttgttgtttgtgccgggtgtggtgctggcgttgtcctgtgctgtggcgtgcagctcactggacggccctggtccccgcttgtgcacccaggggttgcctgccgagcggcgcttctggcggacccgcatctgtgggacactattcaggtggcggcgccccgagattgggcgggtttccctctccgcccgggatcttcaaattgggtgtcatatctccttgtggccaggtccggtagctgacgggttgaggttgcccgcccgagtagcgcctgggtgggacccgcatgttcaagggaccgctgtacgtgctgtgtgtcccgggtgcgtctccaccgtctgcccccaagggttgcgggcccgctgcgggacacattgtttggccacacaccccgcagggcaaaactttgtgcccgggccccatctcggcaacgcgggcctcccgtcgccgcccctctgcgatgcgttgggtcaggactttgcataccacgatcggtggagggtgagtgtgttttgatactccccgaggggccctgcggaccctccttttccgagttgggcaaaggagccacaagcacggaggattgtctgggtcattgcggggcacccacaggggggtgtgcaacggccgcggaatctcgggggtttcgtcccgcttgcggtcacgcctgattctggggcatcttctaggcacgtgggaggcctggggggtcagttgagcattttgagtctctcctccgggagctttcccggccgtcaacaatctccccggactgtctttccagcacataccacaacccaccacattttcaaaaaaaacgttaccccccacatac

SEQ ID NO: 598861 - DNA, 462 bp, Homo sapiens
ggaattcgaagtgaattgttggaatgctgtgggatttttgaacctcaccaaatactcctctgcgtaagcgaggttgaccagcaaagagatgagtatgcactgtggcttcatgaccagggtttttttgctgttttccttggcggatgttggaggatgtctagcacttgagtatacctctatatgctgtataaaatagaaaataaaaaagccaatgaggacaatattttgtgtcgtttttttttattttcgcttcaattctttatacacgtacgtcatcactacgggaaaccaaaaaaaaaaaaaaaaagagaacagtacaaaaaggtttactttacccataattagtatacgtagattttacacacgcactatttttcttatatacaggagatgggtggccacagaacccgcgcctagcctatttctttcttcttagacctgcctccaggtcgccgacatcca

SEQ ID NO: 598862 - DNA, 160 bp, Homo sapiens
ctgcgatcctccgctcgttcattgaccgtccaatgtgcttcgggcgtcctttcacttgcttcctcacgttgaattttatgagcttcgagagccttatttctccccgaaccctcctaacacgggtccttgggaggctgaggtgtcgcaaaaatccgttgca

SEQ ID NO: 598863 - DNA, 292 bp, Homo sapiens
agcaggacccggtgtatccttgtctctccatataaactgtagaaaaatttgtcagtatccaaaaaataacttatggggattttgacaggaattgcattgaatatatagatcaaagaagagctgatacattagaatattgagtcttcttatctacgaacatggactatctttccatttattttgatcttcttttatttctttgattttttttttttttttttttttttaaaatgggagtcccccctctgtggccccaggcctctttataacctctctttaaaaaataccaaat

SEQ ID NO: 598864 - DNA, 170 bp, Homo sapiens
tttttatgttcagttcatagaaaaactggatgatacccctttaactttagccgatatgtttatacacagaattttttataattaacattttaaacttgcttaacttttaaacaaattttttttgcctttatttggaggtcaatttttgccttacctttaaggtttctctc

SEQ ID NO: 598865 - DNA, 185 bp, Homo sapiens
agagaacagaaggactattgggagacagagctgcttcaactgaaagaaacaaaaccagaagatgtcctcagaaaatgaggagatgggaatcagagtggatcagcttcagggccagctgtcaacttaagagaaagaaatgtgaggagcttgttcaggggagagtctaaggtatagacacgagcagt

SEQ ID NO: 598866 - DNA, 203 bp, Homo sapiens
taccggtatcccaccgcagaaactgacatataaatacgacatataaaaaataagacaataaacttgtacaatatggtaatataaccatagctagctaatacaatggagaattgggagcttatcttaaaatcaagtggcaagccagctgctacatatggtcaagcaagaaagaggctagacatctctcctttaggcaagaaaat

SEQ ID NO: 598867 - DNA, 655 bp, Homo sapiens
  misc_feature (425)..(425): n is a, c, g, or t
ggatggaacgacgccgccccggtgcataagcctctcctggctgaacagagacctcgcgtctcccccttagtgcgggcgccgccacgagacacaacaatatgcgcgcccgggcggggtcaccaccaccgactgagcctcgtcgtccaccaggggggctctctagacacaacgcggcgcttcaaagcgcccccacaggtgagatccagacaagatcgccgcctcaccccagttcgagtactgtccgctagagatatgcacacgcccgaatcaatgtgggtgttctcccgtcgccaggagatccctccgatgtaccgcgctatacactcgtgaggaggagaccctcttcctccgcgactgacaaagcagtgcttgcgcacacgtagactcctcccggggacaccacctgatatcaagctgagggacancatgtagaggcgctctcgtccttcacgcaagatgttcgcacgatggcacatctattttgctctgttctatgagaagtcattctataatgtgcttgctcccggataatgttgttcgaggacaccccacgatttctgtataagatttgttgcgggtctattacaaacaaggtgagaatctttttccaggtttcaaaaaaaaaaggccgaaccttacccgtgcggacaaaaca

SEQ ID NO: 598868 - DNA, 124 bp, Homo sapiens
cttgtgaaaggatcataaggaaaggatgggaacactaagatgagtgtatttatagataaaaatactaaagtattggtacaaggtattacagggtctactgcccttttccatacaaaacaaatat

SEQ ID NO: 598869 - DNA, 321 bp, Homo sapiens
taactggagacgtcctgtgaacatcctcgagctgctggcaccctgaaaaccaaggatgtgcagtggcgctcaaggtgcgagcagttgtctggtgaacggcaacaagcaagccttgagcgaaccggcgatattggccgccttgcgtgaacacaagccggcgctgatcgaactgatcaaggccggtgaatacaccgcgaccaaggccggtgaggtgctggtgccgttcaatggcatcccggacaacgccgagcgtatcaatccccagtatgctgaccctgtcgaacctgaaacaggacgagatcgagcgcattgagatacggt

SEQ ID NO: 598870 - DNA, 865 bp, Homo sapiens
  misc_feature (95)..(95): n is a, c, g, or t
ggcatcatggtgaccccgaccccgtaccctcgctctcgatcgaggacgattcaactatggcagcagtgtgctctgccacgtgcacatccgaatgnggcccagaatgcaacagatcttggaggattattgaggcaagtgctcaacacagaagcttcctaagtcagtctacaatggtgtttcaagttattagcgtagtagccaatgggcagaaattttgaataaaatggctcagttcatctacgtggaagccaatggcctgtctagttgtgtcatttgatcgccgaaacagacccaggactttcaggcttgtttagggcagtttggaactgtgttctgtgaacaggacagcatgaagatagttctgattgtgctaagaatcttaggtgcctagaatgtgtcctggaaaacaggaccgatgacagatcgttctggatgcaccaagaattctttggtgcctagcattatattttttggactggactttgtgacattattttggggccgtgaactcagctttttttacacaacattaacttgtggtacaaattaccggccttttgtggagaaaagtctaacagcattcctttcctcttgcggggttctcttaactacaggtgacttccaacacgtttttatacctgtgagtcggacggacattgtacctggcgagccctgcgtaaatttgggtgtggcccccgactccgtgcatgattgggtgcttaaacggacttaattttccttaactgaccactttgttacgcgtggacgcgctgtgacagtcgactacagaggattaccggacgggacagccaccagatggggggggtccaccactaggtcactgaccggctctggttattcccca

SEQ ID NO: 598871 - DNA, 1225 bp, Homo sapiens
  misc_feature (170)..(170): n is a, c, g, or t
  misc_feature (380)..(380): n is a, c, g, or t
  misc_feature (396)..(396): n is a, c, g, or t
  misc_feature (730)..(730): n is a, c, g, or t
ccctggccttcccagcagtgtcggctgagcccttcctctactccagtgacctctatttggctctggcccagccaggagtcagtgcctgcaccatcctgaagtgggactatgttgagcggcagcttcgagactatgatagaatcccagccccctctgcagtgcactgcaanccgatggtggtggacagccagctgtacgtggtcgtggcccagctgtttggcggctcttacatttaccactgggatcccaacaccacgcgcttcaccaggctgcaagacattgacccgcagcgcgtgcgcaagcctaacgacctagaagccttccgcatcgacggtgactggtactttgccgtggctgacagctccaaggcaggcgccacnagcctctaccgctggnaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcngcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccaggctactcctgtgccccagcttcgcaggggacagacgctggtgtctcgcacacattgtggctggatctcagtgcctagggggtgcgaggcctctggtctcctcaggctggccactggaggatgggtgggggcctctgtgagcaccacgctatgcctgtgtgaagacaagcgaccaagctgcattcatgcccgtgtattccgctcacgcaccagcgatgtacatggcgcacccccgtgggactggccccaggaggacgtgcatcatcactgcaatcaggcattaatctccagggaaccccatgagaaaacctaaaggccccatgttcccgtaga

SEQ ID NO: 598872 - DNA, 135 bp, Homo sapiens
  misc_feature (115)..(115): n is a, c, g, or t
tatagctggcccctcttccgttctcaggtattgcggagcacttacgcacgtgccctccaggtaggctctccactgctccgccacatgggccgcctcccacttgtgcttggtggtnctgagctgccatgtccgggc

SEQ ID NO: 598873 - DNA, 367 bp, Homo sapiens
ggtcgaccagagacagataaagtatgaagctccaaggcttgaactccagggcgcttcacttgcatgggacctttctaaattcaccttatacctaattgttaatctttttcccaatgagggcctaccgcattttgtaagcctggggtagggaggatgggtctcacaaaatctagatggaccctcactgagctacagattcaaaggcgttccaggttccctcagaagccagtggaagagacagatgtgaaaacaaataatcttttttctttcttttttttttttttgtgagatggagtcttgctttgtcacccaggctggagtgcaatggcacgatctcggctcactgcagccgctcgggaggctgagg

SEQ ID NO: 598874 - DNA, 432 bp, Homo sapiens
  misc_feature (16)..(16): n is a, c, g, or t
  misc_feature (49)..(49): n is a, c, g, or t
  misc_feature (71)..(71): n is a, c, g, or t
  misc_feature (302)..(302): n is a, c, g, or t
ggtccctcaattaccntagaaaattccctttggaggacacgagaaaaangggtggggccaggggccccttnttcacccctaaccagcaggaagtagccagaacgactgccacacggttcccaacagcagttggggtgtcctgtttagaggcaggactgagaggaggtgccagctgggcttcctgggtcaagtaggggctcagaaagctgtgaaactcactcatttcctgcatcaggacttacttcagtcctggatgaataatattgaagatatacgcttaaaatattcctaacaccaggatntcgtgcatgtgtttttcttccccaagaaagctaataaacagtgaaaaatttgctgtaagtttccctgtatattctctccctctctcccttcccccgcccctgaaactaaaataaaggaatgttaactgct

SEQ ID NO: 598875 - DNA, 197 bp, Homo sapiens
cggttagaggcatgtaagaaggacttgctttctctacatggactacagtggacagaaagagtatacggtctgtgaagctgatgccccatgagctggagagggggtctcattactacaaagagagaggtggtccccgcttacttgaactcctcctccttcaagctcaaagaccacctcccaatagtgaccggagactg

SEQ ID NO: 598876 - DNA, 881 bp, Homo sapiens
  misc_feature (36)..(36): n is a, c, g, or t
  misc_feature (52)..(52): n is a, c, g, or t
  misc_feature (386)..(386): n is a, c, g, or t
caggtacccaatgcagcggactcggcaggcgccacnagcctctaccgctggnaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcngcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccaggctactcctgtgccccagcttcgcaggggacagacgctggtgtctcgcacacattgtggctggatctcagtgcctagggggtgcgaggcctctggtctcctcaggctggccactggaggatgggtgggggcctctgtgagcaccacgctatgcctgtgtgaagacaagcgaccaagctgcattcatgcccgtgtattccgctcacgcaccagcgatgtacatggcgcacccccgtgggactggccccaggaggacgtgcatcatcactgcaatcaggcattaatctccagggaaccccatgagaaaacctaaaggccccatgttcccgtaga

SEQ ID NO: 598877 - DNA, 336 bp, Homo sapiens
  misc_feature (211)..(211): n is a, c, g, or t
tctcccaacagtgaggtcttgaactgggtcttgaactcctccacctcccaaagggctgggattacaggcgtgagccacggacctggcctagggccatgtaaaaagccagatctgtgctgctgtctgtgtagaagggtagacaagtggatgagaagttccagaactattctgggccccttttaccactaagggcaaagtaactggctgcccncaaagaaagatgtctcgatcattcgcacaggacttccctagttgaacttcatgcaaagcaagagcatcctgtttttctggctcaccacgtgtatcttgagaccccggtctccacaggggtaccga

SEQ ID NO: 598878 - DNA, 311 bp, Homo sapiens
  misc_feature (68)..(68): n is a, c, g, or t
  misc_feature (127)..(127): n is a, c, g, or t
  misc_feature (129)..(130): n is a, c, g, or t
tcccctgcctgggtttggggtgcccccggacagggatttcggtggggcctgtcccccacaggaccccnacattcagggggtgggggagggcatcaatgtttttttaggtcctgggccctcgtccaantnntgccccccccaagggttttttccaggatcccaccaattaactgttttagggaaaggggcttcctgccccaactggatgggacccctggggagtgggggggggggagctttttccaaggcccccccctgtttcccccccaattaaaacgggctcttttttggccccctggccttgttttcca

SEQ ID NO: 598879 - DNA, 458 bp, Homo sapiens
tcgacgaggagtggaatggaatggaatgcaattgaatggagtggagaagagtgtactggagtggagtagtatgacattcaatggaatgcagggaagtggaatggaatggaatggaatggactggagtggaatgcagtggagtggaatgcagtagagtggaatggtgtagagtggaatggagtggactggagaggaatggagatgagtggaaaggaaaggaatggaatggaatggaagggagtgaagtggaatggagtggattgaattggaatggagtgtagtggaatggaatgcaatggagtggaaaggaatgaagtggagtgaagagaagtagagtgtagttgagtggagtggagtcgaattgaatggagtggagtagagtggagtggagtggagtagagtggagtggagtggaatggaatggagtggttaggaattgaataaattagattacaatg

SEQ ID NO: 598880 - DNA, 342 bp, Homo sapiens
  misc_feature (19)..(19): n is a, c, g, or t
  misc_feature (61)..(61): n is a, c, g, or t
  misc_feature (79)..(79): n is a, c, g, or t
  misc_feature (83)..(83): n is a, c, g, or t
  misc_feature (159)..(159): n is a, c, g, or t
  misc_feature (192)..(192): n is a, c, g, or t
  misc_feature (264)..(264): n is a, c, g, or t
  misc_feature (334)..(334): n is a, c, g, or t
caaacttaggtctcctctncattttctactacacctgcctcaatttcatggacgacatccnaaaatgtggatttttttnactntttgtcacgtacagtgatccacaattatccagtatagacatccacaaagagtcgcaaaagataactgtactgactncaggaaattttctactattcaaagactaacccngaatctaaagggcagaatgtatcagagtttcaatcagctcaagctaacatagtctgtaaacttgctggtccngcctcctgctaatattctaaaagtggtaacactcctcatcagaattacggaggcctcaaatattcacctnccccatag

SEQ ID NO: 598881 - DNA, 412 bp, Homo sapiens
  misc_feature (5)..(5): n is a, c, g, or t
ccggnacccaacattttgggaggccaaggcagaaggatcacttgtgtccaggagttcaacatcagccctggcaacttagcgagatctcatctctacccaaaaaaaaaaccaaaaaaaaaatttttttttaaagtcccaaggggtttaattaaatggcccctagggcccctggccaaagcctacatttggggggccagggcctgccaagttttccccctcccaattgaaaggccttgccccctgggccctaaatcacatgacggggaacctgggtaggcccttggattcttaaataaaaagccacgggggggtttcctaaaataataaatttggatgggggggaggggggtaattccgtttttataagaagaaaaaagggggggggccctttcctcttttagttcaaatatgg

SEQ ID NO: 598882 - DNA, 199 bp, Homo sapiens
tgaggtaggagataatgaccatcctgggttagcatgggtgaaaccctgtctctaactagaaatgcagagaatgggccgggcatggtggctggttcctgtggttccagctactcgagaggctgaggcgggagaatggtgtgagcccgggaggcggagctggtagtgagccgggatcctgccacggcactccagccggggc

SEQ ID NO: 598883 - DNA, 313 bp, Homo sapiens
tttccccccccccggggggggggggggggaaatttttttaaaaaataggggggcccccccccgggtttccccccccccccttttttgggcccccccccccccgggggggtttttttggttaaacaaacccggggtttggggaggaaacccccccccccccctttttggggggggggccccccctttttggggggggtttttttttttttttgggggggcccccccagggggggccccggggggttttttttgggtttttttttttccccccccttttcccccgggggcccctttttttgggggggggggccca

SEQ ID NO: 598884 - DNA, 975 bp, Homo sapiens
  misc_feature (28)..(28): n is a, c, g, or t
  misc_feature (829)..(829): n is a, c, g, or t
  misc_feature (856)..(856): n is a, c, g, or t
agccatgggccggatccgctagcggagntgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattccaccggagcgtgagcaagggagaagtccgcttctctggccgtggctctctgcaaggcagcctaatgctcctgtgggagggactttgctgatttcccctcttcccttcaacatgaaaatatttaccccccccatgcagtctaanaatgcttcagtacttgtgaaacacagntgttcctctgttctgcgaccgcctttccccttagcacgcccggcgcttagcgacagccggagtgcccgctttcccctgggcctgtggttgtgagctctgatcgtggagcttctccccgg

SEQ ID NO: 598885 - DNA, 168 bp, Homo sapiens
  misc_feature (117)..(117): n is a, c, g, or t
aagctgggccagtaaaatgtttttgtgaagactgttaacagaggctatctctcaggcatggataggagaatggtagatttctatctttttttccaaataattctgtactgttggagnttttaataaatataattatttttatacataaaagaatttttaaaggagatc

SEQ ID NO: 598886 - DNA, 549 bp, Homo sapiens
gctgaacttgcccgaacgggtgttataacgtgacgtttcagctggtccgccaggtacgagctgaaagacattcctcgctttcctggcacggtatgcacggatgcaacctaaaactcagctatcgctgatgcttcttcgctcacggctagcatcagccttctcaactgcaaggaccccttcacgtcaccaatcaaaagcatctcagacgagtaaccgcagatttgaacatggcatgctattggttcagctcgccagacatcgatgcaggtacgacgctcgagccaagccagggcccgtgttgaagtgctcgaaactctcaacaccgacatgagctgggcccggccgggagatcgcgctaagctggacgaagccgtcgacagcctcgaggaagccacaaactcgaccgagtggagggagtggaacaccaattccgtctccgtgccgttcgacgtcactcggctcaagtaccctatccggaaagcatggtccgacagccccagcgagcctaatgcgcttgacggcatgtctatcaccatgctacgcgttggc

SEQ ID NO: 598887 - DNA, 849 bp, Homo sapiens
  misc_feature (28)..(28): n is a, c, g, or t
  misc_feature (703)..(703): n is a, c, g, or t
  misc_feature (730)..(730): n is a, c, g, or t
agccatgggccggatccgctagcggagntgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggacgctgccaaggtctgcagagaattccaccggagcgtgagcaagggagaagtccgcttctctggccgtggctctctgcaaggcagcctaatgctcctgtgggagggactttgctgatttcccctcttcccttcaacatgaaaatatttaccccccccatgcagtctaanaatgcttcagtacttgtgaaacacagntgttcctctgttctgcgaccgcctttccccttagcacgcccggcgcttagcgacagccggagtgcccgctttcccctgggcctgtggttgtgagctctgatcgtggagcttctccccgg

SEQ ID NO: 598888 - DNA, 1016 bp, Homo sapiens
cgtggagaagagcgtgggactcggctgaccctgctcctcccgaccctcatgttctgaatgagcctgatgtgggcctgatggcagtggcaccagatagcactgcgtgtgccttgtggccctgtaatcgtcacgacctcctggcctgctgtgccatcctcgcaaaacaagggcgtccaagctgcctgccatgtctcattgtgccatcatttatctggtgccctatggaggcatgcagtctactttcgccaggcatcccacccagacctatgtactaacgttgactcatgagtgacgtgatgtgatggatgtgaaatgtgcacgaccgacactgccccaagaatccggcactcgtccaggccacgatggcctctgcctgacaagctacgcggacagaagatgggaacgcaaccgccctggtcacgaaccgccggggcacccagcactgccacggacaactgccagcacgcgagcagcacagacaacgcacccgaggcacggcaacggagactcgacacaccaaaaaacaggggcaaacccagggcccgacgcacggacacaacccgtccagacacccacgatgaccacaacagaagacgcagcgaaacatggacgcgccgagagcccaggaaagaccacacataagacaaaaccagaccacacgaacaagaacgatgggccaagcaaatggaacggcaaccagacgacggagagagcatgaccaccacaagagccatgggacaagggggacacgcgcaactcagacaggaacggaagacccagaggcaagaagacagaagcacacctgccgagaaagccccgccgacccgccgcccgcaccgacgcccaccccgtcagaactagcaatataaaaggtccgcaaacagcaccacgaggacaagagcgaaggcccggggaacgggcgagaggcaccaacggcgcaaagagagagacgacaggcaaccggcagccaccccaacagccacgccacaacacgcgcgccacagaacccacggacc

SEQ ID NO: 598889 - DNA, 138 bp, Homo sapiens
ctaagatccccgttcctggacttgtgggccgtcggaagaggcactgctctctgaggcccgctgacgggctgctgactggagttggggccgtctggacagaggcgctggtctctgaggcccgttatgggcttgatgccc

SEQ ID NO: 598890 - DNA, 239 bp, Homo sapiens
gaaggtgcatgctgcggatgggtacgatggagaaggcgctgcatggcacgcatcggagaagccagggctgatgctgcggcccttcagagcgcatggaggggggctctgtggccccatccattcaggaagggtaaggtgggaggatcgcttgagcccgggaggatgaggctgcagtgaactctaatcccgctactgcactccaggtctagcaacagtgcatgtgctctttcactccaggt

SEQ ID NO: 598891 - DNA, 138 bp, Homo sapiens
gttgccaaaaagttggctttgtttatttggttttggcggggaaaggagtggtattttatgctttttgtggacaatgtaaccctaaacccatcatgtattttaaatgccccccacataaataaaacataagcatattta

SEQ ID NO: 598892 - DNA, 157 bp, Homo sapiens
cacttcgttagtcttctggcgtgagctacgagacaatgtgagttacgcctcgagacacaacaatgaccttcacatgcttggtgtttgtctgacatgttcaatgcactaagttccagatcccagaccaagtctgtgttggagattggacttagtcccg

SEQ ID NO: 598893 - DNA, 633 bp, Homo sapiens
agttcctctccttcaaaagcttggtctttggttttcctattagggaaaacagtcaaaataagttccaaaaactatcctccaagtcctattgtgcttgtagtacatgacggttggatggatggatactgaccatggtgggcaggccattcacagcctttgtcaaattcaatacttttcggtcgtctggcttcattaagattttggtcattgcagccaagacaccagttggttggtgataaactgggtggttggtggatgcttcaagacacacggttaaccaattgtattaatatccccctttcggttccgtccccatgggtcgtcaacataggacatttccatcattattggctccaagcgcatagcatccacccaggatagactaaagatacaccaagggggaaagcacaacacattttcttgatactttacagacaaacatggtcagattctctataggatgtattccttcaacattggatattggcttcgagtcctccttaccacacatggaatagatgttagcactcctagcattagagttcctagaatgggggtgatagctacaggtccgggatacctggctgagggtactttgccttgtagcaccattcgactaggtaccgggccctg

SEQ ID NO: 598894 - DNA, 135 bp, Homo sapiens
tgtagttgctggcgtggggctgggattgtttatgttcttgtccttgcaacctatttctggaaaggaaaggctagtgggtcaggaaatgaaatcagtctcggctgggagactgggagagaaaagccctgaatcaat

SEQ ID NO: 598895 - DNA, 204 bp, Homo sapiens
catattgagataactttaatacctcagcagatttgtcttcctttatattgttatcttttttatgtgccatgttgcttttggaatcagcctgactctctgccccagtatatgatagttctactgggtattttactgtttattgatgaacatatcttcattaagaattttttgaaaactcatcaaattccaatgaataagttttct

SEQ ID NO: 598896 - DNA, 1306 bp, Homo sapiens
  misc_feature (893)..(893): n is a, c, g, or t
tctcaaaaaaaaaaaaaaagggacatagggaatggagaatgattggattggagtgggattcacaacttaattaacgtgggtcacagattcaacgtggtggaataatttggtaaaagaggccggggttaatagaatggagggtcagtttggaaaacaaaacagattggatgtcaacatttggtgactaacttggggtgctctttccaacacacattattagattgacaaatttgtggacagtgagtgtttagaaacttgggtgagttaaagggatagggcgatacgacatattttcttaaaatttcaaaattcagaagcttaaagggtcgcatagaactcagtaatattgcggaaaaaagtgaggcattggttcggggacaaacggaatttattatctactaaccgtggggtttcaaaacatttccgagggcggggagctctatacaaagaaactattggctcattgaagagactctcccatattctgggtgcccccaataaggttaattatcaacgtgtatgcttaccaaccccgccaaaaaagaacactaaagggtgtaaagtgggcatcacaccatggggggggtgctacccttaacgaggcgaaacaacgggcgttgctatgtggacacttcttcgccaagggtttacacaccacacagaattgtattatcccgcccgtggtccgtctacaaacacgcagcgcgaggggcaacacaccattttgggaaccaccgtgtggctgttttcacgcagttatcattttccccatataaaaaacggtgggtaaattctgtgggggacacacagtttgtttttaccgcagatggggatcaaggatgaattaattatattaccagaggggggcaatattatcctacaagttataaggntgttgtggggcattgccttgtggaccattttatttaaattgcgcaattggatataatggggaatgttgtaaacggtgggaaaggctatagggggggaggatgttcttgtaacagaagaacgcagggggggattccttataagaaaaatgcaggggcaacatattttaagggctgtgaggacgttataacaagacatttatgggggttatacaacatgtggggtgcatgaatcgttgacaaaggtataactttaagaggcaactgtggaattaaaacatatgtgtgtgtcccgagttgaaatattgtccgttggagaaaagaaactttgggggtggttatgtcaccaagaggataaaattacatgggggagcacgagtacataataaaagttttataaagaaggtagtgatggg

SEQ ID NO: 598897 - DNA, 223 bp, Homo sapiens
cagagtgctgccctttcttgccgctgactcgtcccgtctcctcctcccaagtcgcagtgcccttgttagcgcaatagcagctcaagctcagtcagcgagagagtcacccccgactggtgtgacctctcagaagattcattctagctcatcacagcgtcatattgctctatagcactacgaaatgatgtactcacgttgcagactccgccaatgcagtacatca

SEQ ID NO: 598898 - DNA, 224 bp, Homo sapiens
tgatccaggctccctgcggctttgactccccgggctcaagccgtccacacccatcagcttcccaaggagctgggactataggcctgagccactatgactggctaattttcaaagcttttttttttagagatgtggtctatgttgcctaggctggtctcgaactccaggactcaggtgatcctcctgtctcagcctcccaaagtattgggattacaggtatgagc

SEQ ID NO: 598899 - DNA, 93 bp, Homo sapiens
ccccccgggggggggggggggtttgggggggggcggcccccctcccccttggttttggcctgtggccctttaagggttttttttcccccccca

SEQ ID NO: 598900 - DNA, 1199 bp, Homo sapiens
  misc_feature (34)..(34): n is a, c, g, or t
  misc_feature (54)..(54): n is a, c, g, or t
  misc_feature (56)..(56): n is a, c, g, or t
  misc_feature (62)..(62): n is a, c, g, or t
ggctgcaggatttttcacgagaaaaaacaaagcncttcaggtcaggagaatgtntnaatgtncattgccatcgaggttctgctatttttgagaagctgaagcaactccaaggacacagttcacagaaatttggttctcagccccaaaatactgattgaattggggacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtggggggagatggacccgtttaaacctccgagatgagctgctcagactttacagcatgacgactacaatttcttttctaaacttctcttttctgggattataaatcccaatcggttcctagctgaaaaagttaaaaaggccggttttcccttctttcaaccagtttggttgagtaaatttgtttttttaaaataaaaattgttggcgtttccttaacgaggggtatttatgatccttgctactgattcctggcctcgggcgtccgtttgggcaacggaatacctcaccaaagccgtatccggtttcccagatcaggggataccaggaaaacatgtgacaaagccgcaa

SEQ ID NO: 598901 - DNA, 322 bp, Homo sapiens
  misc_feature (2)..(2): n is a, c, g, or t
  misc_feature (9)..(9): n is a, c, g, or t
  misc_feature (13)..(13): n is a, c, g, or t
  misc_feature (31)..(31): n is a, c, g, or t
  misc_feature (51)..(51): n is a, c, g, or t
  misc_feature (58)..(58): n is a, c, g, or t
  misc_feature (103)..(103): n is a, c, g, or t
  misc_feature (108)..(108): n is a, c, g, or t
  misc_feature (151)..(151): n is a, c, g, or t
  misc_feature (164)..(164): n is a, c, g, or t
  misc_feature (168)..(169): n is a, c, g, or t
  misc_feature (171)..(171): n is a, c, g, or t
  misc_feature (194)..(195): n is a, c, g, or t
  misc_feature (199)..(199): n is a, c, g, or t
  misc_feature (226)..(226): n is a, c, g, or t
  misc_feature (282)..(282): n is a, c, g, or t
  misc_feature (285)..(285): n is a, c, g, or t
  misc_feature (302)..(302): n is a, c, g, or t
  misc_feature (307)..(307): n is a, c, g, or t
antagagangggncaggctttttatgagtancacacaccatatataaaggngcctttntggctgaccacatggttaagtgcataccttcccagtactgggggnaaaangggacccttcttagaatgtgcaagttccatgagagtaatatantgatatgattttnaaannangtgttgatagttacatcttcaannttancattccagtatgcatctttaagataangtgattctaagtagatgactttatattcttgattaaagagtgctatacatgttaanaanggcattaaggaatacantaaanagtctaaagtgatgt

SEQ ID NO: 598902 - DNA, 1145 bp, Homo sapiens
  misc_feature (34)..(34): n is a, c, g, or t
  misc_feature (54)..(54): n is a, c, g, or t
  misc_feature (56)..(56): n is a, c, g, or t
  misc_feature (62)..(62): n is a, c, g, or t
ggctgcaggatttttcacgagaaaaaacaaagcncttcaggtcaggagaatgtntnaatgtncattgccatcgaggttctgctatttttgagaagctgaagcaactccaaggacacagttcacagaaatttggttctcagccccaaaatactgattgaattggggacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtggggggagatggacccgtttaaacctccgagatgagctgctcagactttacagcatgacgactacaatttcttttctaaacttctcttttctgggattataaatcccaatcggttcctagctgaaaaagttaaaaaggccggttttcccttctttcaaccagtttggttgagtaaatttgtttttttaaaataaaaattgttggcgtttccttaacgaggggtatttatgatccttgctactgattcctggcctcgggcgtccgtttgggcaacggaatacctcaccaaagccgtatccggtttcccagatcaggggataccaggaaaacatgtgacaaagccgcaa

SEQ ID NO: 598903 - DNA, 788 bp, Homo sapiens
cggaaagccatgtgaggacacagtgagaaggtgatgtctacaaaccaggaagaaaggcctcaagagaaaccaaccctcccctggcgccttgatcttgcatttccagcctccagaactatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtggggggagatggacccgtttaaacctccgagatgagctgctcagactttacagcatgacgactacaatttcttttctaaacttctcttttctgggattataaatcccaatcggttcctagctgaaaaagttaaaaaggccggttttcccttctttcaaccagtttggttgagtaaatttgtttttttaaaataaaaattgttggcgtttccttaacgaggggtatttatgatccttgctactgattcctggcctcgggcgtccgtttgggcaacggaatacctcaccaaagccgtatccggtttcccagatcaggggataccaggaaaacatgtgacaaagccgcaa

SEQ ID NO: 598904 - DNA, 310 bp, Homo sapiens
ccgagatcgcgccactgcactccagcctgggcgacagaacaaggctctgtctaaaaaaaaaaaaaaaaaaaaagattgacttaatggcctttagggactcaggaggaaactagttggcaagggggctgaggcattgaaacggctgcaacatagggttcaagtgtatacttgcctcgggtgagtgggtgcaccaaaaattctcagcgaattcacctagctaagagaactttactcattggagaccaaaccaccaaccttgtttcccgcaattgaccttattggcaacttaacaaactttaaacacaaaaaa

SEQ ID NO: 598905 - DNA, 904 bp, Homo sapiens
tgagcatggtagaatatgtattaagtacttctcactgctgagtaaattggatactcgatttcaggaagcggaaattttggcactagagatgctgaaacagatggacctgaccaaaggagatcaaaaaggcaaggcttcgtccatttgaggaggaccaaaacagagatcttaaacacggggatgatgtatgattctaaaataaatggcagcaggtttgcctaaatggaatggatgcccgattgcaacagatttttaatcgtactcctgtgaagtcgtcatagcctctccaactgaagtagttgagacgcttggtgccccacatactaagtccctcagaaggactggggcctcttcctaatcctacagctaataaaccacttgttgaagaattgtacaatatcctgacaactcagaatctcgatgccatggaacagagttggtctggaactccttagagtcttgagctatcctgttactcaggtaccaatgggactcttcaggagactacgtgtaggcctttgtgatatacaattcccagcacgtcaagttcttacagaggactaatgcaactaaccagtgacaacagttaagcttgcagctccaacagcaggcaaaaatgcgttagcaacaagctcagcatgcccacatactcgctggatggtatctcacgcaaggtgcttggtcccagcttgcatttggtgacaaatccattaacataataagggagagcccgtccaaaggaccgatcggattactgaagcaagattggcgtgaaagcgagacaatagggagcatgaaggaatcaccaggttacgaggaaaaggagggcttcacacaatattaaaatattcagtgcaaaaaccgtggcctgttttacctgtgaagacatctccgataacagata

SEQ ID NO: 598906 - DNA, 457 bp, Homo sapiens
actacatacttccggatgcactgtatactgacttacaggagagccccttttttaactcaggtgctcctgtagagccttagctgccttacaaatgccaattgccagcctgtctacctacgagcagcaggaaggcccgagcaggtttaggacggatgcttccctgaattgaatgaaatgctgtgctttgagactggaaggcaacagccaccacaaggggacaacctagaacgcggcactcaggcctgtagacagcaggtgtgagtttcatgtgattaataaccagaactgcaaccagaggggaagcatgaaggaaaatttaaggtactacaagcaaaactctcctcgacaaatttaaatactgtatcaggaataaatttatgagcatatataaatcattaagtattacttgtctactagaattccatgtttatcaacatacaaatcaggcatcacctcg

SEQ ID NO: 598907 - DNA, 1330 bp, Homo sapiens
tcctctggcttcagcggttgtctgctcgccttctttgtcttcttctctgtactcccgtgtgtggtcgtccagtgtttccctcgtgtagctatgcccttcctgcgtgctcttgttgtgttacgctttaccgttgccctatttacgtaccaccgggaattgtggtttttttcactgatattttatgcggctggtctttatgttcgccgatctctggcttgtcctgtatgacttgtcctcttcctgttacatttggctcatgcttcccgcggtgggtttgctacccattgatgttgcctccggcggtgctttggtcatatgtatcttcctttccttctttagttctcttattctttctatatatctgggcgacctttctttcactatctccttctttcctcacatatcttgctgttctaaatatggggcaattaatcctaagctatcatttctctctggtctttgcaatcgtatattggtctcacttcacattaacatattcttttgtgtacctcgctctatttccccacattgcctcttttagttccaaggggtctctagttcacggttgttatccctccaagacctagtcgtactatcgttagattagtaatgagtttcccctttctcccattgctgttcactggaaaacttctccatagtgactctggaatcaatcatgtcagtgtaatggagctttatctctgttacatgtttctgggtctcttgtctctctcttgctccagttgtgatccccacttgtactagctacagtgtagtctggaaacacaagtctgacacatgtcattctccttatagaacctgtgccctggcccataggagttaaccctctggcctgttccttcacgatgataaaagtcacagatgtacagtttgtcaagccagatataatacgagtgcaatatgtttgatagtatactccggttcatcttcttcttcaggaacgcgaaatgctggctgattttaaagctgttatagctggaagtatcaggacaagcccatgtacacgggctacagcacagcgtgttataatcagaagatgacgacgcatctgagggatggactttcttctcatagtgacttctgtccatgagtgttaagggctgtcatgttttagagtaatcacttatccattaaggactgttttctctagattagtacgtgaacgaaatggattatacatataactaactctcattctttgtcactatactatccctgtggctaaatataagtcattatacctcgtatgcgcaacagtatttgtataaatatcacttatgtctagcatacatactgccaggattcagag

SEQ ID NO: 598908 - DNA, 168 bp, Homo sapiens
  misc_feature (26)..(26): n is a, c, g, or t
  misc_feature (86)..(87): n is a, c, g, or t
ttatgattatacttctcatgggtgtnaaccatgagaagtatgacaacagcctctagatcatcagcagtgcctcctgcaccaccaanntgcttagacacccctgtggcttaagtcatcctatgacaatcatttggtatctgtggaagggagctcatgacccagcagtcc

SEQ ID NO: 598909 - DNA, 177 bp, Homo sapiens
tacccacagggcatctacccagcagaccaaccccaaccggctctacgtgttcttaatgtatataactgggcgagaaggtttcaaaacaccacaaagaacaaaagtcctatagaggctctatttctattcatgggactggtgcctcacaaatagagtaccagaagccagaactaaagt

SEQ ID NO: 598910 - DNA, 401 bp, Homo sapiens
  misc_feature (114)..(114): n is a, c, g, or t
  misc_feature (136)..(136): n is a, c, g, or t
  misc_feature (210)..(210): n is a, c, g, or t
  misc_feature (231)..(231): n is a, c, g, or t
  misc_feature (234)..(234): n is a, c, g, or t
  misc_feature (241)..(241): n is a, c, g, or t
  misc_feature (251)..(251): n is a, c, g, or t
  misc_feature (312)..(312): n is a, c, g, or t
  misc_feature (366)..(366): n is a, c, g, or t
  misc_feature (398)..(398): n is a, c, g, or t
gaattccctcaccatgtcgctgaagccccagcagcagcagcagcagcagcagcagcagcagcagcagcaacagcagcagcagcagcagcagcagcagccgccgcccgcggctgncaatgtccgcaagcccggcggnagcggccttctagcgtcggccgccgccgcgccttcgccgtcctcgtcctcggtctcctcgtcctcgggcacggntccctcctcggtggtcggggnganctccggnggggggaggnccggcctgggcagaggtcgaaacagaaacaaaggactgcctcagtctacgatttcttttgntggaatcttatgcaaatatgaggatgggtcatattcttacatcaagttggtggntccaaatgtgaaggtacaaatgaaaaaatggnggt

SEQ ID NO: 598911 - DNA, 912 bp, Homo sapiens
  misc_feature (28)..(28): n is a, c, g, or t
  misc_feature (96)..(96): n is a, c, g, or t
  misc_feature (216)..(216): n is a, c, g, or t
  misc_feature (428)..(428): n is a, c, g, or t
  misc_feature (434)..(434): n is a, c, g, or t
  misc_feature (478)..(478): n is a, c, g, or t
  misc_feature (489)..(489): n is a, c, g, or t
  misc_feature (493)..(493): n is a, c, g, or t
  misc_feature (535)..(535): n is a, c, g, or t
  misc_feature (595)..(595): n is a, c, g, or t
  misc_feature (620)..(620): n is a, c, g, or t
  misc_feature (655)..(655): n is a, c, g, or t
  misc_feature (690)..(690): n is a, c, g, or t
  misc_feature (824)..(824): n is a, c, g, or t
  misc_feature (895)..(895): n is a, c, g, or t
ctttcttcttacgccaatatagtcaganctagcttccttatgctatacataaaatcttaacatcagaggcagtacagatagtacagatagtttttnaactgatttccaaacaagcacaaacccactacgttgaaaagaacaggtaatttgaggtttttgggaaaagagagtacttcacacatttaatccaaattaaagggggtgcagaaagttttnagtgagatgaaaggaatgaaataaatataaattgtagggataaataaaaaaaaatttaaataaggtaaaagaactaatttttttaaataaaaatactagtgaggtaaaaggttttgttttttaatgggagagttttaaatatttaggagagtactgttaatattaaaaaggtaatttttgagccagagggttagtaataatagtggtttggntgtggnaattttgaaagtgaatggttttggtggtgaaaaatattttaggngtattagtgangggngagtgtggtggtaatagaatttaagtgttaaatagttttaanaagtgagagagggcaaaagtggatgtactaatttggtagttaaaaaatgggtgtgaggantggttgataattaggatcttaaganaagtagtgggatggggtattgagtggtatgatgantgagtaattaatagaggttaaaagaatatggccanaagtgtgtttgttttatgtatttgtcacttaatttctttagtcattaattttacacccaccagtgaattcctatgggcagatgaaaattttgtggtatacataattagagagaaaatgattatggtgggtattnctgtaagtttgacgaacttgagaagttttagcaccctcccctaaatggatgaagcccttctatttaatttntctccttaaaatagaga

SEQ ID NO: 598912 - DNA, 253 bp, Homo sapiens
cggagtgcgagagaacgggagcctgagcttcctgcccacccatccgtggagctccacttggacaacaacaatgttggccagagctgccctcaggcgctacccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgcgaggtg

SEQ ID NO: 598913 - DNA, 434 bp, Homo sapiens
atgatagcggtgaggatatggatgttgtgtttagagctgtctctgacagaaatgtgcatcctgtttatcttctaagagcagttctgctctgtcgggtaatataagaaacgtacactctcatttaatgaattctctcctccggggggatgggggcgaggtttgtttggaagaggcaggggaaagttcttgcttcggctctgataggtggtctgttgctagggccttgagagaagtatggtggcagggaggcactctgtggaaaactgctgttactttctgagaatgctccaggcatgtgagaggatgggaaagggttcatgggacttggcttagtagatcttgaagggaaagtgttggagctcataggaagtagtgctggctggggcaaaggtctctgatgcacatcatcttcatcattctctcttctgtctggt

SEQ ID NO: 598914 - DNA, 160 bp, Homo sapiens
  misc_feature (28)..(28): n is a, c, g, or t
ctttcttcttacgccaatatagtcaganctagcttccttatgctatacataaaatcttaacatcagaggcagtacagatagtacagattttatgtatagcataaggaagctagctctgactatattttcctaagaataaagacctatttttgtagcatga

SEQ ID NO: 598915 - DNA, 175 bp, Homo sapiens
tccacaaagagctgctgtacttgtacttgcacgtaaagcatctgctcatcgacctccttcatggacatcctgaccacggaaggacagcagccacgtgtgaggtatcggccgtacgcgaggtgttgcctgtagctgtgatgtatgccgtagcgtggtgtagccgtacctgtgtatg

SEQ ID NO: 598916 - DNA, 1111 bp, Homo sapiens
  misc_feature (435)..(435): n is a, c, g, or t
  misc_feature (467)..(467): n is a, c, g, or t
  misc_feature (473)..(473): n is a, c, g, or t
tggagtactagccaaggcacaggggaccggttgtccttaggtccttagtcggtgaatctagcaataggcagctccaaattctctgagtcgaactagggtttggccttgtcactgggtgaggccctactaggtgtaagcattctctcgtgaatttataatttcctctcattaaaataggaacaaaattggctatcctttagaattaggagctgaagattcatttcccgtgggaatgtttcccatttatagcttctcaagttttcagcctcaaacattctacctttctttctcgtgacctccttgtttcattctcattctccctccgagggcagatagggggggctaccatatagtatacctgtgggttatagtggccgtggtatttatatgtggacatctcagcgtggatagtgtgtgacttgtgaaccgtgtgtntctctctcccatagccgtggtctcgtgtgtanacactntatttataagtgggggtgaagaaatctcataaagtgtttatactctcaactctgtgtgagagtggggctctcagtggatctcacgagccaccgagtgggtcgctctctaacacaaagagaaaaacatattgtgggggtggggggtggaagtgggaagtgggagttggcaggaaacagtgggtgagacaacgagtgtgtgggcttatacacgcgagaaatttccttttatatcgcgagaattatttatagcgtggggcctcccaaagaggggagtggaggttagaatataaggcagccatattaagaaaatcttgtgggcactcccacagggtgtaaaaactcgcctcaacgcgggggccccctttttgtagagagagccccaattaagggcgcggcaactccatgttggggcgcttcttataacagatattacacaggccacacagggggtttcttttcccacagagttttgggtgagcacctgtggctcaataactccgtgggtttataccccctccaggggggttcaagaactggcacttactcggacgggacgtggggttattaaaccctaattgtgtcaaacaacttgtggcgctttgggaaacaaccatcaacctttggggtttcccccccaa

SEQ ID NO: 598917 - DNA, 386 bp, Homo sapiens
cgtgtaaacagccaggcaaccccttgtggagggatacaaagggcacggcggactacactgaggtcccagaagaaaggagaccccttcctgcgcctacaatcggtgataggccccgtgtttctagaatctaaaaacatcagcacagacaattacatctggtgctcaacaatgtgttgagaacccactgctgcctcctccaatcagttttatagcaatccacctcggagtgtcacctggccaggtcatcctatgtgtctacatgctattcaacggatgtcggatgagaatgaagttgcctgagcccccaggatggtggagtccttcactgtgagtccatcctttgccccacaacatctttcagcctgggtgacagagcccaaacctgt

SEQ ID NO: 598918 - DNA, 621 bp, Homo sapiens
  misc_feature (153)..(153): n is a, c, g, or t
  misc_feature (161)..(161): n is a, c, g, or t
  misc_feature (168)..(168): n is a, c, g, or t
  misc_feature (182)..(182): n is a, c, g, or t
  misc_feature (199)..(199): n is a, c, g, or t
  misc_feature (208)..(208): n is a, c, g, or t
  misc_feature (237)..(237): n is a, c, g, or t
  misc_feature (245)..(245): n is a, c, g, or t
  misc_feature (274)..(275): n is a, c, g, or t
  misc_feature (291)..(291): n is a, c, g, or t
  misc_feature (300)..(300): n is a, c, g, or t
  misc_feature (330)..(330): n is a, c, g, or t
  misc_feature (348)..(348): n is a, c, g, or t
  misc_feature (374)..(375): n is a, c, g, or t
gctgttttgggcctcgctggtgctctaccctttcttccagttcctggtcagcatgatcaggagcgggtcttccctgacgctggccagcttcatcctcgtcttctttgtggcctccgtgggagttcagatggatagattggtgtgacggaaatntgacaagnctctgcnctacggcaactctngacagcaagcagaaacntgaatgacntgactcaggcgaggtgtcaccatccgaangggaaccnttggggaactggtgtgcctctgcatatcnnctccttagtgggacancggtgacanacaggctgggtgaagcccctgctgggcacnggcggaacgttcacgaancctctcgcagccagggacgctctggnntctcaaggcgcggactggcggacggacagactgttttggtaatccttatttttccacccattgtggctttagatgggctatggttttctttttgtgcgagtgtgtgtgagaatggctgtgtggtgagtgtgaactttggtctgtgatcatagaaagggtatttaggcctgccggggagggcagggctggggaccgaacgggggcccagttccccctttcatccctttggtggcgaagtttactgga

SEQ ID NO: 598919 - DNA, 1220 bp, Homo sapiens
gacctgtgtaccctcggagaacaggcaaaggaaacagaagaaagaagcgagctgcagtgtcgcaggtggctcttagccgacggaggggacagtgccccactgagccctggggacaaggaagatgccagccaccaagaatgcccttgagcaatctgccctcacccaagtgagcacaatgcttccagaatgccacctggttacaggaggaatctgaaggctcagggtaagcccagcacatctgagccaaaaagagctcaaaacatgcaggcgaccaaagagcctcagctctctgaagcctgtgggcctacagcacagacgtggtgcgccggagcagcagagagctggacggggccaggcctgctgtgtcatggccagcgacacaacagtgcccagaaggccccctgtcctgacaatccaaacacctccgcatggcacactgctgcagcgaatggcaacaggggacaaccatttccaggacgcaggaccttgcagtctaccgtactcgtgactcacccctgcatgtaagcttcgcgcactcgaatggcaatcatggaattcctccaatcactgcatcgcggaagaaggatgagcaccacgaagatgcgccagaagcatctcgcctgacacagtaaacccaaacccggcgaaaataccatgaaagagacacacacgacacacaccacagacgacagaaacgacaaggaagccagcaaaaggaccagctgagtcacgaccctcggcgacaggccacacggcatccacacccgcgcagaaagatgaaaaaaaagacaacagcctcgagcggcaatggaaccaggcaaccagaggactagacgaacctacacagcacaaacaggccaagaacactcccagcagtaggatagcgcccacgacacagcggcgacataccacattggcccacgcgaacgcgagcaaacgagctacacacacgaaagctcaaagggaagaacaacacgctaacccactcgtagcatccaagacaggtctatacagacataatcaccaccacgtgcacagagaacgcggaagagacaaaacacaaggacctgaacacaaccacaggaagaggcaaatcagccacgaagggcagacggcatgataacgaggtgacgtcagacacaaccagagacaacacacgaagtgcagacaagcgagaccaagcgtaccagacaaacaacacaacgctcacaccgtatcaa

SEQ ID NO: 598920 - DNA, 148 bp, Homo sapiens
  misc_feature (122)..(122): n is a, c, g, or t
atgttgtctgccagcctcccaggtagcaggggttggatgcgtgtaccaacatgcccctctgtatgttgtattagcagatgagggtttcgccagtgttgaccaaggctggtcttgaactcctngacctcaactgacgctcaggtgatct

SEQ ID NO: 598921 - DNA, 610 bp, Homo sapiens
gaatagatgtattaaaaatgtttcttataagtcttcaggtctgtgttgatgctaatgctggttggctcttactaaattccaaaagggtgtaggatataatgaggcatgtccaacttccccttcccatcatggtctgaactagtttttcaggttaactttggaatgccttggccaagaggagggttccattcagaaggctggggcccttagaattttattttggtttacagaatcagtactctttcaactttaaaataataattacttactgagataataagtcagaactttaaaaattaatttgttcaacattgtttattaagtgtctgatgtgttagggactgtttttggtgctggggacacagaattgaacagtatctgatgccatccttgcattcctataacttacctggcaggggggtgggggattagtggtagacagtaaataagcacaatgaatataaaaggtcaggtaatgttacataccatcaaggaaaataagccagatgaaggtggttgctgttaagtagggtagccaggaaggctggaatgaatttagatattaagatattagtcatatctataggaatttgatccatcttagcaaggg

SEQ ID NO: 598922 - DNA, 350 bp, Homo sapiens
  misc_feature (303)..(303): n is a, c, g, or t
  misc_feature (337)..(337): n is a, c, g, or t
gtcatagtaattagtctgcttgatatcaaatgtactaatttacatattgtgactttattatatagtcacaataataaagactgtgtgttgttggtgaaggaatagactcataacctaatgggacagaaggcagaaccagagatagatccataagtgtgcccaactgattttttacaaaagcaattcaattttgaaagcattccaatgggaggggcagatagcctttttcagtaaatggtcccaagagcaagtgggacgaccagaggcatgttagcttaacccttccaccttaaacccccacantttcattcccccaaaatttttaccccccaattanttttcaggacttt

SEQ ID NO: 598923 - DNA, 743 bp, Homo sapiens
agcggaatgtgggcgtggccggacatgtttctcttgacctatcttccacatcatcaagctgttacgggcgaaaccttggtctgaaacatgcggccagagaaataaatctcaggatccggcaggtgtcaaaggtgccctcttcatcaattcaactgcctgcactattgtctgtagtccctgacaagagtaattatgcctcgaggtcagaagagtaagctccgtgcccgtgagaaacgccaccaggctcgttgtgagaatcaggatctgggagctacgcaggccactgtggcagaaggagagtcaccctcctctgcctatcttctctttggtgacagaccccagaatttgcctgctgctgagacacctagcatccctgaagcgcttcagggagccccatccaccaccaatgctattgcacctgtttcatgcagttcaaatgaaggtgccagcagccaagatgagaaaagtctaggttcctcaagggaagctgagggctggaaaagaagatcctttaaacaagaaagtagtgtcgctggtgcatttcttgcttcagaagtatgacaacgacaagagccaattacacagggcagatatgataccagtggttatcaggaaggataagtgtccacttcaatgagatcctcaagagagcctctgagcacatggagctggcacttggtgtcgatttgaaggaagtggatccaatcaggcactactatgccttttacagcaaattagaccta

SEQ ID NO: 598924 - DNA, 105 bp, Homo sapiens
gtgtatcaccactgcgggcatgcctcctgtacagttcgtcgacacgtgagcacgtgctgacctccaaatatcgttagctggagcctggtcgactctatcaggatc

SEQ ID NO: 598925 - DNA, 163 bp, Homo sapiens
ggagctctagtttaggaatagtgaataagaaatgtactgtcatgttgagtgtgggagaataactggagcacaggagtttgaggccagcctgtgctacatagtgagactctgtctctatcaaaaaatttaaaaataattagctgggtgtggtggcacatgcctg

SEQ ID NO: 598926 - DNA, 1424 bp, Homo sapiens
cgctaacggaagataccttgcgatggctggaaaaaatcgccccttccacaccagagcatacagagcattccgtattgaaattagtagatctcggcgtcacgaactcttccagataaacgatcatcgagacatgcgaagcattcctgagagagccatgcattgctcggccatcatccgtgcgttcatgggaccatgccaggcgacgcagaaaatatgtcggtgagcatcacgtcttagcacaaacacaacgccaggagactccgcagaaattacagcccagcaagattagctctcgcacaccgaatgcgtggaaagggacacgacgcgaaacaaagcaaggcacatggcatcacacggaaagatagcccctgcacgagacaatcacgtagcaaacccatatcgcatacattcatcgaggcgacctatgccagtaagatcgaaaccggcccgactcgcagtgctcgcgcgtcagtggcagacgcgccagctgcacgacgccaccccgtagcgtgtaccctaggcgaaactatcggccaccgaacggaaacgcacacgcacggcagacgcgcggcatcaccgaacgactgcgtactccgcgtcgcacacggaactcgcccacacacgagcccaacgcaccgctcgggacgacgcgcccggccagcacatacataccatccacaaggcggcaccacttccgacacgaacaaacgccgccacagccactcggacactcgaactcgaccgctggcgcgcgctacacacacgcccccacatcgaacccggccccaactgcaacacaagcgcatcgccccagtaggcggccgcccctggcgaaccgcaaacagcacacgcccttggataaccccaacggaggccccaccctacgtctctcgcagcacatacatacactaaaacagagcacacccatcgagccgcatcttccctcggcccacccgccaaccacggccatacccgcgcccaaatccatccctcgcccggcaaccattcccgccccgcgccacgcacccatccaccccttccactcaacgacactcgccccggagcactcccgcacaacgcccactcacctccagcggcaaccgacatcgcacgcacgacccccaccccccatgcgaccccaacacacccacacacacgacacgcgcagccaccgccggctgccgacccccagcgaaccggccaggaagcacctgcagcccgcgaacatacactacccaccctcccaagccacaggccgcccccacctccacaccccaccgcaccctacacaaagccacacctcccgaccgcccacacgccaacaccccctgccacagcgaccacccacctcaccacaccacaccaccccgcccctccccgcccaaccaccccaacccaccacccaacagcaccaaccccgcgcc

SEQ ID NO: 598927 - DNA, 281 bp, Homo sapiens
agatggagtttcgctctgggctgaagtccagtggcgcgatctcggctcactgcaacctctgcctttgaggcaggagaatcgctcgaaccagggagttggaggttgcagtgagccaagattgcaccattgcgttccagtcttgcgacaagagtgagactccgtccaaaaaaaaaaacaaaaattagctgggcttgtggcacaaacctgtagtcctagctactcataaggcttgagatggaagaatcctaaaacctgggaggcagaatttgcagtgagcccaa

SEQ ID NO: 598928 - DNA, 494 bp, Homo sapiens
ggcccttgaccaaaaattctttgttaggggccccttttgggttggggtcagttgggccccttttcaacaattttccctttcggttttacgggccctggttaaaaaaagggggccaccaaaaccggggggtttttttttagccccggccccctgggcttttttcctttttgggccctaaaaaggagggagatttttttttttttattaaggatagggccggttttttgttgggttgggccctccccccccgggttttccaggaagcagaatttttcaaaaaaagggtttttttctttcccgttcctttgggttttggcctcaggccccataattttcttgttcccttttttaagaccagccgggttctttttttccccttggccgggatttttaatttaaagttggggtggaaggggccctttttttaccccccccctggcccggttatttttgctttccttgctttttaatttaattttttttcccccccggga

SEQ ID NO: 598929 - DNA, 319 bp, Homo sapiens
ttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgtaaatcaaaggggactggagtttcagcaggagcaattcatccaacgggagatcgccggagggcc

SEQ ID NO: 598930 - DNA, 115 bp, Homo sapiens
atctgattgatcccccttagacatttggtctgcgcatgatgcacagggcctgatcctggcttgaaacttggccggtgatacctgacagtgtctgtgcaagggtttccttcttacg

SEQ ID NO: 598931 - DNA, 461 bp, Homo sapiens
  misc_feature (414)..(415): n is a, c, g, or t
aagcagtggtatccacgcagagtgcccattacggccggggggggagaaaaaaaaaaaaaaaaaaaaaaaaaaaaaatggggggcggccggcccggaaaagttaaaaccctggggggggcggggcccctggtgttagtgtgaacacgtgctgcatacgctgtgtcccataggagaagacctgtgggacgtagagctatagtgggcgttgggggttcctcaccccattataataaacacgcgccgcggcgggaacaccccgagcgtggtttttggaacaaaactcaagagattgcagtgtctcggcagggccatacgcggcacgtctcatatccaaaccaggcgaggtgtcacacagccgaaaccgctccgagatatatatcatatatctaaccgcgcccgcggccccgtggtgannaatatgacactatagatgatcactaatagacagaatacatcacatg

SEQ ID NO: 598932 - DNA, 295 bp, Homo sapiens
cgtacggacagatgccacacatatggaagatgactctgtcacttgccgatgggtgtacaaaagacacagaagattagaatcattgcacaatggaatggatcgtgatcctgacatgccaacgcacagataatgattaagaaagaagaagaacgttagagggcttccatacgtagggaatctcagcagcgccgaatgagagagaaacagcaccagcgggggctgagcgccagttacctggaacctgatcgatacgatgaggaggaggaaggcgagaagtccatcagcttggctgaca

SEQ ID NO: 598933 - DNA, 1150 bp, Homo sapiens
ctttgatgatggtgaaaagcgtagctagcgattcgacgagatcgcgggaggacgctatcggatgggttggctacgcgcgcgatccgatcgggattatcggcgtgaggatttcacgacaggagctataaatattatatatatcggcggcggcatgcggcggagatattatatccttgtggttgtgagagatatatataggcgcatatttttattacgggcggcatatcggcggcatatggccgtttacgggcgagatctatcatatggagtcgggaacagccagtagccgcgagtagcagccatcagccagtgcggcacgcgaacagcagtaaaacattaagtatcccatccatcaaacgatctgatctacgtagcgacgggcatgcggaggctaggctacgggggcttagggggcgtaggctagcgggggctattttacggcggctagtagtatcgagctacgtacggcgcatctacgagcggggcgtagcgcttaaacgtatcgatcgacgggcgcggcgcgctatattatacgggggctacgatttattatacgggcttatgcggcgctagcgatcggcgtagcgctacggcgatcgcatgcgatcggctagcgcacgacagagccacagagacaaaacgagcggaaccagcaaagcaaagccccaagaaaacccggcccatcgacacgacattgcaggctcggatgcggcgatatcgggcgcgatgcgcgatcggcgtagcatgcacgatgcggcgcgatcggtagcgagcgggcgatgcgatggctagcattatcggcggcagatgaggtcgggatcggcgagcggcgcgcattaacgggctagcgcgacgcggcgcgctagatctgatcgactgcgctatagctgacggtcgcgcgatgtagcgatttcgagcgatcgcgcgatgcgcgcgatcgatcgtgatctatagcgccgatcggcatgcagtcgtacgatgcggcattcgtacgcgatcgcgcgcgatcgcggcggcgatgtatgcgatgcgcgcgcatattaatgcgattatatacgggcgcattacgcgcgatcggacgatgcgagcgagcgcggcgcgtagtatagcgtatatattacggcgctaacggttttcagcatcatggaaa

SEQ ID NO: 598934 - DNA, 229 bp, Homo sapiens
  misc_feature (144)..(144): n is a, c, g, or t
aaaaagttcttctctacttctcggctgaggttcaattattaactttttttaaatttttttgagactgagtctcactctgtcgccctgactgaagtgtggtggtgtcatcttggctcattgtaacctccacctccaggagaattncttgaacccgggaggcaaaggttgcagtgagccaagatcgtgccaccgcactccagcctgggcaacagagcgagactccgtttcc

SEQ ID NO: 598935 - DNA, 865 bp, Homo sapiens
caaggcgggggagtccacccccgtggtgggggctgtccaggtgcctgtcccgggcatgccgccgatgactcaggcgccccgcattatgcatcgcacatgctcgggaccagctcgctcctacatgccgcgcccctggatatgataccccgccgtcccaggctcttgcacctggtcagatcccaccaggggccatgcccccgaaggcacgtttagtgcgcgaggactagattgcctccactgcgccaggccttcttttctgatgatatccacgctgaattcacattcttgtgtttcctctagtcaaacactggccgagcagggagacacaagcggaagactaccatgtcgtggtttcccatagtcttctcttgcaagtcatggtgtaccgctgggcgttgcaacgagagggttcgcggtactggtgtaccccggagctgggcaactgcaacatttctggccctttcggatgtggaagcttatggaactagagttggaagggctaagcaaggtggcgatggggggactacgtcgttcggccgcaatggacgcacctggcgaaggtggcgtgtatagagcactccaactgccaagagacaatactgcccctactgacacgcattcttccctgtccggcccaaaaagaggttacgctatcccgttcttttcttacccacacaacaagtgagcctgtgggggggcatctcattaatatccactgggtctcaatgggcgacggtttcagccgtggccctatggacctggcgttgtcgttgacttgcagttgctctggccttagaaatcgtgttccagggtggcccaccctagggttggcggtgggccatataaagtccgacgttgaaggtgg

SEQ ID NO: 598936 - DNA, 255 bp, Homo sapiens
gcccactttggggcccttggttttttttggggtgggggggagggtggaaattgctatccatccccggggtttttcccccgggggggggggaagcccccgattcctttttaaccccggtttttagggggcccccccctgttggctgaaagggggcggccagataaatttttttggggttccctgtttacggtttttttccccctgggggggggccagttttgggttccgaaataacccttggaattgccaggggga

SEQ ID NO: 598937 - DNA, 653 bp, Homo sapiens
acaaataaattagtcttatttagtttgaagtaccagcatcattaactgaggaattctcactagtggacttagaacgttctttaattatacacatagataatatcactcctgtagaggtttctttttgtgttggatatgttgctgtcactgtcagacttagaagtcttaatcgtaaaactggagtcaggccctaaaaatggagagagagttcaccaccatccacataagaccaccaactcgaactaagacggacagaagaaggcatcagctaactgaacatatccacacgctcgcagctcagactgatattcgtcatctgaccagaacgccccctgcgcaacttctatggtgcaaaacaagctgaacagatctggatctatctgctccacacctggagtctacgggcattagctgactgacaaaacagaacatacttcccacttttcagcacctgctctactagacgtcttgctcctgcatcttccagtcctatgtcttgtctgatgacatcaagctacattccctccagctgctacccatttaccagaccggttctcttacgtctgatggccacccttgtctcaggacccgccctcgctgagctctcttcgcttctttctccttaccctcatgtgggctctctctacatggtg

SEQ ID NO: 598938 - DNA, 247 bp, Homo sapiens
  misc_feature (11)..(11): n is a, c, g, or t
  misc_feature (231)..(231): n is a, c, g, or t
gttgttcaccncaggaagggattagaaacgtctaggagagaatgaagtaaggttgatagtgtggtagagatagctggggagaggtagagggtggcataaaaatgggaatgagaataagagtgagtataaaagtaaagagtagaacttcatcagggtgaaagaattggaaggtccccccccagcaaagatcatctatgcactctaagagggagttaagagttgccatgtccntgtgtgggggcaaatc

SEQ ID NO: 598939 - DNA, 611 bp, Homo sapiens
agatgagtcacaaaatcgccgctgtgtgcctcttgatgagctgcctgattgccacggcttatagcgccgctaaggtgccaatttctatctactacgagtccctgtgcccggacagcgccaagttcattacggagcaggtatatccggcggtgaagggagaactgcgcgatgtggtggaactcactttcgtgccattcggaaagtctcagttcgttacccaggggtccgaagtgacgttcacctgccaccacggaccgaacgagtgctatggcaataaggtgcatgcctgcgccatcgagcacatccaggccaactcctatcaggtggagtacacgcgcgagtcgctcacgatggacttcatcaactgcctaatgaaggccggcaagaatttcccggacaacgtctatcccggccagcgatgcgcctcggagaaccacatcaataactgggagaacatcaagacctgtgccaactccaccgagggaagcgttctgctccggaaggccggcgaaagcacaatgcggctcaaggagccactgaccagcgtgcccaccattctgttcaatgagcaattcgacaagaaggtgaatgatcgcgcccaggtgaacttg

SEQ ID NO: 598940 - DNA, 620 bp, Homo sapiens
aagcctgggtctgcttttgtccagatcagctgtttttttaaaatgtctgactttttttgcatttctaaagaagcgtgagaaatgggctgggagtgcttctgtcctgctgacaccccgcggtgggtcctggacgcgcggccctccagctgccgcaactttccatgccacggatatttcttccgcaaactcacgctcggcttgaaacttcacgagcgacgtcacgacatgactcgacctgctccttcaactgttgactaactaaatgtctcacgccaacaaaccttccttgcagctgccactgcttttccccttgacctgcacctcttccccttaaacacttctgcaggtgacaccccctggcggacggcgccacttgacacagcactgcgtctcttgccagctggcttggcaacggccggctctccgcttctgctcagtcttcctgccagacgcgctcggactgcgtcccctgccatccagccctccccgctctgacgcccgcactgactctgccacactcaccgcggacacggggctgcctcgcccgccgaccacacattcctccgctcgctctctcccggcccgtcctccctcctgctctcccctcccccttcaccccg

SEQ ID NO: 598941 - DNA, 205 bp, Homo sapiens
catacattcaactaatattggttaaatcactagtctatgccaatttgagccatctgtgcttggaattatatcagtgaacaagaaggctatggtcctagtcctcatgtggagactagtaaatagttgtttattttagtggagaggtaaacaataaacaagtcaatgggtaaataaaaatatatgtacacactttaaaaaatgccat

SEQ ID NO: 598942 - DNA, 197 bp, Homo sapiens
tgaaatttttgagaaacacgagtaaagggtcagataccaatgtgtatttaaaaaaaaaaagcctatttataggggttttggccggggcaggggtggaaacctgctttatcctttaggattattcctaaatgcatcttctttataaacctgacctgctatctcagccagattaattatattaaaaaaataagaatccc

SEQ ID NO: 598943 - DNA, 632 bp, Homo sapiens
gcgtggctgaggtccatccgagcatctcaacctggatagcctgatggcggagcccaagaggcacaacgtcctgctttccacagaaaggagctgtagccgagttctctgcgcatatgccactgacggctgtgaagctaatactgtctacagtgggactcatcggataatggtagaactaatatgtctgcaggagtgcgtaacctgtcctattattgcactcctcttagtaaggcccgtatttctatgcgccatcttatctagatgagccatgaatcttgactgtcggtgatgatcttcacgatggtgagcctacttggtgttcgagaaatcgatgtcatcttaatttaagcttacgcatgcaacttctaagggcctctagctgcacgagaccgcgtgttacaaatgacctctgctggggacgccgccgtatgcctttcacggactatgagtcatggttcactgcactgaactcattttttggacagcgaggctgacagcttcctgtagtaacccagatcattcgtgttgccttgtcccttttgccagtttgaattttgatagatttgccgcccgaaccgcgttccgaactttttccttcccgatgggatgttattcgcctccgggcctttgtg

SEQ ID NO: 598944 - DNA, 1303 bp, Homo sapiens
  misc_feature (605)..(605): n is a, c, g, or t
gcaatctctgaccattgtatcatgcccggctggctctgcaatgtcatttcgatgtgtcttcagtatggattttttatatttttttttcggagttcagagttctcggacttgtgttcacgcggaaggttggagagtgtgccagggggtgcggaatcttcacaatattttcaacgagatttcctgtgtgaatgacggacagagagtgtggtccccaatgtgaactctttttctacccattacgtggacagatgagaaaagttatggaagaggtagcacctcgtgggaaatattctcgcacatatacttcaatcaatacacctctaagaccatgtgtctaccttattgggcccactttaaaacatctaaaaaccacagaaatataaactcttacacagtgtttttctctccaacaaatattcaaacagattatatacaccacgtgtcgccgtgcgcccataattttataaccaatactcgagagagacctctgtcatatatgggcccaagttttggggggcgaccaccccaaatacctcaaaaagagggagatttaacgaagaggggacaagaggtcttccaaatcattaaagcgttgaaaagagagnccccgagagagaaaccatatttcgcggggggataacgccgcacataaaggagggtacaaaaattgcgaaagagggagccgttgactaaacacaacgaggtttctctgacgagaactttgagggaccccccatcctacttttgcaaccccctttgtggacgggggcttccttggtgtaaaagtcgtgcacccaccattctcagagggccgagaggcccatacagaaaaaacccgtcgttaaacaacttgcgggacctgtgcttccaactcgtgtcaccaaaagggggagcacctttacacacgaggtggcctcaactcacagttgcacctcttaacccaacttcggggggacgaacttttcacgaaaaacacacaaccggggccacacaaggcgacaaccaaacatggtggggacgagcgtaaccccgtggacaatattgggcgggcgggcccccaagatggtaataccacacagggtgccctttacaaacagtcgacaacaggtgtaacacaacacgctgtgctctccaaaactgtgcggagtagacacttggctcccgcgcacactgcccacctggtgggcccttttgcaaatgtgggggaggacacccacccacagggagaggagcaagacggggccacactaaggacagcgtgaaaggagagagcggctctttagaaacacacgagcaaaaaatg

SEQ ID NO: 598945 - DNA, 250 bp, Homo sapiens
agaatggcatacccgagaggcagagcttgcagtgagccgagattgcgccactgtactccagcctgggtaacagagtgatactccatctcaaaaaaaaaaaaaattcttagtgccctcaaaaaactgctaaaacactcttgccactctggtttactgtaatttctcttaacctccttgattctttagccccagggaattttttccaggaacttgtgtataggagttcccttctttcccttgagttttatac

SEQ ID NO: 598946 - DNA, 155 bp, Homo sapiens
acgaagaaacaccctccttattggtgtgtccacagacatcgaggacctgtgtggtgctattcattcctccatgctaaacagctgaaaagcgaggtagctacactaacagcagctgggaaagaagttatgcttgataggaatatggtgacaaaaat

SEQ ID NO: 598947 - DNA, 193 bp, Homo sapiens
gagtgcagtgccacaatcatagctcactgcaggtcaagcagtcctcccatctcagccttccaagcagctaggaatacaaccaagaaataccatgaccagctaatgtttacattttttttttttttttttttttttttttttgggaaagggagtcccactttgtacccagggggggagggcgggggcacaatct

SEQ ID NO: 598948 - DNA, 559 bp, Homo sapiens
tgaatgattcagagagtcctgtccagagactaaaacacccacagcggaatgctcccatgaagaagtcgtctatcgcgttgttgttactcagcctttcgccactggcaggcttcgccgctactgcgccgttggacctggtgggcccggtgtcggattaccaaatctacgtcaccgaagaaatcgctgagctggtcaccccagaccaggcgtttactgacgccatcaataaaggcgacctgggcaccgccaagaagctctacgcgccgactcgcgtgcactatgagtccatcgagccgatcgccgagctgttcaagcgacctcgacgcgtccatcgactcacagcgtcgacgatcacgagaaaggggtcaaggccgaagacttcaccggtattcaccggatcgagtacagcctgttctccgagaagaacacccagggactcgccgtcctggcccgaaacaactcaacaaggacgtgcaggacctgaaaaaccgggttgacgagctgaccttcccgccggaaaaagatcgtcggcggcgccccaccgcggatgagagagtcg

SEQ ID NO: 598949 - DNA, 131 bp, Homo sapiens
tgctgggatcacaggcgcaagccaccgtgccttagccctcaagtttaagatttccgagtcttgagataggatcgacttgtttatctggattcaacttgacgttgcgactggcggaaacgggtaccgagctc

SEQ ID NO: 598950 - DNA, 120 bp, Homo sapiens
gaacacgtgacaggccagaatgacatgactccactgaccaggactatactgacaaagcctcacggacaaggcctcactgaacaggacccttcactgaccaggcctccctgacaaggactc

SEQ ID NO: 598951 - DNA, 498 bp, Homo sapiens
aggatcatagcttttacttagattctcaaaggtatcaggaatggggaatgtgttagacaaaccgaaaacctgtgtcagcttgaaaatcctccaaaactttaaagacttttcttttttctgagaaaggcgggtaaatcactgagtcatcattcagaacatacagcctcgaagggccagagctcacacccatatatgcaggtaaagagctcaagaaatgtgggttgagtgacggagtgaccccaggggcagactccagctcatcagacactgatacagagagcgcatgctatcccctcaattctccctcttgtcctaaaagcggagtctatatagggatgacaggctcaggctgagcagtcgcattctcgtgggttacgctgtgtcaagaataggtccctcaacatgaagatgtgtctgcgtctgcaccagatgctgcctgggtcaggttgcctgcctccgttctggttacctccctcctactacggtggcaagctggga

SEQ ID NO: 598952 - DNA, 274 bp, Homo sapiens
ggggcaatgagccacgctctgcgtagacgtctattcgctccaagttcatcgaaacactgagcgcacgaatacacgtcctgggtgagaaccattcacggactcctccgggacctgttccaccctccccgccatgcacagatcatctatgtaaaccagagtaagattctggctaacacacgagtcttctgtcctggctccgagggcgaatgcccaaacgttcctccctccgccgcgtgagggaggccgagcactcgcgtccctaatttgaggtcct

SEQ ID NO: 598953 - DNA, 679 bp, Homo sapiens
  misc_feature (318)..(318): n is a, c, g, or t
  misc_feature (347)..(347): n is a, c, g, or t
  misc_feature (382)..(382): n is a, c, g, or t
  misc_feature (476)..(476): n is a, c, g, or t
  misc_feature (516)..(516): n is a, c, g, or t
gggggggggggggggcgggcaaaaggggggggggggggggggagtacggggtttctagggctcaccccatggggggagggggggggggttggggcaaaataagggggttttaaaaggggggtaaaattggccccattaaaaaaaaggcggggggggggggggggggggggttatataaaagggggggtttggggacgggggggggggggggggagccatccacttggtttgtcttccataaaaaaacccggggcgggtcagggctcggggttttagcctagggggggggggggataacattttttccaggggaaaagntatgccccttggggcctttttggggcccntaaaaaaaaaggtgggtcaaaaaaagggggggggncggggtcgggatttccggggatttggtgacccagggggggggggaaacccgggatttttttttgggccccttggggtaaattcccttaaaaaanaaaaaggggggggcttggggggggcaaggggggggagggnttttttttccccccccgggttttaaaaaaaaaaggggggtttttgaaaatccgggcctttcccctttaaattgggggggcccaggattttttttaggggggggggaagaccgggtttcggggggaaaatttttaaagggggggaaaaaaccttttttatggga

SEQ ID NO: 598954 - DNA, 277 bp, Homo sapiens
aggtgactctgaggatcccccccgactagcctgacaggacagttaatgtagtacttccacactcccaaactcagtgagcctataaccttaaaggagggagcatttgctacacaaaaagcactattcacaggcagggatgattgtagcccacaaggaataaataaaggagaaaggagaccctaggaattcatgttcctttacgcctcacaagggacgaaaccctgggaagctggttgggctagccatctacgccggaatattgtacacccttgtcggg

SEQ ID NO: 598955 - DNA, 266 bp, Homo sapiens
tctcttggagacaccaggcatacagactgcggctgccaaagccagctcctccacatgcgcacccagtgcaccactgccccttgagctgggacactggagatgctgctgaagccagagcggctgaccccaggtagcctggctgagctggcactgaaaccccggcggctgctgctgtggctcctgatggtggtggatgtgctggccatggttccaggagatgagagggcttaggagagtgtgagaggctggaggcgagagggaggaga

SEQ ID NO: 598956 - DNA, 252 bp, Homo sapiens
tcccttttttaaaaaaaaaaaccctttttttggtttttccttttcctttttgggggggggggggggggggggggggcccccccaccccttccggaggggggttttccttttttttttaaaaaggggggggggggcaaataaaatttaattttgggggggaaccctttagggggggggaaaaaaaagggtttcccacccctttttttttttttttttttttttttgggaaaaaaatgggcccggccccgggga

SEQ ID NO: 598957 - DNA, 709 bp, Homo sapiens
tactatgcctagaaggaataatactatcgctgttcattatagctactctcataaccctcaaacccactccctcttagccaatattgtgccttattgccatactagtcttggccgcctgcgaagcagggggtgggcctagccctactagtctcaatctccaacacatatggcctagatacgtacataacctaaacctactccaatgctaaaactaatcggtcccaacaattatattactaccagtgacatcgatttcccaaaaaaacacataagttggaatcacaaaacacccaagcctaattattagcatcatccctctactatttttttaaacaaatcaacaaacaactatttaggttgttccccaacttttcctcggacccccaaaaaccccctcctaaatactaatacctgatcctacccctcacaatcatgggaagcaaagccaatttatcccaggtgaaccactaatcacgaaaaaaaattctacctctctaatataaatctccctaaaaatctccttaattataacattcacaggcacaaggaactaattcattattatatcttccttcgaaaccacactttttccccacggggtgatcactcccccggggggaccagccgaaagctggagcggatatttctatttacaccctggtagggcccccccctatcaatgggggtgtaaccccccacccctggctaa

SEQ ID NO: 598958 - DNA, 157 bp, Homo sapiens
gcgatgctaggcagagcatttgtgcaagtcggactgcactacatcatggttgatctactactgttgaagatcctagtggtgtagctgaaatcttaacaaccaagatttgctcagtattgggacagtctgtgaaccatggtttgagaagctatgggtt

SEQ ID NO: 598959 - DNA, 170 bp, Homo sapiens
ctctcatgagagtaaagcagagggcagaggagtgagagggaggggggtcgcgttcacttcatggcttaccggatgctgattggacagaccagatccagtcggttcatagaagcccgtcgccgctggtggcgcaggttgccggcaatgtaccagcttccagctggcgatag

SEQ ID NO: 598960 - DNA, 6440 bp, Homo sapiens
aaatactgctgcaacgagacggagttccaggcggtgatgcaggcgaacctcacggccagctccgagggttacatgcacaacaattacaccgccttgttgggagtgtggatctatggatttttcgtgttgatgctgctggttctggaccttttgtattactcggcaatgaactacgacatctgcaaggtctacctggcacggtggggcatccaaggacgatggatgaaacaggacccccggcggtgggggaaccccgctcgggcccctcggccgggtcagcgggccccacagccgcagcctcccccaggcccgctgccacaagccccacaggccgtgcacacattgcggggagatgctcacagcccaccgctgatgaccttccagagttcgtctgcctgaaaacgcttttgctgtgcctcaggatgggggagatgagatctgaagcacccggtgcagcctccgagaagaacaacttctacagagatgccagggacagccgaggtagcggcggtggcacaggaggaaatgctgcctgtgcccaaagcccccttccgcggacttctaagattaggagcaaactcaggggtaggggctgggggtgcaggggaggggattctgagccacctgtccgcaagcaatagtcctattttgggctggtggcttctgagaggtgactcattgtggactcaggatgaccaagacaaagcaactctggctgattccagccaggaggattgaggcctgtgagttatacctgtggttgaaaaccgaagcttcccttgcccctgctccctccagtagtggccccttggggctatttgtgtcagaatattgaatgtgcgtgtgtgtgtgcgtgtgtgtgatttggggtgttctttttgtttgcttggttggttggtttttattggggcttcccccctcaagttctctgatgggcatgagtcaccctccggctgggggttctcatccgtgtcaatgtccgagccgcaagcttattgctaagcacagggtacggcccctctgtgtctcggggagcactggggatttgaaaatgccagtcagggttgtttcttacagaattcgttcctgtaacaatagtaatactaagggctgcatctcaggctgaccacagggcaggtgccaagttaagtgttttcatgcactccctctctcaccacctgggaggcaggtatgattaaccccctgcagaaaaactcacagtggggaagcggtgccggaacccaaagtccaggctccaactccctggacgtgacatgctcgccagccggggtacaccctgcacaatgctgggagcatctccttgatgcctccaccatcaccgcctggagcgctgatccactcagcacattctggctaagcatctgctgtgtgccaggccccgtgctgggcagtgatgggaatgaaagatgagttagatctcatctctgcccccggggagcctcccatctggtgggagacacagacacgtggatctttgctggaaagggtaacaaggccatggaaacccaggcaggagcgttctagaaatccatccactttcaagtaggacttccatgcccgtaacatccacccaccgagctaatcacccccactcctgccccgctgccctgggacacctatgagatggcatcacctaaatcatcacaaacatctccaaaggccatgctgccagtgtagacacactcattccatgggtgttagtgataccaaatctcccccagctcttagctcgggaggccctgcttgatcaatgtgtgtgtcctctgacgcagtttcctcatttcatcagacctagtgttctcacactgaccacccatccattcaccagacacgacagtgagcaaggcaggtccctgctcactgtgctagctttctagctggggcaggaagacagtgaagaaggaaggtggcgaaggcagtgagtgctctgccgggaactcagtgccaggaactcagttcgagggacacgtgagtgagacccttgtggacctggggtggtctgggaaggccgccttgagcagatgattgaagcccagatttgaatgacacacaggagccagtaatgggcgttaaagataggaaaagagcattccaggcagaaggaacggctagtgcaaagatcctgcggcagccacaggcttggtggtttcaaggaagcacaagaaagccaggtggcacaagaaagccaggtggctggggacccagagggaaggcagaaggagatgagggtgatagtgcccagctctgggctctgctgtgagtcaagctgtgcaaacacaatgtcctgcctttggaaaagcagaacaaacttgctagggcataaagcatcctccattctgcctggctgtccatcctctcaacagccccatgaagaaggggctctccccattttatggacaagaagacagactcagctgggtcaagtggcttgcccaggatcacacaggtcagctgtggaagacccaggcccctggcttcagtctttgggtccagctgtctcctccaggcagtgctgccagtgtccaggcatatggcttggcaaagtgggagaacctctgcttggggtctcgattggagaaaggaatggcttcctctcccctgatgtgagccgtcccagggccatgttgccgtaagggggtgcacagcctgtccactagcccagctgcggaagccacagctgtgtcccacgtgcagtgcctcagaaggcagaggaagccttgaggtgggggcccaagacccagattctgacatcagctctgccactgagaacagcgtgacctcaggcaaggtctgttacctcagtttccccatcggtaagaggaaggagtcagatgggtatttaaggagtttgcaaccctcgtgtcctgctgtcctggacaatgctctgtaggtgcttcctctgccaaaaaggaactggtggccttgcctccctctcctggacacctggggtcaaaggtcactgccaaatagacagctagaactggggttcacctaagcatcccttgagatgtacaaccttctaggaggacattcctcctgcctgcccccctccccgcaagaggtcttttcaggaataactgaaaaacccatggggtttgtggtcctgctgctctgccaagtccctcttgggcagctgggctgaggactggaacattctgtggcaagcaggaggcctcagcagagatcaccaagacccagcacacctggtacagacagcctgcggcaaaggcaggtgcagagtgcagacagccacggcatcctccttcctgcaggtcacccccacgagccacttaacctctcagagcctctgcttctcacctgtcaagtgtgtgaggtagggtaccagttagtcacggtacttgctgtctcacagaggagccgacaggtgagaacagtgtgcatgtgggtgtgaacactcagtgtggaaagcaggtgtgtgtgtattcaatcccccaatggtgtcaagggctcctcaaaatgccatgggtccccaggtcattgtgataaacactgtccccatcctgctgtggttgtggctggaaggtccctcaaggagtagactgtccctgagaacaagatggatgcagggtagtgacgagttcaagcatagctagagttactgttttttagcaactcaacctgattttttaagctgcctacttttactttttactgtgagcttctgtccatcaccatgtaatttgtaataataataatacaaaaagaaaaacgagagagagaagaggacaagatgtccacagaggaatctgcattcgaggctgtttgcagaactaccgcgtttgtaaggactgtttcccactgggaactgtgtgtaattaatgagcagttttatgctttccctctcgtctgtgtacggtgtgattgttgtgtgtttcagaatctctattcagaaccaatagctggtaatgcctgctggctcgctgccctcaagttagcctctgaacgtgccctgcacctagagaagcagccttctcacccgcctcacctggctgctccagcggccaggccagccacctgaccatgaccattgctgatgtgcaacaggccttaattgaaaaaacacacaagtacatacatgcacatgcgcgcacacacacaggtgatttcacaggtagatctggtccctcttgctgtctccaatgctctagaaagcagcaagtaggcagctgacagtgttcccagggtgagtggcatctcccctcatcatcagaaagattcagtcaaattttggcccagagctgaagaggaggacttgggaatgtcagggaaaacatgacagggctaggggttaacaggcttctttggccaggagatggtttccagttcaccgtcaacccaaaagctctcttcaggtcatggcaaacagaccagggctgtgggtgtggctgtgcttggcactgactcccccacaggccgctgtccaggttggctcaggattccagctgccatccccaggcaggcccctccgctggctcggctgctttcacaatcaccatgtctgtctattagagactgtgccattcaaggagacggggtccccgggggtgcagacttgtaaaattttttaatttttcaacttggctgaactggtccccatcaacaggaaaagccttcggaagtgaatttacagatttctcccatgtttgaaattaacataacatgaacccagaaggcagagcttgcagtgagctgagatcgcaccagtgcactccagcctgggcaacagagtgagactctgtctaggtaggtaggtaagaaggaaggaaggaagaacagacctggatggagttattgggaacatgtcttatcaatgttgaagggccccctatcactgtagggagacatccacgtgggttgttttcgtctgctgtgaaaatctagggttggaatcatggaagcaaactgcaggaattcttaatcatcctgctcacgtggtgggcatcagagggtgtctgcttggcccccacagcactgggacagtcagagaggccatgagtggatgacgccctgatcactgccctttgcagtccaggaatacctcactgggctggggccataccctgtgccctctggaagacaagcctgcgcacttactatgtgccagatgccatgcacagtgccctagttccttgctgtagcaccaacacgtcccacgctggtgcttaaatgcacgcaaacaactttggtggttgtggcccgaaaagctcaaatgttaaagttaagcagtcaggcaagctagaagaggtgaggagcctcctagaaaactcattcgatgacacgcgcttccctcacctattcagatacttgccgagtgcctgccacttgcctggccctgtacccagggcctatctgggagccattcctgctatagctgggaccacttgtgaaacggctagttgtgcctaacagacatgctcagattcacaaaatgaattcagaacacttacctgtcccacccgtgaaagtgaccttggaggtgtcattgccccccaccaccccagtttctagtccaagccaacagctggtgctagatagatgcttgatgaatgagcagatttgactgttagttactctgtacctaaaactcctatctttacatcaaagccctgacagatttgcccttgacagactgaaatccggggctgctgcagggttcacctccaggaggcaccattcacgacactgtcccataaatggtaatgggctcccagggatactgtttacatagactgcactgagaacggtgacccttaggtttgtacaatgaggtaccctgttgaatgaccctaaaccagcctccaaaatgtgcaggatcccacattggtcagcgccaaccctgagcacaggatctaaaactatagatgatatggccaccctggccacagctggaaccaagctggtggcccaagagagagcctcttcttggaattgcatgtcagtttctcatacgcagtttcttcctatttttcccatttcccgttttaaagctagtggcatacctcacagtcaaataaccaagtggtcagtgtctcgacaatgtgcagtaacgaggtgggggctgcaagggtgaggggctcagtcaccttaacaaggcaggagacctcccacaaaaggctgatgtgtcgtccccagggccagctggacaagggcatgcagcgcaggggtagggggatggaaatattttctctcccgtaaactctgacttcatgtgagcaggcatggggtctccctgagagctgataaccgggaaaaccaaaaccaataatattcctaataataatactagaatgtaagaataatcatgtgtttttcactgaccgctgttgctctgcttttgtctttatatacagtagtttttataacaatgtccctaggttttaataaaggagtgtcatgtc

SEQ ID NO: 598961 - DNA, 153 bp, Homo sapiens
gtgatgctggagggggacaagttgaaagtggagccgggagatccatgggggcctggagaccctccgccttaagcgtccaacgtgtggtacaacgtaccctagggtaacgagcccccgtagcaacgagtcccaacaatagtaaaccaagacgag

SEQ ID NO: 598962 - DNA, 171 bp, Homo sapiens
tgagatcctgccattgtactctagcctgggcgacagggtgagactcaaaaaaaaaaaaaatttcggtgacccacaaaacttttagaatccgataaaaggatgatttccccccaaactttattcttcccttctaatggctgtggagtttaatccccaaatgggggtgttggg

SEQ ID NO: 598963 - DNA, 418 bp, Homo sapiens
ggtcgaccgggattcgtcggaaaagggattacatgtacaaagtagatagcagcattctcagaagctgctgtgtgatgttgcttttaagtcacagagttgaacattccctttcatagagcaggtttcaaacactctttctgtagtatctgggagaggacatttcgagcgcttttaggcctatggtgaacaaggaaatatcttcccataaaaactggacagaagcattctcacaaactggttggggatgtatgtcctcagctaacagagtacaaccggtctttggatacagcagtatggaaacactctttctgtagaatctgcaaggtggatattgggatagctctaacgatttcgatggaaacgggaatactttagtataaaatctagacagaggcactctcagaaactgcttggtgat

SEQ ID NO: 598964 - DNA, 264 bp, Homo sapiens
tgtagccctggctggattatccacttaaatactccttgtctggctgagatagatccacttctaagtactagcttgtcctggctggatgatccacttatactagtgcttgtctggctcggatgatccacttaaatactagcttgtctgagctggatagatccacttaaaatactgcttgtctaggctggatgatccactttaatactgcttgtctggctggatgatccactttaatactgcttgtctggctggatgatccacttt

SEQ ID NO: 598965 - DNA, 116 bp, Homo sapiens
cggatctaaccgatagccgacagggctgaggggataaggcaggaggatgcatggggcctgtgtgtgaacagagatgaagctggggtcagaggtaggagctgtcgggctagtcgggg

SEQ ID NO: 598966 - DNA, 173 bp, Homo sapiens
  misc_feature (51)..(51): n is a, c, g, or t
  misc_feature (66)..(66): n is a, c, g, or t
  misc_feature (84)..(84): n is a, c, g, or t
  misc_feature (137)..(137): n is a, c, g, or t
  misc_feature (156)..(156): n is a, c, g, or t
gctgggtatcctccaatttaattctgacactatttggagatagcatcagancccacaggttgagtnctcagtccccaagaccgnccaccccctagacaccagtgaactagtcaatggagcccagagctgtctatctntggagaagagctgtctgtnaggcaggtgtatacaga

SEQ ID NO: 598967 - DNA, 424 bp, Homo sapiens
  misc_feature (61)..(61): n is a, c, g, or t
  misc_feature (177)..(177): n is a, c, g, or t
  misc_feature (182)..(182): n is a, c, g, or t
  misc_feature (185)..(185): n is a, c, g, or t
  misc_feature (209)..(209): n is a, c, g, or t
  misc_feature (211)..(211): n is a, c, g, or t
  misc_feature (214)..(214): n is a, c, g, or t
  misc_feature (219)..(219): n is a, c, g, or t
  misc_feature (227)..(227): n is a, c, g, or t
  misc_feature (237)..(237): n is a, c, g, or t
  misc_feature (246)..(246): n is a, c, g, or t
  misc_feature (251)..(251): n is a, c, g, or t
  misc_feature (256)..(256): n is a, c, g, or t
  misc_feature (275)..(276): n is a, c, g, or t
  misc_feature (282)..(283): n is a, c, g, or t
  misc_feature (290)..(290): n is a, c, g, or t
  misc_feature (297)..(297): n is a, c, g, or t
  misc_feature (300)..(301): n is a, c, g, or t
  misc_feature (304)..(304): n is a, c, g, or t
  misc_feature (307)..(308): n is a, c, g, or t
  misc_feature (312)..(312): n is a, c, g, or t
  misc_feature (317)..(317): n is a, c, g, or t
  misc_feature (324)..(324): n is a, c, g, or t
  misc_feature (331)..(331): n is a, c, g, or t
  misc_feature (364)..(364): n is a, c, g, or t
  misc_feature (367)..(368): n is a, c, g, or t
  misc_feature (375)..(375): n is a, c, g, or t
tacagttcagctcggtacccaggaacagctatgacatttcatattggtactgtgtgaattntaaaactcatatcatttggcccagcccatactgcccaagacaaaacttccagacaattctgatgccatccagttttgttcttacaaactgcatattagaaaaaaaaaaaaaaaaanatctncanggtcctaaatgtgatgtgcccagngngangcttntcagagcnggacgtgacntttatgtcnttganaagcntcgattatccaggtccttnncctggnntatcctngaccagncanngtnctnngggnatatngcttccnccagganatcaagctcaaagtcttaattcccaatctcagnatnncggacanggtcaaaagcctgggaggacgctagggttctggtgtaaaccttgtccaa

SEQ ID NO: 598968 - DNA, 349 bp, Homo sapiens
tttttcattataaaacataaaatattataaaagttgcaatttttttaagttaaaaaattcaaaactggccaggcacagtgggtcacgcctgtaatcccagcactttgggaggccgaggtgggtagatcacctgaggtcaggggttcgagaccagcttggccaacacgatgaaaccctatctttactaaaaacacaaaaattagccaggtgtggtggcacacccctgtaatcccaactactcagaaggctgaggcatgagaatcacttgaacctggagacaaaggctgcagtgagccaagatcatgccatcacactccagcctgggcaacagagtaagactctgtctcca

SEQ ID NO: 598969 - DNA, 285 bp, Homo sapiens
cagggaaacactatgacctcttatatcttttagtggattttttttaacacctcagacaaactgcaatatgatacatacacagcatttaaataggtggtcaggaggttgtcaaaacaaatgccagagcagagtgtgcatgtgcacgtctgcgtgcgcttgcgcgcgctcgcgcgcacacacacacacacacacacacacacacacacacacagtgtgttcggtcacacagacatcactctgcagcacagagaaaccacgagaagggaatctcaattcatacaattt

SEQ ID NO: 598970 - DNA, 567 bp, Homo sapiens
  misc_feature (40)..(40): n is a, c, g, or t
  misc_feature (562)..(563): n is a, c, g, or t
gctctgctaagagatgtccaaggcggcggggggcaagatncttccagactcatctgtcagagccccaagccctttagacccagagcccaaggaccatgcctttgggacattaggactgcagcctttgcttctgtgtattttggagttttggtgacttttgtcacctggacacactcatttgttagccatagtgggttcccttggtcagcaacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaaccccccggcctctgccctggcatggtctccgcatgggctgaggtgtagctgattggctgccacatttcggccatgctggctggcgtgcccatgttgcagatattttcccgagttccccagaatggatggtattgaatctcagccacatgcaacactgtgtccagcattctttgcaataaatactttttaaaaaannaaaa

SEQ ID NO: 598971 - DNA, 426 bp, Homo sapiens
  misc_feature (421)..(422): n is a, c, g, or t
tcccctgttgctgcccgtgtccacacaggaatgtacactggtggcagaaacatgcatttgccataaataacagtgcatgtacctctggatgtcatctgaggtgagaccaccgaggccttttctctctgtgtacagaggggagttaggagttgctggactggatgcattacgaggactggggacagggtagagggacatccagggatcagggcatgagtgggggcaaccccccggcctctgccctggcatggtctccgcatgggctgaggtgtagctgattggctgccacatttcggccatgctggctggcgtgcccatgttgcagatattttcccgagttccccagaatggatggtattgaatctcagccacatgcaacactgtgtccagcattctttgcaataaatactttttaaaaaannaaaa

SEQ ID NO: 598972 - DNA, 278 bp, Homo sapiens
ctattgcatgggtaatctcctaaatattttaagttaatataaatggggaaatgtggggaaatagctgggcagacccagagttgttaagagttgcaatccaatctctgacaaactataaagacctttaaggaaaggataaaggtttggttgcatgctggcagaaaagtcatagctgattcactacttaccttgtatgctgtgttatcatgcctgctcctgttcggctatcgcccattcgcctcgtatcatgatagctaggcccttgagaagggggaccc

SEQ ID NO: 598973 - DNA, 87 bp, Homo sapiens
ggcacgagcttgaaggcagccacttgacactaatgctgatgtcctgaacatcggtcacttgcatctgggatggtttgacaatttctg

SEQ ID NO: 598974 - DNA, 367 bp, Homo sapiens
cacagtagtgaaaccacatctctactaaaaatacaataaaattagctgggcatggtggtgtaatcccagctacttgggaggctgagacaggagaatcacttgaacctgggagacagaggttgcagtgagccaagattgcgccactgcactccagcctgggtgttaaacacagcgagttctaagtttctcttcaaagaatcagtatgtcagtatgttcagttctttgttctccattttcaagtttaacttccttgtactcttcatctctttgcccctagtttcagtaaacaaccttcccgccagttctaatcagtagttcacatctgttcccctggtcacctgctctgtcctgatttccaccttgcca

SEQ ID NO: 598975 - DNA, 206 bp, Homo sapiens
tatgcagcgcatgtcagagggtgtgccttcggtaacctctgggactcagacgtgaaatggggctattcctagtttaattgctatagctattatgattattactcgataagtattgatcggtaatattggttatggttcattgtccggagagtatattgttgaagagtatagctattacaaggattatcgatgcggttgctcgcgtt

SEQ ID NO: 598976 - DNA, 849 bp, Homo sapiens
gccctgatgtgatgccgtcctgcgcggtctgtcgctctggaggcagcgtccttttatctccgtcgcgcctgctctccgtacctaagtgcgtgcgccacccgatggaagattcgatggacatgggacatgagcccccgtgaggcgcccagaactatcgttttcggtatgtgaactaggaggccgaccaaagattagtcactctaaggtggataatgatgaaagatgagcaccagtgatctttcagaagcggcagttaggagggctggtgcaaaggatgagtggcacattgttgaagcagcaggcgattgaacttacgagaggccgtccaagtgaacagtatacacctggcaaccttttgaagagagtgtctgtacagccaaaggtttcccttgggggccttggaaataaggcaccaccagtgattctaacggtggacgcgtggttcagggccagtgcagtataggggacagcacttagtagctgtggaggaagatgcagagtcagaagatgcagaggagggaggcatgtgaaactcttacgtatttcgggaacagcggtctgtccctgaaaggtggtagcaaggtcccataatgattaaagttaccactttgtcgctgatgaagatggtgaccgatgattgctgaggatgttgtggaagaagattatggatgtgatgatttgaagatgaggaactggagaaaaaggcagtggagaatttatagaggatttccagcataaggtcggagcaatcccctgtaaaattgaggtttttacgcagttaatggaggattttatgaaggaacggttaaacaaggctattttacatatacattggggaaaaagggggtc

SEQ ID NO: 598977 - DNA, 128 bp, Homo sapiens
  misc_feature (58)..(58): n is a, c, g, or t
actacctttattccttagtactcattacatcttccatagtcactgaattttattcttngtcagtgcggcttatttaaatactgactgtatggaaaaattaaaattatggtatccttaataaaataaca

SEQ ID NO: 598978 - DNA, 255 bp, Homo sapiens
agggtgggtccaaagacgataccaatggttctctgcatacataagattctcctttgcgtggagggtcactctctttagatgtgccatgaggtacctggagtgttaccgcagttgagcagtgtggcagtaagtttcatgtgcttcatagaagggttcccaatttgctcattccggatccataatttggggcagatatctaataaaacttaggggtaaggcattcatattgtaatggaggtggaattgggcaaatcc

SEQ ID NO: 598979 - DNA, 1577 bp, Homo sapiens
  misc_feature (1577)..(1577): n is a, c, g, or t
ggaatgccgctccgagtgcggaagatgaggacgacgaggactactgtgccctatgtgcctgttactgtgcatgcgcctggcatgctacttgctccagaatgctgctgcagctgaagactgcaatggtgagcttgcggaggaatgacgcatgcatggacatgctggtatgtgatacccctgtggtgagatgatggactgagcatccctgctatggcccttcatgtccaagctgttcaagcactcctgcgattcatggcagccatggcaacctttacaacgatgaatgtgcttgacatgctgctggcaaatgatgtcttgcctaagggcacgcaagcaagcttgaaacagtgacacgacacgcagaacagaactccctggaacgcagatgatatgacctgaatgaggcctctgaaggccacttctggactggtccacgcttgacacgggagcattgggcctacaggggtgcactttaccgttagttgcattgaacccccagcttcaaaaaagccacgtctgggaacatccacaacaccaccggttcaagtggctgcccgtggacggccgattgttcctttggaacaaaggatgctggaccaattgcaggtcctgccagattgccgtgtaccaggaacaacataagcccatcatttccctttgtaggttggtgaaggtgagacgcacgcgcggatagttcccacagaccaaggccacaacttccgaagtctgcacagcctatcccaagaatggcgaagacatattggagaagcgggttctgccccgtttgctgagaggtcgacaagttccactctggaacggtaagggggctccttagtacacgtaagacgaaacagatggggccacattttcgaagccaactgcgcccaatgtgaaagcccccaatgtttccgaatgagagttctcccgctgggtggagcattttccgcacccatacgcccaaaaattatccttaattacatgtatgtggccctaggatgcgaaccactattggactttaaggggcgcatcattcactggacgtttattagcacaccggtagggggtgttaccacactgcaggcacaaatgaaacacaatccatttgagggtattctgattccaacactggtttattgcgcccctgaggttcataagtcccatgtttgcgtatccctatgcggccatttgggcaaaacccacatgtgaccggaaccaggcgacgtgcgtttaaccacccactgttctctttcccaaacgacgcgcacaacagaacgtggatcggcgccccatttaactagtggatagcatgtcacaagttaactatcacttagggcacacacatttatcgcgagtgggaagacgttatgggagcccactggggtacaggatacacatgtatgtggtatatctcttaatggagaacaggatacatacacatgtgcgtatgccattgagtatctgcactacggatagagacaaatgcgttacaacacaattatcactgtgagacgtatcgtgtagcccctctaattagagaaattatggaggatgaacactatagccatagtgttcgaaan

SEQ ID NO: 598980 - DNA, 231 bp, Homo sapiens
gtatcagaggattcataaacggagctggaactcggatggcatgaagtcaggctggaggctcggatgcagatgagcttccaaagggagtttgaccagtgcaggacacctaccagcacctaccaaggacagcagcgggcagcatgtggacgtgagcccctaacagacagcgcctgcagctcctggagccttttgacaagtgggatgtcaaggaccttggaggacctgcagatc

SEQ ID NO: 598981 - DNA, 523 bp, Homo sapiens
accgcgccacaccccacttatttatcttctcccccccctccattatccaattctcactcctttctctctctcttcactcctcccctacccccttctttcccctaccctaaatttcacacctccatattctcttctcccaccctcaaatccccaccaactttcactccccaaccacaaaacctaaccccctccactccaccctttctctattaatattcccccctcccctatcctatctccaactcttcctatacttcccctccccccctctctttaactcaccacccttatcctactacttcacctcattatacctcccctctatccaaacctcctacaccccaccttcctcacttcccccaccctctatcccccccccaacaccctactacatcaccactccatctcctctctttcccctcactcccctcatctcctcccacctaccaccacatactcttcattcccctaccctctctaactcaatctatctactacctcatatccacctcacctctttcct

SEQ ID NO: 598982 - DNA, 117 bp, Homo sapiens
tggaccgaggctaaggctttcaggagagttagaatctcatagtaaagactgagaaatttagtgccagaccaagacgaatgggtgtgtaggctgcatttctttcttactgcgtacaca

SEQ ID NO: 598983 - DNA, 198 bp, Homo sapiens
ctcagggtttcgatgatgatggttcagaatttcatgaacatatatgtatctggagaaacaccgtggagagcatttacaaaacaagcgaccaatctcgccaccttcatggtagactggagactttggggcctttccaaaaacccatatacttagcgttaaacagaagcgctgaacacatcagagcgggtgagaaatcca

SEQ ID NO: 598984 - DNA, 228 bp, Homo sapiens
gtgtgcagtgaatcactaagttgatggctccttacggcagccacagaaaactaacagtgaggagggagcactgcatttaactgagtttacaaaggaaatatctgaaatgcagaggagtgacatgcccaggcttactctgatgattttaaaacaagtttgcaaattccttgacactcttcttaaaaaagatggaatcaaactcccctcccattgcaacacggtctctca

SEQ ID NO: 598985 - DNA, 122 bp, Homo sapiens
ctggcttctcaggtctgggtggggtgaccccaggagtcttttctgtctggttcttgctctgttttctgaaaaccagcctttttgtcctccaacaggttttgtcaatgagtcaggaaggagaa

SEQ ID NO: 598986 - DNA, 210 bp, Homo sapiens
aaagggcacaggtagcttgcgccctgtaaaagttgccccctggtaccttgatcgctgtcggagctgaacaccatctcccagagtcacagctctggacaccgaccccagccttgactcagggccccgccctctcccttggtctgtcgtgcccctttaggaggccgcctccctgccgaggccaggctgccgcccgcatctgccagtcccgcc

SEQ ID NO: 598987 - DNA, 143 bp, Homo sapiens
gagaccggcgggtgctgcggcctcagcacgagttgacgccgtgtgatgcgtctgctcctagagtgtgtgatcgtgtcttacctgcgtactactaccccgagtaagtaacctatcttgccaccgggaataccacctacgaaaaa

SEQ ID NO: 598988 - DNA, 525 bp, Homo sapiens
catgtgatatgtagagaggtagtgtgtgtgtgtgtgtgtgtgtgtgtgtgtgtgtgtgtgtaagtatatatgatgactatcatatcaggtgaatctgtaggaatccttaggacacgattgtgttagtgctggccacagatattatgcttatctctaacaaatgacagagagttccaccaatggggaaacaaattatctacattttaaaaatgtagtttccatgatctggcaggtagcgtatacattatagtgcgtgcccatccaacattacgcttagtagatcacaagtggtgtaggagaggagagaagatgactatgatgaactaactcttttcccgttgatgtagagcaagggcaaaaagcagacatatttccccatctgctccctttcgggggagcgctaaattttcacagctcatgtctctctctgagggggtacgcccctgagagtgtgctagctgtgagaaagagttgcgtcctccaagtgcaaacaaaccccaggccgagacatctttctccagagtg

SEQ ID NO: 598989 - DNA, 165 bp, Homo sapiens
  misc_feature (26)..(26): n is a, c, g, or t
  misc_feature (53)..(53): n is a, c, g, or t
  misc_feature (74)..(74): n is a, c, g, or t
  misc_feature (137)..(137): n is a, c, g, or t
ttggttgtgaagggaaggtaggaaangcatgtagtggaaatggtcagtagacnacggtagagggaagctaggtnacattactggggaacagctggtggagcctggggttacagcatggggagaaatggagatggagnacaggacagctggtttttacagaggatc

SEQ ID NO: 598990 - DNA, 477 bp, Homo sapiens
aaggctgacttagagttatcccattggatagcggattagggccgacaggaccgagggccttagttggtgggcaagtcggggatcccagaaagagaagcgtgacccggaagcgagaaactgggtgtccgccccagctccgggctgccagtagagcttctaccatcatggagctattgtacgggcgccggaagacgccaagagaagctatctgggcagacaccgcagagggccctgaaccgtgccatgcgtgagctggaccgcgagcgacagaaactagagaccccaggaggaagaaaatcattgcaggacattaagaagatggccaagcaaggccagatggattgctgtccgcatcatggcaaaagacttggtgcgcacccgggcgcatattgtgcgccaagatggctaatggatggcggcccaacatttccaggctggtgtcccttaaggatccagaacattcaggtccacaaactc

SEQ ID NO: 598991 - DNA, 1515 bp, Homo sapiens
gccccctctcacgccaaccccggccccagccgggctgcagagtgctgctgatgcgctggtgagtactagattgcagtgatacaagaaggtacatggtagagatagacaccactaccccactcaatccccacagatctacgacacatagggtctgactcgaagtcgcacgctctggatggacgcgatgcctagaggggtaggtgagctcatggaaggtgcccataacggaaacggcttcgccagtgcggtcgcacgtgtgttgtggcacggtgagactctaagagagacatgggactatgacagatgcgctggtgaagtcttgctcgcaggtctgtcgcatgaccacttgtcgcactagatggtgaatcgcaagggatagaagatgatgctagttgatgctcacatgtgtagatcaattgtgctgttgatctctgctacatctgttgcgtacgtaccgttaagctcgattcgtagagcggcatatttttgtgtcacgcccaaagtggatcatagggtggggccatcggctaacggattttcaccgtaaatataaagaggtgggacacaccaaggtccgccaagggaacactaagcgctctccattgggcccctaaacctttatcagaacagcagcaccctacccctttagggagtacccccccatgaaggcttccttattggccttttgggaatcttgtccctaaccatgatgaaaagggcctatgtggagacgcaggggggtatggtgtaggaagggtgtcccaaagggggggccagggaggcgctccttagggaaccaataccattaggagttgtagtgaattacacttagacaccggcggggtaggccccggcctggtggagttctccccactagagtccacccacgcgtctagagggcaagtgctccccggaaaggtggcgggctaaaaagcctcggagaaacctcttcccccttgttaaagtcaccaaacgggtgaggacagaattgcgagcacacgtgcgaggcccaaggctctccaaagggggggggaatggccgaaccaaaggtcgtgctgcaagaccaaaaggccacggtagcgaatagaacggcacattggccaaaaagcagggttacatatacacgctgatgaggagcaccaactgctaccaaccctgtaggaatcctccggggtggcgcccatactcgctttagcaaccgcgcccattttcgttttggatttgaccaccaccaaagccggaatcgggggtgccggaatacttcgccgaaaattggggagagacgacaggctgtgtgagtgccacttatttggagccattaaggtggcgcaatggcacgggcacattttggatccccccttatagacaagaggattcccccccattattcacccgatgaggggtcgtttataccccattgggttttataacgcgccgtaggaggtacatatatatggtcatatgtccccatttggtggcggagagactaaaacaaaagccatataaaatgtgggg

SEQ ID NO: 598992 - DNA, 858 bp, Homo sapiens
  misc_feature (51)..(51): n is a, c, g, or t
  misc_feature (73)..(73): n is a, c, g, or t
  misc_feature (75)..(75): n is a, c, g, or t
  misc_feature (101)..(101): n is a, c, g, or t
  misc_feature (109)..(109): n is a, c, g, or t
  misc_feature (113)..(113): n is a, c, g, or t
  misc_feature (149)..(150): n is a, c, g, or t
  misc_feature (157)..(157): n is a, c, g, or t
  misc_feature (160)..(160): n is a, c, g, or t
  misc_feature (170)..(170): n is a, c, g, or t
  misc_feature (173)..(173): n is a, c, g, or t
  misc_feature (176)..(176): n is a, c, g, or t
  misc_feature (179)..(179): n is a, c, g, or t
  misc_feature (195)..(195): n is a, c, g, or t
  misc_feature (200)..(200): n is a, c, g, or t
  misc_feature (207)..(207): n is a, c, g, or t
  misc_feature (219)..(219): n is a, c, g, or t
  misc_feature (222)..(224): n is a, c, g, or t
  misc_feature (230)..(230): n is a, c, g, or t
  misc_feature (232)..(232): n is a, c, g, or t
  misc_feature (237)..(237): n is a, c, g, or t
  misc_feature (242)..(243): n is a, c, g, or t
  misc_feature (245)..(245): n is a, c, g, or t
  misc_feature (249)..(250): n is a, c, g, or t
  misc_feature (252)..(252): n is a, c, g, or t
  misc_feature (262)..(262): n is a, c, g, or t
  misc_feature (265)..(265): n is a, c, g, or t
  misc_feature (275)..(275): n is a, c, g, or t
  misc_feature (279)..(280): n is a, c, g, or t
  misc_feature (282)..(282): n is a, c, g, or t
  misc_feature (286)..(286): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (301)..(301): n is a, c, g, or t
  misc_feature (307)..(307): n is a, c, g, or t
  misc_feature (309)..(310): n is a, c, g, or t
  misc_feature (312)..(312): n is a, c, g, or t
  misc_feature (314)..(316): n is a, c, g, or t
  misc_feature (322)..(322): n is a, c, g, or t
  misc_feature (324)..(324): n is a, c, g, or t
  misc_feature (340)..(340): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (361)..(361): n is a, c, g, or t
  misc_feature (366)..(366): n is a, c, g, or t
  misc_feature (381)..(381): n is a, c, g, or t
  misc_feature (383)..(383): n is a, c, g, or t
  misc_feature (529)..(530): n is a, c, g, or t
  misc_feature (553)..(554): n is a, c, g, or t
  misc_feature (621)..(621): n is a, c, g, or t
  misc_feature (673)..(673): n is a, c, g, or t
  misc_feature (733)..(733): n is a, c, g, or t
  misc_feature (759)..(759): n is a, c, g, or t
  misc_feature (853)..(853): n is a, c, g, or t
ggctgcggactccctcccctgcacggtggggacagccacccagagttagtnttctggggtccctctgccaaangnggtgggcgttatgcccaatcccaggntccccttntttnctcccctgggctccacgtcccaaggtcagggccacnnttttttnttncttttttttnctnctnctncaaggttttggttttnttgcnttctttnttttttttttcnttnnncttgtngntgggncattnnanattnntnctggttactnttnttttcccatnttcnntntgcntngngnccaggtctngggttntnntntnnngttttncnaggtatctggggtatnttntngnatctgctggtggcngaggnaagttcaggttggtnanggctgtgatggggccctcagcatccccaccctccggcccacccggccctcctcctgtgccgcgcccctgctgggcccgaaccagggcgttggcgctgcgtgccagggcctctgcctctgcgtctccccgcccactgttcacaaagnncccttcctcctccgcctcgggtnncccagccccggccccctcgccccacaccacctcctgcacctcagcccggatcctcagttggctcagnagtgcccgcagccgcccctcggccgccccaggcgcctcccgaggccccaggnacagggaagatccggagccgggcgctatgccaagcgggcaccatgcccaagatggttgcnatctgcagcaggaagaggccgcaganatccacatagccgggccaccccgggggcgcagcaggttgaggggccacacgtccacatggtgcagctgagaggtgccccagacccccggctcancgctt

SEQ ID NO: 598993 - DNA, 223 bp, Homo sapiens
gacagtgtcataccccaaataaagtataggcgatcacaaattgaaacctggacgcaatagatatagtaccgcaagggaaagatgaccaattataaccaagcataatatcgcaaggactatcccctataccttctgcataatgaattaacaaaaaataacatagcaaggagagccaaagctaagacccccgactacagcgaccaggctatgaacaacagagggg

SEQ ID NO: 598994 - DNA, 464 bp, Homo sapiens
cattgcatacaatagttgagttgattagcttggtgaccacgggtttacatattgtagggggaatggggaagctaccctgaccacctgtgacatacagcatttgctactatgccgcctacgccttccgcggatctaacggttccccgcctgcgcgaactgcacgcttggcgatgtgttgtactgtattgcttacccacgtgcgctcgcgtattgatatgggggggggggggacattacttttaaattacgggtgaccgcagccgcgagaataaggtagtggttgtgccagctgccctactaggccccgcagaggcccacctgccgcaaaatggaaccgacggcgtgctatgcagggccgggcgtggcggcgaatatccgggattgacttgatacgtggtatgcgaagcttacttggtttcgaatttcacccgcgcgcatacctgggcgaccacctgccgttgcat

SEQ ID NO: 598995 - DNA, 298 bp, Homo sapiens
  misc_feature (158)..(158): n is a, c, g, or t
tatatatgaactgtgtaggatggctgggtgtggtggcttatgcctgtggtcccagcactttgggaggctgaggcaggcggattgtttgagtcaggagttttgagaaccagcatggtgaaaaccctgtctctactaaaaaatacagggattagctagcnttggttgggatgccacctgtggtcctagctactcgggcggctgagggacaagaatcgcttgagcccgggaggtgaggttgtggtgagccaagatcgtgccattgcactccagcctagacgacaagatgaaactttgtccc

SEQ ID NO: 598996 - DNA, 278 bp, Homo sapiens
gcgggtgctgcctgacggtagagaaggagcactagtatgctactccagtattagagctgtacttttgtgggagttgatatagaatgggagggatgtttagtatatccagatattattggtaatatgggatatattattgattctgatcactcttggtcagtttctctttctttatctttctttctccttttttaagaaaacgagttaagtttaacagttttgtattacaggcttgtgattcatgcttagtgtaaagtggatgttgatattattttaaa

SEQ ID NO: 598997 - DNA, 153 bp, Homo sapiens
ttcatctcctgtcagggcatacttaagtaaagaagatttgcatgcagcggttcattacttcatctcctgtcagggcatacttaagtctgttcttcaggagatgaagtaatgaaccgctgcatgcaaatcgatggcaaggtccgaactgatata

SEQ ID NO: 598998 - DNA, 108 bp, Homo sapiens
ccgagcagtactgtatgttgcactcaaaaataaaataattcggtgtcgtctggatgtatacaattttggataactccagaagatgacacagtgttactttattagatg

SEQ ID NO: 598999 - DNA, 945 bp, Homo sapiens
  misc_feature (45)..(45): n is a, c, g, or t
  misc_feature (49)..(49): n is a, c, g, or t
  misc_feature (74)..(74): n is a, c, g, or t
  misc_feature (80)..(80): n is a, c, g, or t
  misc_feature (84)..(84): n is a, c, g, or t
  misc_feature (89)..(90): n is a, c, g, or t
  misc_feature (96)..(97): n is a, c, g, or t
  misc_feature (99)..(100): n is a, c, g, or t
  misc_feature (111)..(111): n is a, c, g, or t
  misc_feature (117)..(117): n is a, c, g, or t
  misc_feature (121)..(121): n is a, c, g, or t
  misc_feature (123)..(123): n is a, c, g, or t
  misc_feature (129)..(129): n is a, c, g, or t
  misc_feature (131)..(131): n is a, c, g, or t
  misc_feature (134)..(134): n is a, c, g, or t
  misc_feature (148)..(148): n is a, c, g, or t
  misc_feature (150)..(150): n is a, c, g, or t
  misc_feature (156)..(156): n is a, c, g, or t
  misc_feature (170)..(170): n is a, c, g, or t
  misc_feature (174)..(174): n is a, c, g, or t
  misc_feature (176)..(176): n is a, c, g, or t
  misc_feature (180)..(180): n is a, c, g, or t
  misc_feature (186)..(187): n is a, c, g, or t
  misc_feature (200)..(201): n is a, c, g, or t
  misc_feature (213)..(213): n is a, c, g, or t
  misc_feature (219)..(219): n is a, c, g, or t
  misc_feature (221)..(221): n is a, c, g, or t
  misc_feature (240)..(240): n is a, c, g, or t
  misc_feature (247)..(247): n is a, c, g, or t
  misc_feature (251)..(251): n is a, c, g, or t
  misc_feature (269)..(269): n is a, c, g, or t
  misc_feature (277)..(277): n is a, c, g, or t
  misc_feature (280)..(280): n is a, c, g, or t
  misc_feature (284)..(284): n is a, c, g, or t
  misc_feature (302)..(302): n is a, c, g, or t
  misc_feature (305)..(306): n is a, c, g, or t
  misc_feature (318)..(318): n is a, c, g, or t
  misc_feature (323)..(323): n is a, c, g, or t
  misc_feature (353)..(353): n is a, c, g, or t
  misc_feature (364)..(364): n is a, c, g, or t
  misc_feature (367)..(367): n is a, c, g, or t
  misc_feature (380)..(380): n is a, c, g, or t
  misc_feature (382)..(382): n is a, c, g, or t
  misc_feature (388)..(388): n is a, c, g, or t
  misc_feature (396)..(396): n is a, c, g, or t
  misc_feature (406)..(406): n is a, c, g, or t
  misc_feature (415)..(415): n is a, c, g, or t
  misc_feature (423)..(423): n is a, c, g, or t
  misc_feature (430)..(430): n is a, c, g, or t
  misc_feature (433)..(433): n is a, c, g, or t
  misc_feature (436)..(436): n is a, c, g, or t
  misc_feature (439)..(439): n is a, c, g, or t
  misc_feature (441)..(441): n is a, c, g, or t
  misc_feature (443)..(443): n is a, c, g, or t
  misc_feature (471)..(471): n is a, c, g, or t
  misc_feature (489)..(490): n is a, c, g, or t
  misc_feature (497)..(497): n is a, c, g, or t
  misc_feature (501)..(501): n is a, c, g, or t
  misc_feature (504)..(504): n is a, c, g, or t
  misc_feature (520)..(520): n is a, c, g, or t
  misc_feature (529)..(529): n is a, c, g, or t
  misc_feature (532)..(532): n is a, c, g, or t
  misc_feature (924)..(924): n is a, c, g, or t
aagtttgtgattgtagactgcagatacccctatgaatatgaaggngggnacatcaagactggggtgaacttgcncctggnacgngaggnngagagnntnntactgaagagngccatngggngntgtagngnggncaagagagtgatcntnattttncactgtgaattctnatcngngggngggggnnggatgtggggttnnatcagggaaggngaccgngntgtgaaggactacgccagnctctacnacgntgagatgtatatggtganagggggcnacnaggngttcttccctcagcaccngannttctgtgaacgncaggnctacgggggcatgaaccagggggggttcanggatgagctanagnggttgggggtgangngtgggnggtggggngggggggggnggggggggnggtctgtnggggggnggnggnggngngnggggggtgggggagtggtgctacctccnttgggtttgggggggtgnngggaggngggntangggcgtgggggggtgngggggtggnggngggtgaggtggtgtccatgggaaagatggtgtgggtgtggtgggtgtgtgggccaggccagattcgcgctgtgtcatgggatgattttcggatatcctggtgccccccacccctggaagagcccagtctgttgagttagttaagttgggttaataccagcttaaaggcagtattttgtgtcctccaggagcttcttgtttccttgttagggttaaccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggnatgtctgccatgttgcccttt

SEQ ID NO: 599000 - DNA, 200 bp, Homo sapiens
ctctctctctctcaacaaactcagcccaacaatgtaactgttctttaactcccacctctttgagattggtataatcctcctagcttctgtgactgctagggttctgatagctgcagtcatgagagctctccggcttttggcagagtgcaatgcacctcctgataatcaagggtcttcgcttcccgtctctataaaggatg

SEQ ID NO: 599001 - DNA, 338 bp, Homo sapiens
  misc_feature (19)..(19): n is a, c, g, or t
  misc_feature (179)..(179): n is a, c, g, or t
  misc_feature (188)..(188): n is a, c, g, or t
ttttggtgccttgtgaggncttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctntactaaaantacaaaaaattaggtgtagtggcaggcacctgtaatcccagctactcgggaggctgaggcaggagaatcgcttgaacctagaaggtggaggttgcagtgagcggagattgtaccatggcactccagcctgggacaacaagagcgaaattt

SEQ ID NO: 599002 - DNA, 559 bp, Homo sapiens
aactgccctgctgcacagaaaaagacctcatgcccattcgggtaaaacttgcacaacctcgggttcatcaggttagggaacagcccagacccagaatgcctttgtcctttgtatatcagcaggctccgaggaaaaagtttcttcttttgtgggcatgaccacagtgggcttcagtaggtcaaggttggcacttttttttgtggaaaaggaaaagcccagcctctgtaaatcatcacttcaactcctgattggtcccgggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttcaaaaaaaaa

SEQ ID NO: 599003 - DNA, 442 bp, Homo sapiens
  misc_feature (9)..(9): n is a, c, g, or t
  misc_feature (189)..(189): n is a, c, g, or t
  misc_feature (360)..(360): n is a, c, g, or t
  misc_feature (428)..(428): n is a, c, g, or t
tgtcctggnacctgtggaatcatagcctgagctacaaagggacctttgagaccatcctctagtccaccatcctcttcattttacaggtgtgggacctgagctggattgaacagggtcgggggagaagaggcctgggcaggacaggccacctgggatctcatcctggcccttgccagccactggctgagntgaccttcagcaggcacttcacctctcagagttgctgttccttagagttatacgatgggtttggactagatggtctttaagattatagaagtatagggtcctaagtatatattattatattgagaagggctatggaaggatttatattaatcctgatgttcttcagttatncttctgtagtttcctgctatttacggttagccagtgttttacatttttaaaggatttttaatggggcnttttactaaacctg

SEQ ID NO: 599004 - DNA, 583 bp, Homo sapiens
acttcaggcagggcttgccaccagcctggcagagccccgaactcggaacccagcaatggccttccagacgcacgtcagctaccgcgcgctcacactgcagggccccacaagaggcctcccagtgtgcgcgggcctcttgaagaagtaactctactcagaggcccgaatgacccaaactgggctctgggaggctggggacggccttccaggccaagtggggcgcgcgcagggctcagcggggcccaagagaagggctgagggcactgggtcctgagccacccaccgaaggacgccgcgggacagcaaggcccgaagcaggaggagagaagggagcagattcctgggcctcctggggcccggtcgctccgggatgtctgagctctgggaggggcgtgcccggggcgcctccctcgcggggtattgtgggatcacgagtcactggcgacggtgggtcaggactacacttcccaggaggctgtgcgcgccgcgtggcgcctgggagttgtggtccagagcgcgggcgcggcgggcgcggcaggcgggcgcgtggactacgcatcctaggatgccgcgcgcggccgct

SEQ ID NO: 599005 - DNA, 364 bp, Homo sapiens
ttacagcgagacaccgtctagattagttatgatgtggtaaaacatcctcgtccctttgtcccttatagacgaacatttttttttcttgggaacggacatcttgctctgtcgaccagagacatgaagtgcggtggcttaatcttcagctcagtgcaacctctgcctcccgggtacaatcaattctcctgcctcagcctcctgagcagctgggactacaggcgcatgctgcgacgcccggctaatttaattgtattttagtggagacggggtttcaccgtgttagcccaggctaggtctcaaaactcctagagctccaggcaatcttacccaccttggcctccccaaaagtgtataggaattacag

SEQ ID NO: 599006 - DNA, 397 bp, Homo sapiens
gtaggtaatcgctgactcggaaagtacgggattagaggtgtcagtcaccaggccagaccctaaaataggtggaatatatattctggacactaaatacttaacaatagatgatttgcaaatagttctcctaagagtttgctagttttagctcttatatttaggtcattgctccattagagttctgtttggtgggtatatggtgtgaggtaggggttgaacttcattcttttctctgtggttatccagttttctcaacagtgtaggttgaagacactattctttccccatggaatgtacttggcatccttatcaaaaatcaattgaggataagtataagggtttatttctggactctgattctgtcagttggatggaaaaagtttccatgtccagtgaa

SEQ ID NO: 599007 - DNA, 175 bp, Homo sapiens
actgcaccttcaccaccagagaaccttatgccaaaccatcctacccaaaatatcgtataggacggtaaatgtacaaataccctgggcggaaattaatattattagtaccccgaaggggagaaatgttgggaaaattttttatcccccccggaataattattagggcgggggttaa

SEQ ID NO: 599008 - DNA, 199 bp, Homo sapiens
  misc_feature (69)..(69): n is a, c, g, or t
cttagaggatccctccagtgcgaataaaatggtacgttgtgaatatgacttctcaattacccaaatcangctacaaagacatggcatgtgtgtgggaggaaagaagattgagtgggcggagccttgtaggtaccaattctttctgacataaaaaaaaaaatagcagtccgtggggtgcagggggaaaattcttgaagtc

SEQ ID NO: 599009 - DNA, 265 bp, Homo sapiens
ctgggggagctttaaacgggggaaaccctggttttcccagatgctccccatggctgtctttaaaagactcaaaacttttttttgtcctctttgttaaggttggaagctccccccccccccccagtgtgttgagttttttcaaaaaaacctttaaatgtggttcataaatatatgaatacgtatttgtgttaaacagtgagtgtgcagtgtgttaatacttttaatttttttgctagaaaaataaagtttcattcccttctgtgga

SEQ ID NO: 599010 - DNA, 271 bp, Homo sapiens
  misc_feature (204)..(204): n is a, c, g, or t
aaaaccaaaactgctcttctagtgccaaacgccctgatcatagcaacagtcacagacagggtgagtatgcagccgagcgagggcatctttgctttgtcctcctgctctgggctctgctgcctaaggggtctcttgccaaggaccaagactccaaaccataaatatcatctcctgtgggtgaatcagggaaaattccataaggantaattttaaaaattattggcctgtaggacatttcatgtagtgctgtttccctttcacagggtgattt

SEQ ID NO: 599011 - DNA, 1077 bp, Homo sapiens
  misc_feature (1077)..(1077): n is a, c, g, or t
tgcagttagaatcgcgtttgcgacgaaatgattgggtgagtgggatctcaccgtgggtccgatatagcctttggtctgccttgtttgattgaagctcccagtggaattcgcaatattggcttggaggggtgaatgtgctgtgaagagggatccggtgataaggaccatagacaatgaggggttagcccgcttgcgaataagtggccggtttgcaggtctctctagttggaccggtattctattcggaggaccgtaaaaatctcagtgacagacctactccattgggtcggttgttgccctcgaacgtggccgtttggtagtcgccggcggcctcccattccctgagttttcaccttccacgcgtgcggagtggtgacctttaaaactgctggcctgagcaacgttgcaactgcagcaagtattcttagaccggtttacacggggtatatttagctccccttcgggttagcattgtgcatgcttttggcatactttccgcgtggcggctatagaccgtagcttgggttctacttgcaatacatgcggccataaccaccattctgcctgttcggcgatgatggtaccatgcccacaacatttcaatcaaacttctccttgagtgtgccatcggcgatacggcacaatcgggacgcacttgtgctacatggatttgccttgaatgcccgttgggtattcatcgaggcagtcctatggtactttctaacgcaggtctgcaccggtgatgtacgactccctcagcgggaccgtgttctctctcgtggtgagccaatgccacgtttggtgccttgttgggaaatcctatttggcgcagtctggaaagttacattaagttgttacaagcaaagcaaagttatttgcatttccgctttacaccatatttgatgtgccctgtggctacacgaagtcagtgcttcgagcaggggggtgcaaggtcgctctttcaccacctggttgcttctcatggagccgcaggttgtcacacctttggttggccgacacattcctcgggtgtgtgcaaggtttctcgcacaaagaaatgtgtgcgcggcgagttan

SEQ ID NO: 599012 - DNA, 172 bp, Homo sapiens
aataactttaaaaaaatatgcatcttttaggcgatccaagatagccaccagttaacatggaaatatgtagaacttttaagggtcctgagatcctggagatcttggttaaattggtgaagattaatggctttggaaatccataactagcttggcttctggtcttctgataata

SEQ ID NO: 599013 - DNA, 169 bp, Homo sapiens
gatcatgtctagatctgatcaacctcccattcttgggctattagagtgcacaagaaattaccttgaaaaaatggaattcagtgactgaccagtctaggtaaagacagatgatactgtccagcatgcatgcagttccagagagctcaaggtcgtgattccacatttttgt

SEQ ID NO: 599014 - DNA, 357 bp, Homo sapiens
aaaggggggggggggggggggggggccccccttttccccccaaacccccgggggggtatttttttttttccccttccccccccccccccccttttttcggggggggggggggggggcccccccgtttttttttctcggccccctttttttttgggggaaaaaggggggttttttaccccccccccgggcccccccccccgggaggggggggggtttttttgggccccccctggttttttttttgggggggggggggttttggttttttttttttttaccccggcctttttttgggggccccccccccccccattttttcccccgttttttggcccccccttaaagggtttttgggga

SEQ ID NO: 599015 - DNA, 1092 bp, Homo sapiens
gcaggagttccatgaccaggctgggcaaccatagcgagaccctatctctaagattacccagaagagagaaaatactcttttcttggagaacggagtctagcatctgtgtgcccaggctaggcattggcacgcgcagcgaatgctaggagctgccactcggggcacttacttgcctcgcacgaagtgcacagtgatgctcctcgcctgcagcctcctggggtcacgctgggattcacaatggtgcatagccgacccacagcctcggctcacatttgtcgtccattgaggaagtcaagaagacggaggcttgtcgaccagaagagtgggaccaacggctggggcacctccgaggactccgtgcacgcgtcaggggtagagtgccaccacaaggcgtgcagcacatcgcgcgagaaaccatagagtggaggatgtaacgagggccgctgaaggccaacacgacggcgccaagagccaacagagaacacaatctccgaacgcagggcaagctacacacacaaggtggagggcactcgggaggcaccactgggggacgcgatctgcggtagcccaccccgagtagggcacgacccacgacagaggggccaacaccactcccggcgggagaaaagaatagccaggacgtgaggaaacaaggcgaaacgcagggacactcccgtcaggagcggcgaaaagaagcgacgcgagtgaggaacgagaagctaagaccagaagaggagacacaagcccccggagaagggagaatcggaacacttaccaacggaggaaagctggaaggactaaccaagagggaagagacatcaccacgagggggagggtggaagacacagccacacagcggagaagaagcaaagggcacacccaagcggagacacttgccgaaagagaaactaaaacaagccaataggggcaaaccacacccccgacacaaggtcggaacagcccaacaagaccacccgaggatgaaagaggaaagacggaaacagcaggggaggtaaaagtatgaccacacactgcgcgaacgcaccaagaactggtaccagaagagaacaacggacggagaaagggacagac

SEQ ID NO: 599016 - DNA, 828 bp, Homo sapiens
gcactggttgttgcgctgagcagtgcgggtcggtgcaggctcgcttgactcattgccgcacctaggtagagtgatgctgaccctcttgcctgttgctttgggagcgcattgctccgaacctcgccctatttgacctgggagagatggagaaggactgcttcattgatgcgatcccgtatgttagcacgcgtcgtaggaaattaccggaactcaggtgtctaacagtccacgcacattagtacccgcgcgggcctcccacggcgcattgcgggtatgcgtaaaagataaccggacgcaatatgtgatggtctatcccgtgggcccgtccgtatcgcatcctgagggctggttccggtcagcgcgttcacgcatacccccgtgttaatcacactaatcgtagtcttcatatccagagtcagccctgagttaatcccatcttttggcgtggaaggtcctgctgtaggatttctcatgagactagtccaacagatagggtagagaccagttgtgcaagtgaggtcttcatgagaattgctgcgtcatagaagatggttggttgaggtcagctagctcgttacgcaacttgcagagcacgtcttggatggaacagagtggacgcacgactcctgaccatgagccacgaactaccatggagggcccgaagagtgagccagcttttgcgggctacaccagtaagagcacgctaaccacgcgggtagctgtcgctgtggatactgccgacacctcattcgtcgatgaacatcgggtgtctgacctatgcgggcacctcgagacttctgtgatgccaataacgcttgtgtcctgtca

SEQ ID NO: 599017 - DNA, 209 bp, Homo sapiens
cactgacaggggacagtccgttcaagagagactagagagaaatgaatagtatgagtagcgcatcaggagaaactcctactaaaaagagaggaattctttaggaagatggaagtgaatcaccagacgaaaagaattggcccaagaaaatcgagttctgcgcttattacgccggtctcgcaagatgtagcgtaatgagccgtggttcccac

SEQ ID NO: 599018 - DNA, 159 bp, Homo sapiens
aattcgcggccgcgtcgacacggtgcgagaagacgacagaagggggctactcaggaggctgaggcaggagaattgcgtgaatctgggaggcggaggttgcagtgagctgagatcgagccactgcactccagcctgggcaacagagcaagactccatctc

SEQ ID NO: 599019 - DNA, 188 bp, Homo sapiens
ctcggctccagcgccatggcccctcccaggaagttcttcgttgtggggaaactgtgaagatgaacggggcggaagaggagtcttggggagctcatcggcactctgaacgcggccaaggtgccgccgacactagtgtttgtgctcccctactgctatatcgacttcgccgcagagctagatcccagatt

SEQ ID NO: 599020 - DNA, 230 bp, Homo sapiens
gccaaggtctgcgtgtgccaggcggtctcgaactcctggagtacatgatcctccacctcggcttccgaagcgctgggattacaggcatgagccgggtgctcggcagttgctcttaatttagacctaactctgataaactttgttatctgggttcttagccaaattaattttatatttaggaaattaagagcattactagttaataactggagctgtcgggctagtcgggg

SEQ ID NO: 599021 - DNA, 346 bp, Homo sapiens
gctcgacttttgtgttttttgagacagagtttcattcttgttgcccaggctggagtacagtggcacgatctcggctcactgcaacctccacctcccaggttcaagcgattatcctgcctcagcctcctgagtagctgggattacaggcgcccaccaccatgcctggctagtttttctatttttagtagagatggggtttcaccttgttggtcaggctggtctcaaactcctgacctcaggtgatccaccagcctcgcctttccaagagtgctaggattacaggcgtgacgaccgcgccctgccatataatctttttaaaaccgacaatctataatttccgtcgacg

SEQ ID NO: 599022 - DNA, 689 bp, Homo sapiens
agcgggtccttgcggtgctgggcagcagaccgtccaaaccgacacgcgtggtatcctcgcggtgtccggcaacgagactaccaagacagacgctatgactgaggctgatgtgaatccaaaggcctatccccttgccgatgcgcaaccgtcacgcaacgtaaggcataactgcgacctcgattcagcaagttcatgtagactagtaatgcagcgttcggaaacggagccgaactgaggccactcaaatactccttcaatcagggagcgatctctgatgttcatcgtgatggcatgcagactgctcgagccgactggagatcattgctgcacctgccgctgctgtgtgaagacgagaatgtgaccctacgatgatttagtgcgctgccaagcaggaccctggggagagcctgtggggtctccaggcctgtcatcgcctgttgctgtgcaccatctaaagaaggctcgcagctgagaacagcagatccaatccagttcaggcagtcgaatggaaaggctcttaggtctaaacctgtggacctctgcgcacggtgctccctgccaggcttcccccctgaggttgggtatcatattatctggtgttagcatgtagtattttcagctacgtctctattgttataaaatgtagtactaagatctgagaaaagtgagtgaaatgtctccaagcgccg

SEQ ID NO: 599023 - DNA, 385 bp, Homo sapiens
acacaggaacagcaatgcgggaaatcgaccataatcccatcactcccacaggtcctccctataacatatggggataacaattcagcatgagatttgggtggggacatggagccaaaccatatcaccaaactcatgtgacttttcagatataagcagtacaatgaatagcaaatatagcagaatatccaattttgttattgcatctatacagcctccaaaatactatgcacttaatacagggcaagtcaagaacaaccactccagtcgtgtacctaggaatccaagccacaccagaaggaatgtctttcaaaggtaccaagttttgacatttgctccaattaaaaaggtttctccggatgctctggaggtattccaaataagtgtc

SEQ ID NO: 599024 - DNA, 123 bp, Homo sapiens
ttatgggagtgaaggtgttgtgtcacttgagcttggcagctctggaaagtggtagatacttcctgaaggccagcgcttgtggagcttggcaggggtcagtgtagtagtgtagcgagccagtgc

SEQ ID NO: 599025 - DNA, 519 bp, Homo sapiens
cccccaccggccaggcctgtcttccccactggtaaacaagggggcgggagacaggggacaagggacagggcgctgagtgcctgggagctggacacacagccacatcgaggggcccgagaaagtcctcacgccccagcaggtgtggcagcagtcagggtgcacgggacctgcccacacaggtgcaggtgaactaggaggtggcgcgtggccatttcctccttttgcaggacagaccaggacgtggctgataacacctgccccggcaagacagggtttctagaaaaacatgctttatggtcagaaaaagtttggagtcattgaagtagcggggtagtgggaacctacacaccggatcccagtatctctggagttttgagggctgctggggacccttgctgtcagaaacatgcctggtgtggacccgtgagcagaaggaaatgtcgtccttactgctgcattctgtcctgtctcctcgggcagctctggaccagatgaagaccactagggtcaggcgtggat

SEQ ID NO: 599026 - DNA, 356 bp, Homo sapiens
gctgcactcctcctcctgcatgctctcaaggcaatggactaccactggattgagaccttgcagagtgatacaaagcgggtgcgaaaggttctctggaccacagcctcccgtcatgacgctatgtcaatcctaaacagagccggattctcaaccccttcttcatggagattgcagctgacaaactgctgagccgctctatgcacctgccacagacgattgagcagaagcccaccacgggcctgttggccatcacgctggcccactatctaagcaccagggctgacagtggacgctttgggtaccgcaacacctactaccagaagcagaccattcactactatgagcagatcacgctc

SEQ ID NO: 599027 - DNA, 244 bp, Homo sapiens
tatattcaccggagcgaggcctgcatctgtggctgtattgataagaacttcatacgttccttctactgtgatcttgtatgaaaaggtaacatcaaatcaaggcatagattcacgtaaccctcagtagtgtccagtatcatgatgtaattcaatccgtactagggaaggttgatgagaccaaagtgggccaacttgtgcacactgcccagactgtggacataggggtatctaccacaatagtagg

SEQ ID NO: 599028 - DNA, 362 bp, Homo sapiens
ccgccagtctcgtgatatctgaacgacactgccactgagcgaggagatcctatgtttaatatggatatgacctgtgactggcttccgaaacccaacatttttgcttcatgcaatgagattgtgcactcctacctccctgtcatcctggacatcattgtaggacaaatgagccgtcctggggaggtgtgctctgctctcctcctctgcgagtctctccagaagctccttgcttagctgaatcaccagaagctgctagtgtcctatctgattccagtagctggaccttattcaggttgtggcccccttcatggccctcatccctctcctcctctatcctctggacggtccccgtctagccccag

SEQ ID NO: 599029 - DNA, 413 bp, Homo sapiens
ggccttatatatcacactattgtagaaagtattatttaatttaaatggatgcaggttgtctactaaagaaagattatatataactatgctaattgttcataatcaacagaaaccaagatagagctacaaactcagctgtacagttcatacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttcaaaaaaaa

SEQ ID NO: 599030 - DNA, 200 bp, Homo sapiens
  misc_feature (5)..(5): n is a, c, g, or t
  misc_feature (123)..(123): n is a, c, g, or t
  misc_feature (152)..(152): n is a, c, g, or t
  misc_feature (177)..(177): n is a, c, g, or t
caccnaaacaaatgtatatagggggaaggtttcacaagcatgtcatagggtcggtaaatatgcagcatttgaaatatacattgacttaaatgcaaatagtcaggctgaagctctctgtaaagnaaggtacacccacaaaaggcaggcctttnctggagccagagaaatgtggttgtntttatattagtggggcagaatta

SEQ ID NO: 599031 - DNA, 1085 bp, Homo sapiens
gcagtggaatcgcttgaacccgggaggcagagttgcatgtgagccgagatggcgccattgcgctcaacgctgggggacacgacgcgagacttctccaaaaaaaaaaggatggtaaaaggcccagtttattttgtgtcccccaagaaccggcaagagaaaaggcttataataggatcagagggatcatagactggcgcacgacagaagagggtaccccttctaaaggggggtcacctcgggcacatttcccacttcccacctttccagggggatatcaaccctctatacaataacctcgtgggcatacgagcccagggacatattttccattccggtgtacacacaccaagggacattattccatacaggctggacctggtactggtaacgacacctaaggggcgcgcggaacaggcggacactgcggcggggcgccctacaaggactcggcgtaacgcacgaaccggcccgacgacgacgaccggtaatctacaagcgaccggcccgcaggacggacgaactaactaaggcaaacgggcacccaatagggtcccacagacagactccatacttgggcccggaggtttattctaccggggtgttatgtacggtatcatataccgcaggggtgttttcacttaaaggttacagcacgacacactcacggtgttcccacgacgatccccacctaccgttcaactacacttaactaacattttcaacatacacgtacggccctcacatcttacgtattccgtgaacaatcctaatactatcttcggtctaaccgggcaagtcacacccttggagcaaaggcgggtgaaacccaacgcgaggccgggtgcttagacctctgcggccttcgacgtttcggaactggtatctggaagcccgcactctcactcttgtgcttcgcgcaaacaacttggaacgagaaggggtctttatcataatacacatacacgcatccctatctgctgcctccgactacccctacaccatgagaatcagcagatcatgctaccacgctacaccagatgcagatcatgcacgcacactgacgtcacgacgagctatgacgatgg

SEQ ID NO: 599032 - DNA, 1633 bp, Homo sapiens
  misc_feature (347)..(347): n is a, c, g, or t
  misc_feature (1309)..(1309): n is a, c, g, or t
gaaaaaaaaaaagcagagatttaccatgtatcagtgccgggcttttggttataaagcttgggttggtctagtgctctttggctataaaatagactgtagtacaccctagtaggaaaaaaaaaaactaaactttaaaaattaaaaaatatatttgggcttattttccggcaggagcaatcctttttataccagtgaattatttacaaaaaaattgtgtcagatttcgtgaattattttctttctttggatagatttttgggaattcatttattgagttaaaagtttgtgttactttattttaaactattttaaaagagtgttattttataccatgtgtgtgtttaccnaaggattgaaactgtgatatgtgggatagcattttatgggttgggtcttcttggattatgggttattggattatagggtatattgggtaataaaagatggataggctcgcaagcggaggaaacatttcttgtggcgacgtggtacaccattagccgtgacagccctcttacaaacactttaaaacacacaactggggtctcacacaacacagcaacaacacacagcgggaaacaaccattttcctcaacacaacagacaataacaacacagaatatgtacaaagcgagttatacaacacctttgtgtatcttacacaagagtgtgtcgtgtggactcaagaaagagtgccctatacgaaaatagttacgaccgagtgtatcacagagagggggggataatcccccgcgaaatttccgggaaacaaaaatgtgttcccaaaaacaagaggcgctttgcatggttgcccgggagaagtctcacccctttttacacagacgaaagtacataacacaggacgcagaaaaccccagcaatgaatcttagtgcgagctcgacaaaggggcgcaccaaattatacaccctatggtgatgtttaaccccccactatagacgtaggaaggaactaaactataccagcaactacgaagacgagactccctaaagtgggcaaccaattattgaaacccgggagttattgtggtaacgaccaatacataatgggtgtggcccccacatgtttctgatagaataaacgaacggttgtggattcattgatgagacaccaccactgttagtgtctctcaacacatagctcaacaattggagggcggattagtgggacccacatattttatgggactcatagtgagaaactactacactccatgatgcggtataggacttaaaaacagcaggccacctatctatgaatatctgacaaattaaacccacagagggtttntatgcgcagggttcttgtacaacagcagatgtacacaaccaccgaagctgatttactaccaacaataaattgcacatcaaaactacatctgttggcaagtggatcgagagcggcacaactagtatgctatctccagcgaaaagaaagtgcccctaatgattaaaacggccacaggcagtacttagtctccaaaccaaaacaggaggcggactcataagaaaatccacagggggccagcagacgtgcgtaccaccggccttttcaacatagtcacctatgtagacgaaatataaagacgcgacgatgctatcatcgcggaataga

SEQ ID NO: 599033 - DNA, 107 bp, Homo sapiens
acatcattcctaagaatcaaacccacaagatgtcaatctgcttttactctacaagaaaacttgctgatttgctgtcttgcttgctctctgtgcacgacaggccaaaa

SEQ ID NO: 599034 - DNA, 175 bp, Homo sapiens
cacccacagcctaattattagcatcatccccctactatttgttaaccaaagtcagacaacaaccctactttaggctggttgcccgcaaccgttgttccgtccggacgcccacgtgaacaacgcccgccgtccgtaagtacgtagactaacctggaactcgcgtaccccgtccaag

SEQ ID NO: 599035 - DNA, 146 bp, Homo sapiens
ttcgacctgttttgttgttttattttcttcttccccaggtgtgaatcaacttcttgggccttgtctctgagttggaaaaggttttagaaaatttgatgagcttgaatttgtgggataataaaaagcttttttgcccaattatttta

SEQ ID NO: 599036 - DNA, 331 bp, Homo sapiens
tgaggacgcagcaggaagaaggatgaaagaagcgcttgcctatacagctctacaatacctttctcggctctctactggaaaatcagtgctaacaacagacggcgcaggtgcatttggtacaagagctatgcagtcagcacatgatagaggagccaaagtgatcacaacagcacgcagccttgaagatgcgcagtgccttgaaagaatcagacctcccatagcacgagtgagtgatgtatctaatgagccagttcatgttgcagaaagctgatagcgagaaacaggtcgcctgataggagatatagctctagatgctgtagtgcgattatat

SEQ ID NO: 599037 - DNA, 251 bp, Homo sapiens
tgatgactctagaggaccccgtctagcctcgacaggcgggccgcagggctaagaacccggggtcttcctctcttgccttgcagcctcttactttctgaactcagctgttttcactccgcctttcaacttactgaaaagggaagcttgcagcggcctggtccagctccccagcctccccgccctgggtgggcccctttggccatccctagctcttacccctcatgcagctccctgcaggggactccacactc

SEQ ID NO: 599038 - DNA, 301 bp, Homo sapiens
cccatttttcccttttttttccccccgccccttgccccagattttttaaggggggggtttccccccccccccccaaaacccttttggggggaaaaatttttttggggggggggtccccgggggttttaaatttttgggaaaaaccccgggcccccccccctaaaggccccggggttcccccccccccgggggggccccctaaaagttttcccccccttccccattttttccttggggggggggggccccttcccccttttttaaaaattttttttttgccccaagaccccggcccggggga

SEQ ID NO: 599039 - DNA, 205 bp, Homo sapiens
acgaggaatacggggatcagtttaagtgacacgtttgcaggaatagtcccttgaatgccgattagtttaattttggaactggatgcacatatataacggctcatgagagaaaaccctggagttacgcatcaaaaacgccgtgcagggaatcgcccttttaccaaatgttgccgtgtcgaccaggtccgcattgttggagcatctt

SEQ ID NO: 599040 - DNA, 1299 bp, Homo sapiens
gcgaaacggcgaagaaagaagctcctgctcccgtcctgatgagtctgaatgactcgagatgcgaatggctttatacggccaagaaaggtaggtgtagaagagaggctgctcgcacgagcctcgacagagacaaggaatcatacgaatcccgtcacgatcactcgcaccgttccggtcgtgcccgaagactactgtcgactccggagaacagcctcaaattattctctcgggaagtagtcgctccgcaggatggaaatcgaagccttgatccaactatgcctatcaatcgaatcgatttccgagcgatgactcagcgtggagagtcctgcctcatgaaagaatgagtaggaagagacgagatccaacacacgtgttgtgttcatttggtgcgagatgttacaaggccgagatctaaagcgactcagacttaagaacaggcatgtcgaacgacacgctgttatgatcattcgattgttggccagaggtccaatcatccactgacttcgtgccctgatggaggagaacgaaggcagtatgattcagacctggcgtcctgcattacggatgctttaggattgttgccagatcaagacagttgggatcactctaaacctgagtccagtcgtgcctaagttctgaatactatagtactatatagtagtcttgatcatgcatagatagccgacatgataattatacaaaaccgagtaactcagagagtacaaagatggggactaagaaagacatgttcatcatgcggtcaacaggtgctaaaaggtactatccaagcagcaccgtgattgctgtacacacacgggagaccaactagcgaacgcacccagaatggaagcacaaaaagtgccagagacccaggaagcgcgataaccccgggaacaacaggcggaccaagggcccacaaccaccaccaccaccagacacaagcgtacacaggggaaactacatataggacaacacaaaccgcacaccccacgacacaacacacgcgcacaataacacgcgacagacgagagacaaacgaagcagaacacggacgcacatccacgacaccagaagcgccacagcacaaaaactccaccaagaccaaactaacatacaacacacgaaccacagcagacactacaacactcccacccatcctatatcaccacaacaaacacaatatcacactataactgattaacacactaccaaaaacacaccacactcacaataacatgatctacaaataaaacaatacaacaaacaactccataccaaaaacaccccccccgcccagac

SEQ ID NO: 599041 - DNA, 393 bp, Homo sapiens
agaagagacaccgataaccactacagaggagcgagacatccccccagacatcttgtaccacacttagccctccactagatcgtgcagaaacacagggaacgggaaagcatgaggaacactctcgggactggaaaaacgtcaacagagatcaggtaatccaatcatcccaaactgagaatctaccgcctaactgatccagctgaagacagccttagcgttcgttctcatctgtataatggggcataatatcttctataaggatgcttacaattctggaataaaataatgcatatgaaagcatctgacatgggtaatgcactcactaaaactgggtgaacctggaaattctgcatttattcaataaatattacgtgaacgtctacaatatactag

SEQ ID NO: 599042 - DNA, 417 bp, Homo sapiens
ccaaatgcccaaaggggtttttattgaaatgaaaatttaattttggttttaaaaaaatggttatccttatttattttgggggaaaataggaaggttttttagaagcccattttcctaacctgataaaatataggtttggttggtagaaaaggtggtccttaaaaatgttaattggtggccccccatggtaataattttgtaagaggcttccaaatggttttacgggggaacccccccccctgaaaaaccaaaatcgggtgctgttttgcttctttttcccccttatttttggattgggggcctttcccatgccaaaaaaggagccaacccctggataggtggagaatttttttaaagaatgagatggttatatattaacccccatttttttttgggaaataaaaagggccccaaaga

SEQ ID NO: 599043 - DNA, 308 bp, Homo sapiens
cctaaaaaaaaaccccctggctaaaaaaatgaaaaccaccccgtttttttttttaagaagatccagtagggccccgcccagtttgaagataaccaaaccaaaaaagctcaatcatttttaccaagtttcgccccatgcaagaattcagtttatagcccccttccccagataagcaaataaaattcccgaaatttgagataacgggctttttcttcatttgccccaaccaaaatatccccaaaaaatggacccatagatccccaattatcagagtttccagagttcaagagggggttcttttgaaatta

SEQ ID NO: 599044 - DNA, 1677 bp, Homo sapiens
cgggggttttgatcttcttccccttcttttcttccccttcttctttccttcctccctccctctctcatttcccttctccttctccctcagtctccacattcaacattgacaagtccattcagaaaagcaagctgcttctggttgggcccagacctgccttgaggagcctgtagagttaaaaaatgaaccccacggatatagcagataccaccctcgatgaaagcatatacagcaattactatctgtatgaaagtatccccaagccttgcaccaaagaaggcatcaaggcatttggggagctcttcctgcccccactgtattccttggtttttgtatttggtctgcttggaaattctgtggtggttctggtcctgttcaaatacaagcggctcaggtccatgactgatgtgtacctgctcaaccttgccatctcggatctgctcttcgtgttttccctccctttttggggctactatgcagcagaccagtgggtttttgggctaggtctgtgcaagatgatttcctggatgtacttggtgggcttttacagtggcatattctttgtcatgctcatgagcattgatagatacctggcgatagtgcacgcggtgttttccttgagggcaaggaccttgacttatggggtcatcaccagtttggctacatggtcagtggctgtgttcgcctcccttcctggctttctgttcagcacttgttatactgagcgcaaccatacctactgcaaaaccaagtactctctcaactccacgacgtggaaggttctcagctccctggaaatcaacattctcggattggtgatccccttagggatcatgctgttttgctactccatgatcatcaggaccttgcagcattgtaaaaatgagaagaagaacaaggcggtgaagatgatctttgccgtggtggtcctcttccttgggttctggacaccttacaacatagtgctcttcctagagaccctggtggagctagaagtccttcaggactgcacctttgaaagatacttggactatgccatccaggccacagaaactctggcttttgttcactgctgccttaatcccatcatctacttttttctgggggagaaatttcgcaagtacatcctacagctcttcaaaacctgcaggggcctttttgtgctctgccaatactgtgggctcctccaaatttactctgctgacacccccagctcatcttacacgcagtccaccatggatcatgatcttcatgatgctctgtaggaaaaatgaaatggtgaaatgcagagtcaatgaacttttccacattcagagcttactttaaaattggtatttttaggtaagagatccctgagccagtgtcaggaggaaggcttacacccacagtggaaagacagcttctcatcctgcaggcagctttttctctcccactagacaagtccagcctggcaagggttcacctgggctgaggcatccttcctcacaccaggcttgcctgcaggcatgagtcagtctgatgagaactctgagcagtgcttgaatgaagttgtaggtaatattgcaaggcaaagactattcccttctaacctgaactgatgggtttctccagagggaattgcagagtactggctgatggagtaaatcgctaccttttgctgtggcaaatgggcccccg

SEQ ID NO: 599045 - DNA, 499 bp, Homo sapiens
  misc_feature (128)..(128): n is a, c, g, or t
  misc_feature (258)..(258): n is a, c, g, or t
aaacgccgccttttccttggggtgtatttgctacttatgtcctatagatttcaggatattcttcagggtataccaaagcccgagagcagtgctgctttctcaatgtgtctttttcttttttgggggcnagggggggggatggagtcttgctctgttgcccaggcggaggttgcagtgagccaagattgcgccattgtacttcagcctgggcaacaagagcaaaactccatctcaaaaaaaaaaaagagaccgggcgcnggtgtcacgcctgtaatcctagcactttgggagccaaggcggggagatcacgaggtcagtagatcgagaccctcccggctaacacggtgaaaccctgtctctactaaaaatacaaaaaactagccgggcgtggtgcgggcgcctgtggtcccagctactcgggaggctgaggcaggagaatggcgtgaacccgggaggcggagcttgcggtgagccgagatcgcgccactgtactccagcc

SEQ ID NO: 599046 - DNA, 215 bp, Homo sapiens
atcacacctttgaacgcgggcgcgggctgttgtttgggaagtgcgaatcgccctcttctcccggatgctgcacgttgacgaacatcgtcttgtagtccggggtgaaggtgatgccggtcagttcgcaggacttcggccccaccatgaaacggcgaatttcgccgctgatcggatcgcccaccagcatctggttgttgccctgcccggcgtaatcg

SEQ ID NO: 599047 - DNA, 760 bp, Homo sapiens
ttacgttctattgcttccttggaagatactacattggtccccaccccctcttgtactccatacactaaatgtgccccctccccactcgttccctcaattaataggcgtacacacgtttttcccgcccacaaattaccaacgtgcttcaccgccctcctttccgtgtgaaaaacccctcgcgggattatactttacgagcagattataaaaacctggcccccacactcatctctgttcgccttctcaactccggcgatggtttgtaaatatataccctaccgaccgttctacttctaataggaaaaaaatgttctctactgttaccactaacacccccctaccttacttcacctgctcccatgttgcggcacgccacctatgaaatccttcgctcccataaaaggaggtttttatattggcgacacacacaaatgcgcgcacacatcctttttgaggttatcctaccttcagaatgatatccttctctcctatgttctttataaaacgcccaccccgcttggctcttaataataacccactcgtcctgtaaaacatgattccacaccactctttgtataatgcattacatgttattgcaaacatatacttcttacatcgagcctgtgtatctctccccacttatggaactattgtcatgtgattgtatatctccccgcgaggcaatttattaacacttctgctatccgccgcagggatttcatcacttcaataatttcatccgcaggtcttccacaatggt

SEQ ID NO: 599048 - DNA, 935 bp, Homo sapiens
ggaaagagctgatgcgtcctcctcgctgggcctaaaccagtccagaccgagaagtgagaggagagggtgaacctccacccaggtgaaagggagggatggaaagaagttcatggggtgttgccatcctagtgcaagcgatgtagtgctgttcaagaaaatgaggcttatgagtactgcgaactggcattctattagatttgacaagaaaggtttttgccgaagtccaggaagactgtgtagcatgttggcaaaggagggaaaagtgcgcaaggaaagtatgctgtgcggaacaggattgacaggagtagaagcgtgtacggcaggagcgccaccgtggaatgaccgttgaagaatattagttccagtgttgctgtggaatttggcgctcctgtattgccgttgagtggtcccggacccgctctagcagcgcatcctggcagcttgcaggactagttgtgtgcggagcagcggagtcgtaccacagccagttgcagtatttgacagccccgttccccagccagaatagagctttgagtttttttgttggatagtggagttagctcgtttccatggcttacaggttgctgaaaagtaaattgtacctgtaaagaaaatcatagcaagctcagcagtccagttggctttttaagaagttctgtagcttccaagtttataagtgaatactttcttagattttaggtaggaggggagcagaggaattatgaactggggtaaacccattttgaatattagcattgccaatatcctgtattcttgttttacagtttggagttagaaagtttaagcatagtaattcttaagtcttttgtctgatttttaaagtagctttcttataaatttggatcatgttatgatttgtaacattcacacaacacctcacttttgaatctataataagacttgcgcgtatgaga

SEQ ID NO: 599049 - DNA, 102 bp, Homo sapiens
  misc_feature (89)..(89): n is a, c, g, or t
  misc_feature (96)..(96): n is a, c, g, or t
ggtgccaggctactcctcccgcagtgtgggtggttccgaggctgactaccctgcggcggagcggatcaaagaaattccctcatggaccnggcttgngaggag

SEQ ID NO: 599050 - DNA, 427 bp, Homo sapiens
cgctgatctagaggatccttaaacaccgcaatctggacctggatagcattattgctgaggtcaaggcccagtatgaggagattgccaaccgcagacggacagaatttgagtcctggtatcagaccaagtatgaggagctgcagcagaactgctggccgggatggagatgaactccgcaacaccaaagcatgagatctctgagatgaaccggatgatccagaggctgagagccgaggattgacaatgtcaaggaaacagtgcgcccaatctgcgagaacgccattgcggatgccgagcaaggtgtggagctggccctcaagggatgcagggaaacaaagctgggcagagcttggaggaggccctgccgaaaaggccaagcaggacattgggccgggctgctagcgtgaataaccaggagctcatgaac

SEQ ID NO: 599051 - DNA, 235 bp, Homo sapiens
acagccatgtatatctgtggaatactcaaggtgtacaccgtttgactacagctgcagaagtgttcctttagcacaaagtagtgacccattttactcgggactaagggcagaaacggttcacattccattattggaagtagttatactccggcgcttaagctagtttagtgcctgggctgaatccagttacatgaaaagcgttttaacgttaggaaaaacaaacaaaaacaaaacc

SEQ ID NO: 599052 - DNA, 271 bp, Homo sapiens
ccccaaggagaagaccggaccaatgaaagaaatcaaccttctcctgacagctcatccgtggttgtatcaggacttatggtggccaccaaatatgaagtggagtgtctatgactcttataggacacttttgacaatgcagacctagctcagggtagttgtcacctactctgcgagagatgtcagtcccacgcaagcaaggggctcgttgtgacagattgctactgatgaccaccccccaagggtaaagacacgtcggcggtatacgtattaa

SEQ ID NO: 599053 - DNA, 217 bp, Homo sapiens
gcatttgaaatcccacataaccattgaagttgcaacaccttagctcatatctaactcctattatcagagagcccagttaaacataactttacatcagtagactcggagctttacgtggatgggagcagcttcaccaatccctgcaaaatgacttttaggaggcaacaaccacttcttcagttagaccagaggttatttggtcacgaatgcttaggat

SEQ ID NO: 599054 - DNA, 188 bp, Homo sapiens
agtgatggatccttacgtgaccagtcgtcctgacggttctgcgcccgggcgctatcagagcccagaataccgcgcgtggtaattatcagtgtaccggcaccggttgtcgacattcggcgatccatctatagtcgggctgctggcttggccgcgggggcctgtgcggcgcgtcagaaggtggtgccagg

SEQ ID NO: 599055 - DNA, 795 bp, Homo sapiens
cctctgtgtggagagagagggtcttccagctggggtgcgcgcagaagtggctcccccccagtgtgtcccctctgctgcccaatggtgtttgccccggcgccccccggcgggccctgtgtatatttttgctgtgggggagccccccccgccttctggtgaatgcgtttttggggacaaaacgcgctgttccggaaaattctgggggccccgaaggggggggacgacaaaacgcccccgggcggccaggctgtgatgtggtcccccaacgcagatgggagaccagcgccaccccagcgggtgaataaatgggaaagatgaaaagaaattttgtgggagccaaaggaaattctggaaaggttatttagttcaagaaagccaggcccttaggaaaatgtgatgaagcccgccgcggaagaaagagcccgggttcaagccatctgaatggagtccagatctcccccttccccctccggggtctctccttctactcatctgtagatactagtagtattccaccgcacctttcagacgagttagacttccggccaccttgagacaaggtgtccctggtcgtccagtttaaccggaacagagaggtgtgaacccacaccatgggagggagaggaggaattaaccgagggaatattaattaatggtctgtaaaccataccactgtggataagattatccaatctgttttagtgtaatgattgtcaacagtttaaaacctttttatatataaactgggatactcatgtccatattctttattaattaaatgtttttcagtgtcca

SEQ ID NO: 599056 - DNA, 252 bp, Homo sapiens
cgggcgcagtcaaggatagtcgctgtatactcttgcttactactcaccacaaagagcatcaagatatatgctctttgttttttttgtttggaaaccaaaactcactctgtcgcccaggcgggagtgcaagggagcaatctgggctcagggaaacctccaccttccaggtccaagtgattctccggcctcggcctcccgagtggctgaaataattgggcattgccccacatacacccgggcataagtttggat

SEQ ID NO: 599057 - DNA, 236 bp, Homo sapiens
tatcatacactatgtggcctttacgtgtctagagtgtctattaccttgaataatgttttcaaggttcatccaagctacagtatatatctactcttcagtcctttttacagctcaaaatattccattgtatgaatatttcacattttgctgatccattcatcagttgatgggcttttggattgtttcttctttattagctgttctgaataatgctgctatatgtgcggtaaaagctt

SEQ ID NO: 599058 - DNA, 829 bp, Homo sapiens
gcggacgcaagatgtgcgacggcgaccatagctctccagtgtcaatgtgccagcaacggaggggtggtcctgagccgtgcggctgtgctgtgcgtgcatgtggtggcagcggcgagacaaatggaaacctcacacagtggcacacgactccactcaagcatggagcaacgcggcagaagcacagtcctgccacagctgtggggctgccctccgcctgaactgcgccgaagcatgcatgtgatgggccccttcatgacagtgcccagagaaagctactgctcattggcatgcaggacgcactcacagaagtggtgctaggctgacagcgagacccaatcggcatgcacccaggcaggcatgcatggctcaacctaagcctggcagtgatggggcacggcagttgacaaattggggccttttggatgatcccttctctctaccctttgcacatctgactgggcggcttcaggctgtgccagctggggctgcttggccaatcattgttgcctgctgttctacgttgtggctcctatgtctacgtattgcagcttggggggcgatggggacaccactcctggccagggcgccttttgcccgcctttgggcccccatctaaagagcgatcgaacattgttcccttgcgcgactcctgtcagccatgtaacgtcacacaggtgcctttgacctttcgatggacgtatgacgcgtccccgtaagtctagcacatgcttggtcttggcagcagatgaactcgggttgatgcctgcggcgcggcagggaaccatcaaaggctgggcagatcccagtcaatcaataggggcaggcccta

SEQ ID NO: 599059 - DNA, 327 bp, Homo sapiens
tttgtctatgtactgttcttatggaatcatgccctgaatgtctgctgccgcatatgcagatgctgctcggggtcttcagtctcacctctccgttgacattgcttccctattggggaattgttccattgggttgtcctatttacacttatgtgtcgtgttaaaataatcatttctctattaatttctccatatacatttccttctgacatttccaattattgtttcccttcagtgcccccaggcttgccagcttggagtgcaaatacctagattccctgagcacccccaaggtatgactgtctcttcagtggagattttacagttgta

SEQ ID NO: 599060 - DNA, 837 bp, Homo sapiens
taaattaggggggaaaaattgggacccttgcccccaaaattccttaaaacttgtgctattaaggcaacttttctggaatattctgggggtgccggccaatgtagaagatgtttacctggagacattatttaacgcgccattgtggggacaacgaagacgacatttattaataaactggctgggtgggaaaaggcctacgctagatcgtcggtgtggtggacaacgtattagatccattttacctgttgtggattttcacacaatgacatttaaacaatgttgtggtgtaagagtggttttataaaagagagaaaaaaatttattctaacaaaagctgtttttcacacacccacatatattagggcgtggtgttaatttaaaacagggaggaagactcttttacaggtgggggcacatcttgtgggcgcacagggggggtagtatcatctccaaccactttatataggagtagaagaacaaaacaaaggtggttttttaaaaaaaagtggtgtggctacgcactacaacatgatgcggcggcacaaaagagggcaacaaaaatatactcaccacgaataaagatgatggttggggcagcctcttttttttaaaacacaacagcaagacggctcattattttgtgggcggcattttttacacaccaccattgttgggtggctgattggttggcgccacccgtccctcacacgaagaagaggttatttgtggcggggggttggtacaaccaccaccgtattatattgtgttggcacatgttttttctcccccaaattaaggagggggggggggagtggttggtcgggatgtcactccttc

SEQ ID NO: 599061 - DNA, 164 bp, Homo sapiens
gcaaagggcaatactgtgtgattccccttacattagaaatattagtagtgtagttgatgatagtagacgaaaaggtatagctgttgctaagggaaagggaggtggggagttattgttctatagggcacagagatattgggagagatagggaaaacttctgtgag

SEQ ID NO: 599062 - DNA, 484 bp, Homo sapiens
  misc_feature (18)..(18): n is a, c, g, or t
ctattccctaagtaccanatattatatagaaggatataggaaagaaccactgaagaaatttgatatttctgttttgacaatagacctacaaagcatgataaattagacctataaactatgataaggaaagaaactgatttctcctttggggggattaggttaaataggtaatggcacattaaagaactagaattggccaggtgcagtgactcatgtctataatcccagcattttgggaggctgaggcaggtgtatcacctgaggtcaaaagttcaagaccagcttggccaatatggtgaaaccccttctctactaaaaatacagaaattatctgggtgtggtggcacgtgcctgtaatcccagctactcgggagctgaggcaggagaatcgctcgaattcaggaggcagaggctaaagtgagctgagatcgtgtgccactgtactccagcctggccaacaagagtgagactctgtctcaaaaag

SEQ ID NO: 599063 - DNA, 586 bp, Homo sapiens
  misc_feature (10)..(11): n is a, c, g, or t
  misc_feature (23)..(23): n is a, c, g, or t
  misc_feature (34)..(34): n is a, c, g, or t
  misc_feature (36)..(36): n is a, c, g, or t
  misc_feature (38)..(38): n is a, c, g, or t
  misc_feature (59)..(59): n is a, c, g, or t
  misc_feature (72)..(72): n is a, c, g, or t
  misc_feature (87)..(87): n is a, c, g, or t
  misc_feature (89)..(89): n is a, c, g, or t
  misc_feature (96)..(96): n is a, c, g, or t
  misc_feature (108)..(108): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (586)..(586): n is a, c, g, or t
tgcttagctnnagcatacgtagngtagtgcactncncncgctgcgcttaggctaggcgngagatatatcggncgtactgcagtcagncnggagtangtatgccttgtngaccgcggtagtctccgcggacagtgcgtcgccccaccagccgtcggctgcngncngtcgtgctgatcttctcactacccgcagtggccgctgtttctccgtcgctcgtcgtgtagtcgtcttgcgtctctgcggcgcgtcgtgcgtatcacgccgccgcacgctgcgggcactcgtgggtgtatactcgccgcacgagaggcgtctacacagtgtacagcgcgcgcgtggcgagagctcgagacacacgcgttggtgtagtcgccctctcagatgcccagagcagcggacatgtgtctctctctctctcacacacgtgtctctgtgagcgcacggacacattacacgtgacacaccctgtagagggtggccacacggccaaggtggagtcattaagagcacggggcccgaggcccgtgtgtagagcgcctcttgtgcgtgggactctgcgcagtggctctacctgttgttggccccn

SEQ ID NO: 599064 - DNA, 168 bp, Homo sapiens
  misc_feature (101)..(101): n is a, c, g, or t
  misc_feature (105)..(105): n is a, c, g, or t
  misc_feature (134)..(134): n is a, c, g, or t
  misc_feature (138)..(138): n is a, c, g, or t
tctcccagctttacacattataaactgaggttcccaaaaggggccaggtgtggtggctcacagctgtaatcctagcacttttggaggccgaggtgggaggntcgnggagttcgaggcaacatggggagactctntctntaccgggaatttaaaaagtagccaggtatg

SEQ ID NO: 599065 - DNA, 113 bp, Homo sapiens
ggaatgctgagattttgcgtagctgtgttaggtttaatccacactcatcgcccttaccacgctactcctacctatctccccacactcatcgccctcagcattcctcgcaacag

SEQ ID NO: 599066 - DNA, 484 bp, Homo sapiens
agcggggttgcttcctcctcttccctccttcctctcctagtttcttccctcccttcccgcctactcctccctccccacacccgggccgtgccaccagtcaggccgacggagaagacacctcaggagaacccacaagaacagagggacggaaaccatagaacacgaatgacgccacaaacatctactgctaaaacagagttaccccacgaaaaggacaaccacgacgcgaacgaacctagctgagcatcgcgcaggagcaccgacccaagagacaacgaatggcagctcataccatatcctcatagaacaggctcgaccgagcaacagcgaagaccctgacgacacgtgctcgactcgcgagcaccacaacagcggaatgcaacatgctgccacacaacacccaaacaccatacacagccaacatcgacaaggatgatcccacctacaaaaaagcgcgtgcaaccaacaccatcaatgaccaacc

SEQ ID NO: 599067 - DNA, 1381 bp, Homo sapiens
atgtcctggtgatattactcgtttctcgcgggtgtttcttgtcccccagaaatgtcatggcgcgagaattcttcgaaggggggaatttgtcccccaaggtggtgaactgagagctaacggattgtggaggatttccacacaggctcttgagaggtattcttcaccgtgatgggggagccttatttgtgagtaaactcccccccttgtataatggtaattatattgtttaaagggggggtccccgagcggcctaaagtttcttttcgtaaaagaatggggggcgacccaagggttcgccaaaaggatgaggtagaattgaaagggcgtacaggtttataaggggtgtataaaagattttgggggaatagagaagaattgttcgctccatacgccccccctttctataggggggggctacaaatgccaaggccgccagcaaggtttgggtgctcttctctcatagggcatcaggctattagtggcgagaggagtagcttctttccaaaggagggccccaaaaaagagggtgttttgtgggtgtctcaacagtggaagttggaagagggcttctcttttttcgcggggaagagagtagagtcctcacaaggagcgcccactatatattgtatatagataggggagagtgagagggagagtcggaatgggactcttttctctgagaaagataaagagaagagatctgttatgccgcccacgtgatatgttccccccccccccaagagcgctctcagagagagggagatcctcaagcgcgctctaacgagagtctctcgaaattggagaggtgatagaaacccgggagggggaaagggtgtctctctcttttgcgcgcgtttggccccttttgtctaacacctctcctctcggatctttctcccaccccactaatattttggggtgaaccacgtgtttttttctccttccacttgagaaagcacgtgtcccctgcgggagtttcttgtgcgcactttttgagaacacaggcttcttccttgtttgtgtgtgtttgaatgtgcacattaagggcacattgggggaaaacgcttctttaatctctttgcgttgcttttcccacaaggagttgggcttgtgttataaaatatgttggggaagaaatataagggttgggagaggcacagggcacatatgcacggagtcccaaatcctcaattttatctttctccgagccttaaaggagatgtatagctgctggttgtcctgttcaaggttgctggagaacacaggggtcaatgttgaaggccaaggcctgtaagctctctatacctggggcctatttttactttcattttgtatttttggttctttgaaaatgatttaataaagggaactgactttggga

SEQ ID NO: 599068 - DNA, 960 bp, Homo sapiens
  misc_feature (5)..(5): n is a, c, g, or t
  misc_feature (184)..(184): n is a, c, g, or t
  misc_feature (241)..(241): n is a, c, g, or t
  misc_feature (294)..(294): n is a, c, g, or t
  misc_feature (448)..(448): n is a, c, g, or t
  misc_feature (551)..(551): n is a, c, g, or t
  misc_feature (567)..(567): n is a, c, g, or t
  misc_feature (579)..(579): n is a, c, g, or t
  misc_feature (611)..(611): n is a, c, g, or t
  misc_feature (642)..(642): n is a, c, g, or t
  misc_feature (650)..(650): n is a, c, g, or t
  misc_feature (656)..(656): n is a, c, g, or t
  misc_feature (683)..(683): n is a, c, g, or t
  misc_feature (711)..(711): n is a, c, g, or t
  misc_feature (767)..(767): n is a, c, g, or t
  misc_feature (777)..(777): n is a, c, g, or t
  misc_feature (806)..(806): n is a, c, g, or t
  misc_feature (829)..(829): n is a, c, g, or t
  misc_feature (894)..(894): n is a, c, g, or t
  misc_feature (955)..(955): n is a, c, g, or t
atganatatacaataataataacaacaatgacaacaataataatggtaccttagaagctttaaaaagaaaaatacactattttataccaggtctcaaggaacttgttagtttttggctttggctccagggtcagatgtttttccagctcaaagctgtaaatggaacgtaactttcgcaccagtngaatatctttgtttggctgagttatctctgagcggacacgaattggtgacccaaggnttggagcattgagaagaccatttgcctggccatggctgttctcctcttcagtngcagcgttacaaataccaagctttatcttgtttttgttggcatccatcttttcccaaacatccttctgctggggacgggggtgttccagagatccaggcaatttatctggtgaaagaacaacagggatgccattttctccatcgctaagctgtncatctggaaatacctcatctgttttttctcgaagcaagtgttcagggatgggagtggcattggcaataccaattgcagcaggggtgaagcgagtgttcaactnaggggtggtagaagtngtggtggttgtnagggagccatcatttccagtcttctccaagtnaaaaaaaaaaaaaaaaataactccaaaagtnttgatgcnattgtnaaacacggatgtgagaagctggtagtntggttttgtaaaataatccaaagaaganatatggtctagaaagatgctgaattctggagggagaagtttcaacatgagcctgtngtcatatctnttcttaatagagcctacttgctccttgtnctttatttttctccagggcagcngatcaaccacaaactccaccaacatgtagaataaaggaccaaaggtcatcatgttttcccatttncctgttccgatgtgcgttgattgaagcataaagaactgttccttggaaacctgccaaaacncgagg

SEQ ID NO: 599069 - DNA, 154 bp, Homo sapiens
tctgtgtcaggttttgttgatgttggggtgtgttctgtgtgcaggttttgttgcagcatgttggggtgcgtgtgctgtgtgaggttttgttgatgttgaggtgtgtgtgccgtgtgaggttttgttgagctgttgggttgtgcctgccggcatt

SEQ ID NO: 599070 - DNA, 262 bp, Homo sapiens
aatcatgtcggtaccgaatacgctcctagacggggagtccacggcgttggtcgtagggcgcctggtcaccaggtctgcttttaactctggtaaagtggatattgttgccagtcaatgagcccttcattgagcctcaagctacatgtgtttacattgttccaatgatgattccacgccagtggcaaaattccatggtcaccggtcaatggcgtgagaacgcggaagctctgtcatcatatggcaaatccctatcacgcatctt

SEQ ID NO: 599071 - DNA, 165 bp, Homo sapiens
catgtctggctaatttttttgtctttctgtacagcagggttccgtgttagccaggctggtctcgctctcctgacctcgtggtccgcccacctcggcctcccaccgtgctgtgattccaggatcggttcccaccctgtatgcctaacagacttttctggggctcct

SEQ ID NO: 599072 - DNA, 672 bp, Homo sapiens
aagagaatatcaaacatagatttctggaagtatttgccaaccttctggttgagctgcaagaaaatatttatggtgagaacttttctgtatcccgttatagggtttttggttggttttggtttgttcatttactatagctatggtctagtaaacaatatgcaactgtaactacacttcagcaaggacaatattgtctatcatagacatcattatcatgacagtatggtacgataagttcatgatgaaggaaaacaaaattctttgcaacttcttttatagccatatagtatgtatttcatgtgttgttattccctgtgatgaaacatatcagctattacagtagaacagcatatatattcaagtagtttagactatattaaccatgttcttgtacctcgtatttatacatatgctgtattctggaaagtactgcctttactacgggaacgctataattcgatacatagtgaaacaagggaatggtgaccccttgtgcctcttccactgaggataacaacacagcattgtaatccattctcttgcaccttctatcttcttatctcgtcattacggtttcattaatttgtacgagggacagggagtgggcaaggggaagaagcagcttattgactaaccagcccctctgtggtccaccagcgtcttggcttggga

SEQ ID NO: 599073 - DNA, 723 bp, Homo sapiens
  misc_feature (45)..(45): n is a, c, g, or t
  misc_feature (78)..(78): n is a, c, g, or t
  misc_feature (89)..(89): n is a, c, g, or t
  misc_feature (93)..(93): n is a, c, g, or t
  misc_feature (105)..(105): n is a, c, g, or t
  misc_feature (109)..(109): n is a, c, g, or t
  misc_feature (111)..(111): n is a, c, g, or t
  misc_feature (115)..(115): n is a, c, g, or t
  misc_feature (123)..(123): n is a, c, g, or t
  misc_feature (135)..(135): n is a, c, g, or t
  misc_feature (142)..(143): n is a, c, g, or t
  misc_feature (149)..(149): n is a, c, g, or t
  misc_feature (175)..(176): n is a, c, g, or t
  misc_feature (183)..(183): n is a, c, g, or t
  misc_feature (201)..(201): n is a, c, g, or t
  misc_feature (221)..(221): n is a, c, g, or t
  misc_feature (229)..(229): n is a, c, g, or t
  misc_feature (236)..(236): n is a, c, g, or t
  misc_feature (257)..(257): n is a, c, g, or t
  misc_feature (304)..(304): n is a, c, g, or t
  misc_feature (313)..(313): n is a, c, g, or t
  misc_feature (317)..(317): n is a, c, g, or t
  misc_feature (355)..(356): n is a, c, g, or t
  misc_feature (391)..(391): n is a, c, g, or t
  misc_feature (431)..(431): n is a, c, g, or t
  misc_feature (533)..(533): n is a, c, g, or t
  misc_feature (575)..(575): n is a, c, g, or t
  misc_feature (655)..(655): n is a, c, g, or t
  misc_feature (721)..(721): n is a, c, g, or t
acccacccacctcaaaccctggaggcagcagcataagccccagtntccactatggtgtctcctcaatgaccagaatanccgcaagtacnaggngtcagcaattcnattntntctntccggatnaaaaaagaagcngtgatgnncctgtnagaaagcactgcctgcaggtcaaaanntggaagnggctctcccaggccaggngacaacccttcaggtgcagngggggaanaaaaggnttaacctgtgataatcccaanaccttctgaaaaaagagtaacagtcatccagcaaggggccatgggtnggggggggnggtnggggggacactgtcccctgcctcagcatgtcctgtttnntgggtgggcacagatataggctcgcttctcaaggntctgctgggacactttcttaatctgctcatctaggttttntggagcatacttgtccagctgagagaggctgaagagattctgcaagttagcttccacgcagaaggtgttggccaagagaacctcgtggtcgtggttgcgganccaatgcggatggagcggctggcccgcgacagcacggccgtnatgccatacaggttgatgaggatgttggccacccgcttcagtaccagctgctcctccatgatggtcttgccaaagcgganaggcagtgtctccacggtccggccgaagcagtaggtgttctcctcaaacttgttggcactgtccgnag

SEQ ID NO: 599074 - DNA, 795 bp, Homo sapiens
  misc_feature (789)..(789): n is a, c, g, or t
ggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcactaccaggcctgccttacaagagctccagaaggcagcactaaacacataaaggaaaaaccagtaccaagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacggtgcaaagacacacatagggctcaaaataaagggatggagggaatatttaccaagcaaaatgggaaagggaaaggaaaaaaaagcaagggggttgcaatcctaaggtctcctcattanagcagg

SEQ ID NO: 599075 - DNA, 887 bp, Homo sapiens
  misc_feature (26)..(26): n is a, c, g, or t
  misc_feature (75)..(75): n is a, c, g, or t
  misc_feature (82)..(82): n is a, c, g, or t
  misc_feature (99)..(99): n is a, c, g, or t
  misc_feature (106)..(106): n is a, c, g, or t
  misc_feature (112)..(112): n is a, c, g, or t
  misc_feature (129)..(129): n is a, c, g, or t
  misc_feature (131)..(131): n is a, c, g, or t
  misc_feature (137)..(137): n is a, c, g, or t
  misc_feature (140)..(140): n is a, c, g, or t
  misc_feature (149)..(149): n is a, c, g, or t
  misc_feature (158)..(158): n is a, c, g, or t
  misc_feature (161)..(161): n is a, c, g, or t
  misc_feature (174)..(174): n is a, c, g, or t
  misc_feature (180)..(180): n is a, c, g, or t
  misc_feature (186)..(188): n is a, c, g, or t
  misc_feature (203)..(203): n is a, c, g, or t
  misc_feature (211)..(211): n is a, c, g, or t
  misc_feature (238)..(238): n is a, c, g, or t
  misc_feature (250)..(250): n is a, c, g, or t
  misc_feature (297)..(297): n is a, c, g, or t
  misc_feature (303)..(303): n is a, c, g, or t
  misc_feature (395)..(395): n is a, c, g, or t
  misc_feature (458)..(458): n is a, c, g, or t
  misc_feature (635)..(635): n is a, c, g, or t
  misc_feature (759)..(759): n is a, c, g, or t
  misc_feature (787)..(787): n is a, c, g, or t
  misc_feature (872)..(872): n is a, c, g, or t
actcttgcaaatggtaaataccagtnataattacaatgacgtaaacttggatgtctgacagcttgaccatccggnggaactngagtggcagcgggaccncccaggngagggnaacaccaaacgcttggntngcaacngtncggccgagnggcgattgnggnttagtctatgagngatggngcgggnnngcgggggtgcaccantgggggcntgcagctaagaggctgggagcgtgggnggaaatgaaganggcagtcctggcctggggcagggagaggaaaccccagactagctggngagcgngggaagatttgtcacgatcacagtgcagacgcaaagtgggcatgggacctgtggactgtgtgggaaatttatgccagggaggatcacgaggnggctgcggctgcggccctggggaccaaagaggaacagagcaaggcaaaagcagggagagaggngggaggagatttgagcgcagatcttaattcaagtgtaactggtggtgcgagaagattctagagagaggggaaaggaggatgtggggtttggtcttctcatcaaatagctaggccatttcctccagacaggggccttggggcactgccttggtctggtgggcaagtttttgggcagtntggggctgctggctttcctgcccaagggaaggaagggcatgcctgcagagggctaggatggaagggccctttggcttcttactggcagtgggctttgctcttgtcccaccagtggactgcagcnatgggaagtgacctgaagcagttgagcngaggaacagaatcagggcggtgagcagatgcagctaagggctgaaattcgcaggctagaggtgatctgaggggatgtggaccccncttcctttacaaagg

SEQ ID NO: 599076 - DNA, 1730 bp, Homo sapiens
gctccctccctccttcctctactcccaccccatcccatgtccccccattacctcaacatccatttttaacagagacgcagactgactttggaaagggagagcgctaggggtataagaaccatcaccgactgctaatctaaccccatgggaccacctcacccggaggaatacctcatctgaccaatacactgacagagggtcatacggaccccatacagcgcacagcctccgacacatactaaaaaacccacaacacgacccgtgatagtatcaacacactaagaggacatcacgacaacgccgagacaacacgcagatcgaccccctacataccacatgacccaaagaaggcagaggaaaatcgaatcacacaccaagcaaacagacacacgacgaggaggacgaccacacaaacgccaccaaagatcgataacaacacatcccacagaacgagaacgaatcagccaccacgcaccaaccacccccgtggaagagaaagcacatatcgtacaggacagaaagcaaaactgccccgacacccggactcacccaggcgccctatacacacgattcacagacatcgcaagcacgggatgagacaggggagcaaacataccaccgatgcgccgaaacaacaagcggggcaacccaaagaacgacgaacgaggaccaaacaggtacgcaccacccacaaacgcaccccacgagggacacccccgcaccaggacatagcacaaaggaggccataccaaaggcacatggacagcggaaagagaacagacggaggcccacgacccgacccgaatacatgagacgaaatcaaaacgaacacaaacagcgaagcacaataccagaggcaccgtaacaccccgcagcgaatccccatgcgaagagccggaaccaccaacatcccacgcatccacaagagcccatatacagcagcgaagcaagcaacaggacgaggaacacccaagtgtcaaccacacgcgtaactagcgaccagcgcagaagcatgtaacccgatgagcaaatgaaaatggatggacaatgatacgtgaggacagtacccatccggagcgaaacaatcacgaaaaacacaaatgacatgggagccgcaaggtacgccggcaaactgatgagaaggacagccaaagacacaacacgaaggatagcacacaacgcagacgcaagaaaacatatatggaccgcaccaccatgtctgacgaatgatccagacggattgattacaaacaccaaaaacaagccagacgggagcgaaggacggataacacagcaagaagcccccgcgagacgcataggacagagccaccaccccagccagcacgtagcgcatcgcttcagcggaggcgacacacgcagaaaaacagaaccaacagaagcgggcacgacgcgaccgcgaaaacggccccaacgccactactacaacaccctggacacagcgacagcgacatgcaccgcaatgacagaccacacacaccatccagaacaaacacaactcaaaccacacaacgccgccagaggacaaaccaaacgcagcaccaagacaacacgcgaacgagcagcaaaacaaccaaagggtgaaatagaaggagagcataagaacagcaacacatagcccaacaagacgcaacagatgaccacacgactaacgtgcaaaagataggagagacaacaggaggcgaacccaaacagagaaaaagaaaatacat

SEQ ID NO: 599077 - DNA, 273 bp, Homo sapiens
  misc_feature (17)..(17): n is a, c, g, or t
  misc_feature (106)..(106): n is a, c, g, or t
  misc_feature (138)..(138): n is a, c, g, or t
  misc_feature (149)..(149): n is a, c, g, or t
  misc_feature (154)..(154): n is a, c, g, or t
  misc_feature (222)..(222): n is a, c, g, or t
  misc_feature (244)..(244): n is a, c, g, or t
tatttctacagagcgcngtttcaggaactaaataaatgaaaaccataaaggggagaccctgctacaactcgatgcctggcacgcgtacatgggcaggtggtagcgnttatagtgcaggtagtcaagagtgcttctctncaccaggggtntgtanatggattccttactcttttgaggtattgcctgggcttctttagtcgggttgatttcctcacttctatntgatgggctaactgctctatgnaaggaagaactttcctcctccttggggct

SEQ ID NO: 599078 - DNA, 353 bp, Homo sapiens
  misc_feature (9)..(9): n is a, c, g, or t
  misc_feature (353)..(353): n is a, c, g, or t
tctcctggnaactgtgacacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttan

SEQ ID NO: 599079 - DNA, 332 bp, Homo sapiens
gagctcggccctagttaggtgatggagtgacagctacaggggtggttgttagttctttctgaggggtgaaattttaaactagcggtggtcagggcaatgcctacttgaaactagtgacatttcagtgaagacttgaggaagtgagggaacaaagtattcagaatcaaagggaagaatattctagccagaggaagcaacaagtattacacaaagtcttgaggcagatgcatgcctggtgaactcacagaagaacaaggagatcagtcctgtcctggctgtcactcactcgcttgcccactgatctcttccacatcactccttcacccaagcta

SEQ ID NO: 599080 - DNA, 237 bp, Homo sapiens
ttcctaataacgatcatcctggtccacatggatgtcgctgatcactcatctcgtggagcgccatgatagctgcgccttacgcgccacggggcacttgatccggttaatgacgaaatcccggaattcctgcgatttgcggtcgaaggcgcggacgagccagcgcaagccgttgtcgatcaaggcgaacgggacgatctcccgctcggtgcgaccactggagatggagcagtattcaat

SEQ ID NO: 599081 - DNA, 372 bp, Homo sapiens
  misc_feature (46)..(46): n is a, c, g, or t
  misc_feature (58)..(58): n is a, c, g, or t
  misc_feature (100)..(100): n is a, c, g, or t
  misc_feature (200)..(200): n is a, c, g, or t
  misc_feature (203)..(203): n is a, c, g, or t
  misc_feature (329)..(329): n is a, c, g, or t
  misc_feature (333)..(333): n is a, c, g, or t
aagttcgattcgacgcagacgttggtagcgatgccggtgaaaaccnagatggcgtatntccgcggtgcgcaaaatgctgtccagcggcgtattgaagaanacgctgtagcgcggcttcggcagcacaatattcgccaggctgcggcaccagttcatccaccagttgataatcccaggagcctttcgccagcaatttcccnctnagctgcgggctttacgcatggttttcagggcgttcgatttatgaaaattcggtgagccgggtccgccagcctcgacatactgttcatcccagccattttgaaaccagatgatcagcaatcccatgncctncgctgcggtcacggcggtttgaatgttggcaattgaccg

SEQ ID NO: 599082 - DNA, 164 bp, Homo sapiens
  misc_feature (15)..(15): n is a, c, g, or t
  misc_feature (71)..(71): n is a, c, g, or t
  misc_feature (133)..(133): n is a, c, g, or t
agcaccatgagatantacaatagtttaagaccctaaattgtaaatgcatattagtggtaatttactgcagncagccataggacactgacacagaaatgtttataagaaatcaccactaaagaaattattcatncaaccaaacaccgtctgttcctcaaaaacct

SEQ ID NO: 599083 - DNA, 922 bp, Homo sapiens
  misc_feature (8)..(8): n is a, c, g, or t
  misc_feature (250)..(250): n is a, c, g, or t
  misc_feature (321)..(321): n is a, c, g, or t
  misc_feature (353)..(353): n is a, c, g, or t
  misc_feature (381)..(381): n is a, c, g, or t
  misc_feature (384)..(384): n is a, c, g, or t
  misc_feature (404)..(404): n is a, c, g, or t
agcggctncctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactntaagcgccgttctccctgtcagtgccccgcatgagaccatgaagaatccttggctgaatcacggagcaatncaaccagctccacaaacggggaatgagaactngcagctcggtcctctggcagagaccccncgnaggagtgcagcaccttctcnccaacagacagcggggaggagccggggcagcatctcacactggcgtgcagttccagctggcaggcagaaccagaagccgctatctccatggagcgtgagggccatctggagctctgaccccgggaaggtgggacaggatgcacgcacaaggggtgtgcacagggagggcagcatgccttaacagccagactttgacagctcagcaagaggctctctcatgcacatggatatccgcctgccccaaggaattccttacagaagctacagatggcgagccccagatctggcccaaggccggctcagaccgcatgtcccgaccggagctccctgtacagacatttggctttgggaaactggaaacatacgtgaaacttggacaaaaggggaagaggggcacccataatgccacaggcgttcaaagggagcagaaaactggacggagaaccaagtaggcccagaaaagagatccgggctgaagcacgaggaggaagcgcccagcaacggcacaccgaaaggag

SEQ ID NO: 599084 - DNA, 215 bp, Homo sapiens
  misc_feature (19)..(19): n is a, c, g, or t
  misc_feature (36)..(36): n is a, c, g, or t
  misc_feature (116)..(116): n is a, c, g, or t
  misc_feature (130)..(130): n is a, c, g, or t
  misc_feature (134)..(134): n is a, c, g, or t
ggcggcaaaccaaacaaanccagagtcatctggggnaaagtgactcgggcccatggaaacagtggcatggcgtgccaaattccgaagcaatcttcctgctaaggccattggacacngatccgagtgatgntgtncccctcaaggaaaactaacgaaaaatcaataaataaatgtggatttgtgctcttgtaaagtggattaaaaaacttactacc

SEQ ID NO: 599085 - DNA, 572 bp, Homo sapiens
  misc_feature (8)..(8): n is a, c, g, or t
agcggctncctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagggggcaccgcggcgccgggtataacggagccacaggtaagcggaacggctcttaacgcgcgcagttcttgctcttgccctgacggcgagaggtcggagggaaataccggacgcggccgaggggacgagcagagatcacgaggcgtgatctgtgtgatactgtgttgtgtgttgaggggtggggggtgccctcgaaaggccactcgtaagcttccaggtgcttgagagcggagggtcatttctgcaatctcagaccccgcgcccccttagggagtctccatctgggatcactttggcccctgggctcccgtctgaacccta

SEQ ID NO: 599086 - DNA, 1000 bp, Homo sapiens
  misc_feature (8)..(8): n is a, c, g, or t
  misc_feature (328)..(328): n is a, c, g, or t
  misc_feature (399)..(399): n is a, c, g, or t
  misc_feature (431)..(431): n is a, c, g, or t
  misc_feature (459)..(459): n is a, c, g, or t
  misc_feature (462)..(462): n is a, c, g, or t
  misc_feature (482)..(482): n is a, c, g, or t
agcggctncctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagggggcaccgcggcgccgggtataacggagcacccggctgcccagtccctcatgatcatgaacaagatgaagaactntaagcgccgttctccctgtcagtgccccgcatgagaccatgaagaatccttggctgaatcacggagcaatncaaccagctccacaaacggggaatgagaactngcagctcggtcctctggcagagaccccncgnaggagtgcagcaccttctcnccaacagacagcggggaggagccggggcagcatctcacactggcgtgcagttccagctggcaggcagaaccagaagccgctatctccatggagcgtgagggccatctggagctctgaccccgggaaggtgggacaggatgcacgcacaaggggtgtgcacagggagggcagcatgccttaacagccagactttgacagctcagcaagaggctctctcatgcacatggatatccgcctgccccaaggaattccttacagaagctacagatggcgagccccagatctggcccaaggccggctcagaccgcatgtcccgaccggagctccctgtacagacatttggctttgggaaactggaaacatacgtgaaacttggacaaaaggggaagaggggcacccataatgccacaggcgttcaaagggagcagaaaactggacggagaaccaagtaggcccagaaaagagatccgggctgaagcacgaggaggaagcgcccagcaacggcacaccgaaaggag

SEQ ID NO: 599087 - DNA, 2042 bp, Homo sapiens
  misc_feature (401)..(401): n is a, c, g, or t
tgttgactgctttcatctgtacaagaagggcataaagtttaaaaaacagtaaagagaaacaagcatgactattatgatcgcacggaaaactggaagtggtcaggaaatgttgttgaaaccacgagtggatcatgtgtacacgacgtatgcttacaagtgttgagaacaatatcgcttggtaaccaatgcacaaagtgggaagacatcgatagagtattgaactgctgatgatacgcatatctccacagcactacgcaacaccgctggcgcacccaccgaacacgcttacactacgatgggtatccacacacattacacactcctagaataacccaggctcaacacctcgtagattcggacacaccgacattgatacaccaacactgccacaactgcccttnacacagtggataccaactacgaggcttataaatgaggccacggcacactttgatatataaacggcaaatgatataaatagaccgtggaaaaatgctagcgtgctatatatcacgcaaagagcggttcgccaccacaacaaacatgcgtgggacaaaaccacaataagtccacaccaaacgctgggccccattattatcctccaaatacaccgacaacagacaataatatattgagcatcgatagaaactgtatccagcaatatctaccagctaagaataatcacgaacaaaacaagcagataataccagggacacacacagaccacgcctacaacccaacaaaccaatcccccgggcaggacacacacaaagaaacaagcgcgacaaagctagtcgccccacacacgagggccacgcactccaccccaccacgtggactcacaacgacggactacacacacaacgacacgatcacacgccacacagaacaacagatcagacgggcagcagtacacacacagacgagacaagcacgagagaagcgcagcccacacaccaaagacaagacgaaagcaaaacgcggaccaagcagcaaccacacacgaaaaagctaccacaacagaagtatcacacacccaaccaccaccacaagccaccaccacaaggcagacgatccgaccaaccgaagacacccaagtacaagatccacgccgcgacgacaaagcaagggacgtgtatctaaagcagagcgcacccacaaccaacgcagacctcccgaggggaaccgaggcggaacaggcaataagagcgacacgcagggagtacatcaccaccacgagggcaatcaaaaaaagctcaagcaacgaaagaaccaacagacaatgtaacaaacacgacacagacacacaaacacacgacacacacaaaccagacaggactggacgcccacacgagacgcagcgccgaccgcacgcacgagacgagcgcgaccaaggcgggccaacacgcaagacacacaaacccgaacagaaagaccaagagaatcgagagaagaagcaggaaccaacaacgcaggaggtccgcagcaaacaacaaaagcagacgagcaggcagatacgcagcgacacgacaagatcaagaacacgcgcgagcgacaaacagaacgaaacgaaaacgatcagacgaagcgacccacaggcagtataagaacagcagacagacaaccagcctagatcagcacgctgactgcgacgaggccacgacacacgcgcgacagcgcaaactgcagcgacagatcagcgatcaaaaacacgacccaaaactcacatagcggacccactccacccacacactcccagagctctacacacaacaataggaaggacaaacacaagatgccaacaatacatccgaccaactaatcaagacacactcacactacactactaagacgcactactcaaagacaccccaccacccgcatgatcatacaacacactactcacactccagatcactacactgatacactatcagcatcagacacaatcaatactaaataaccataataaagactaacacgccacaatgctgcatcaaatctcttatttcttttatttattttatcttatctataccacg

SEQ ID NO: 599088 - DNA, 130 bp, Homo sapiens
atctaagatcctcattaactcatacaatcgtcgagtatttacgtacataattgaaagtacaggtcagctggtttcaattatgtctaaacagaaatgggacaaatagacttgaaaaatagaagggatttat

SEQ ID NO: 599089 - DNA, 721 bp, Homo sapiens
atatttactttttatggaattggtaatgttacagaattctggcatggccaaaccattgcctgagaaattcaaacaaagggtacaagggagccagcctcatccaacccatcatacgaagtatattaaaactgtgattcatgttatatttggagttatttccacaatcttttaaaaagttatacccaagagttgtaattataacatcttgcggcgggctctccagatttcgagtacaagtatgcctttacataacagcctccacttactcatctgttcatctcttcagtaacataacccccaacaaaatttggtggggaaaaaatgctgggaaaagtgcagagttcaacgatgaagagattttcttaaaggtttttcattcccaataaaagtcttcagttgtaccaagaatcccatttctgatttaatcattcaaccttccctgggcgggctcagttactcacccaataattttttcagaaggcaaggcatcctgcctgccacctcaagtgtcaactattggcccagatgcgagtggcaggccccgtcagggagatcctggtaaccctcctcggagtccaattccgtgccgcggacacttctcgtcagattaaactcctattctgaaaagcgctcccatcgtcaaagagtagcttttactcacccacttggcttcactctgtgcctgttgcaagttctgcacactcatgccttggggcacggg

SEQ ID NO: 599090 - DNA, 322 bp, Homo sapiens
tgtgggtagcacaactagggtcagtttagcaggtggtaaagtccatttaccaagatagattgtaggtaaagaagggcagatttactagagaaattatgaaaatatgttgcagtgggcagctcagcagagaaggggctacctgcaaagaggcaggggctggaggaaagttttatagggtcctgctgaagggtgctacgtgtggaatgaggtcattgtgcccgcaggttgttagtgattagctgtctctaacaattgttcatacagtaattgttcattattgttctcaacttggggctctccccaacctggggacccttcctta

SEQ ID NO: 599091 - DNA, 448 bp, Homo sapiens
  misc_feature (59)..(60): n is a, c, g, or t
ttatatttcaaaatgatattatggtaacccaattgtaagcacagcattaacctgtcatnnaaccctaatatacataaggatgtggatgttattggaaatccattaaagccaatccactttcatttcaagttggatacctactattgattcatgtggattcttatcctgaattaattttggtaagagcgaaacaatgttattaggatgaaaactcctctcaaatctttgtaagttgactaaacctttttgtgtgtttaaaatagttgtattaataccttgaatggctccaaacattcatgttcatagaaatattttgcatatattctttctggtcacctattttttttattgtctcttgtgcaggactttttattttaatttttaaatagacattttaaagtaatgtagcaaaaaatcagtaatgataaccgtaggtatatatatgcct

SEQ ID NO: 599092 - DNA, 205 bp, Homo sapiens
tattgcggcaccaaaataaggaaccctggcttgatgtggtgcctgcatgacctctgccctctggcattagccagaaggagtagtgccatatagtgatggttaacaccaggcctcaccctggctggctggagggagtgcccagctggccggtgagatcttgtctcagcctcagctagatggatggataagaggatgagctgttctg

SEQ ID NO: 599093 - DNA, 180 bp, Homo sapiens
aggatcctggacgaggccatgatcctgaactaactcgtaaggcttgtctggttttaggacaggtaaaatgggggaattgtaaggagcagtttataggctttaaaaggccatgctgtagccaggtgcagtgcataacaggctttaatctattttaaagcggtgtcgatgaggtaccgcagc

SEQ ID NO: 599094 - DNA, 199 bp, Homo sapiens
tccgagctgtatacctgaacattcgtgtcccagagccttaactttgagaggactctatcctccttcagtttctggggttacatgagggaaacaggggtttttcctagaatggggtctgtgacgcctcctctgtttttccccaggagtcccaggctgttagtaattatcttaggttctctcatgtggacacgaatgttca

SEQ ID NO: 599095 - DNA, 434 bp, Homo sapiens
cattattagaggtgaagagggtttgggagaggtattaaagttcaccaggggaattgtgacaattaatgagctttgagccccactgccttaaatgatacctgcacgtggaaggccagggaagatcaggaaccagtgaaagagagttctgataagaccacgtccagtgtaagttagggaggaagggcactcgaggaaggaagacgtggttctccaccattcctctcctgagaaagagagctttatagtcatattgtgggcgaaattcatatcttgcactaagaaaagttcaattggagtcctagctctctcactgataatccgtgtgacattggacaggccactttacttccctggatgtccttctttcactaggtctgatgctgattctcctgcccccctcacagggcagtgatgtggaaccaagtgagacattg

SEQ ID NO: 599096 - DNA, 219 bp, Homo sapiens
agaatagaacacttcaatttagaagagctcctaattgatcaactacaattaaggggggaggtattttgaggtaaaagggggtagggtaaggaagccttttaggcgggagaagaattataaaagttttgaaaagggttccttggttgggcttgccctccattaactctcttgaactcgaggagacaaacacgtgtgcctcgtgcatgacaaacactcata

SEQ ID NO: 599097 - DNA, 226 bp, Homo sapiens
gggtatggggtatagaggaaatttctgaggcataggaagaatggagtagtcatattactgatgtggggaagattgagaagagatatttttgaggacttatcagaagttcaattttggccatggtatgtttgacatgcccattagatagccaattagagaagtccactagattgttgattatcggcaactcgtcgtagagggaaagatgcgggccagatgtctacct

SEQ ID NO: 599098 - DNA, 256 bp, Homo sapiens
ctgacttcaacgtagtccttataatcgtgtacaaagactaaaggaaactataaaaggagtaaagggggaggtatgataatgttgcatcacaatagacaatacccatcaagagaacttattataaaaaaaacacagatggaaattctggaattacgtaacattactaaaatgaacacattcactcagcaagggcagtcaacaatcagcatttgcacctggcagcacagcagttcggcacattcgcacagcatcagca

SEQ ID NO: 599099 - DNA, 161 bp, Homo sapiens
acatcaacagtgttcaagcttagctttgtttacagaaaatgaggtagggtgcggtggctcacatctgtaatctcagcagtttggtgaggccaaggcaggcgcatcagctgaggtcaagagtttgagaccagcctggtcaaaatgatgaaaccccatctata

SEQ ID NO: 599100 - DNA, 658 bp, Homo sapiens
  misc_feature (12)..(12): n is a, c, g, or t
  misc_feature (32)..(32): n is a, c, g, or t
  misc_feature (47)..(47): n is a, c, g, or t
  misc_feature (77)..(77): n is a, c, g, or t
  misc_feature (92)..(92): n is a, c, g, or t
  misc_feature (113)..(113): n is a, c, g, or t
  misc_feature (117)..(117): n is a, c, g, or t
  misc_feature (160)..(160): n is a, c, g, or t
  misc_feature (166)..(166): n is a, c, g, or t
  misc_feature (173)..(173): n is a, c, g, or t
  misc_feature (180)..(180): n is a, c, g, or t
  misc_feature (186)..(186): n is a, c, g, or t
  misc_feature (195)..(195): n is a, c, g, or t
  misc_feature (205)..(206): n is a, c, g, or t
  misc_feature (211)..(212): n is a, c, g, or t
  misc_feature (214)..(214): n is a, c, g, or t
  misc_feature (217)..(218): n is a, c, g, or t
  misc_feature (223)..(223): n is a, c, g, or t
  misc_feature (237)..(237): n is a, c, g, or t
  misc_feature (241)..(241): n is a, c, g, or t
  misc_feature (255)..(255): n is a, c, g, or t
  misc_feature (259)..(259): n is a, c, g, or t
  misc_feature (261)..(262): n is a, c, g, or t
  misc_feature (270)..(270): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (282)..(282): n is a, c, g, or t
  misc_feature (286)..(286): n is a, c, g, or t
  misc_feature (288)..(288): n is a, c, g, or t
  misc_feature (295)..(295): n is a, c, g, or t
  misc_feature (306)..(307): n is a, c, g, or t
  misc_feature (311)..(311): n is a, c, g, or t
  misc_feature (313)..(314): n is a, c, g, or t
  misc_feature (317)..(317): n is a, c, g, or t
  misc_feature (329)..(329): n is a, c, g, or t
  misc_feature (333)..(333): n is a, c, g, or t
  misc_feature (337)..(337): n is a, c, g, or t
  misc_feature (339)..(340): n is a, c, g, or t
  misc_feature (343)..(343): n is a, c, g, or t
  misc_feature (358)..(358): n is a, c, g, or t
  misc_feature (363)..(363): n is a, c, g, or t
  misc_feature (369)..(369): n is a, c, g, or t
  misc_feature (389)..(389): n is a, c, g, or t
  misc_feature (451)..(451): n is a, c, g, or t
  misc_feature (462)..(462): n is a, c, g, or t
  misc_feature (464)..(464): n is a, c, g, or t
  misc_feature (471)..(471): n is a, c, g, or t
  misc_feature (479)..(479): n is a, c, g, or t
  misc_feature (487)..(487): n is a, c, g, or t
  misc_feature (502)..(502): n is a, c, g, or t
  misc_feature (507)..(507): n is a, c, g, or t
  misc_feature (511)..(511): n is a, c, g, or t
  misc_feature (516)..(516): n is a, c, g, or t
  misc_feature (533)..(533): n is a, c, g, or t
  misc_feature (536)..(536): n is a, c, g, or t
  misc_feature (569)..(569): n is a, c, g, or t
  misc_feature (578)..(578): n is a, c, g, or t
  misc_feature (619)..(619): n is a, c, g, or t
tgattcaaaaanagagatttatttattaaggnttatttagtttctgnataaaaatctccaattgttcctcattgggntttttcttttaaaanacacatcaactcttttggggntgcnttgtttgccccagcactttaaaaaaaacagcgctttttagggncagggngaacagngaagggnaagggnggggggggntttcttgggnnttagnngnggnnggggncatctctccccggnaagngaatacacacgggngggngnntcttaggngggnaaancngncccngnagggaanaattctggggnngaangnnaanggggggatctangggnaatngnntgngccccagagggttgnaaganacgccnctggggcatcaaggggttgnggggggggttcagcgggaaaacaacaacaacaacaacaaaaaacaaccagaaaaaagaaaanaaacaaaaaantnttttttncgggacanaaagagcngggtttacaatagtnctgtnaggntgggntgtgcaaaccacaaganaanacacaccagttttctttttaaaaaatcccacanaggggcccngcataattttaaatcaaactctttatagtccttaaaataanaatacagcgagagcctcataaggtcacgtgctttttttt

SEQ ID NO: 599101 - DNA, 286 bp, Homo sapiens
tctagacggacccccattgactttcacgtggtacacggggacagccacgtgtcgggcacccaccacgctcacggtcctgcctgcgactgattcaccagtaccatgagcacttggtgcgccgcgccacgtatccagtgcagcggttgccatagctagcaggagtccacaaagcagctcactatgaagaaagtgcccatcgtagcctgtatacatctcaaaggatttgaacactcagccacgctgcggcggaagatcaccacgtagaccatcactggggtaccgcgct

SEQ ID NO: 599102 - DNA, 711 bp, Homo sapiens
  misc_feature (134)..(134): n is a, c, g, or t
  misc_feature (646)..(646): n is a, c, g, or t
gatttaatgccagaggtaaaagatggtaaagaagtttcaaatcctagtgaatatttattagtagttgatgctatgacagtccacgatgctgttaatgtagcagagacatttaataactcattagatctttcagngaataatattaacaaagttagatggtgatacaagaggtggtgctgctctttcaataagagacattactggcaagccaattaaatttgttggtgttggtgaacagatgagtgatattgaagtattccatccagatagaatggcttcaagaatattaggaatgggagatgtcctttctttaatagaaaaagctcagcaagctattgaccaagatgaagcaagtaagttaagtgaaaaaatgttaaatcaagaatttaactttgatgactacttatcagctatggatcaaatgaaaaagcttggacctataaataaattgatagagatgattccaggtgttaacaaaggaacttgaaggcattgatttttctcaaggagaaaaacaaatggctacagttaaagcaatcatacaatcgatgacagctaaagaaagaaaacaaccttctttagtaataggaaatggttcaagaaagagaagaatagctaaaggttctggtacaacagtacaagaagntaaataaagttcttaaaaggctatgaaatgatgaaaaagcaaatgaagcaaatgaaatcattcca

SEQ ID NO: 599103 - DNA, 170 bp, Homo sapiens
  misc_feature (130)..(130): n is a, c, g, or t
tctagaggatccaacacagtcgtaaggccgatgtctcaggaaatcaggtgtgctcaaatactaccaacagtttggtgctcggaacaacagcttctgcctggagcacagatcaatattctgagaagtgcgnaatcaacactgcaatgatgataacgttatcaggtgcggga

SEQ ID NO: 599104 - DNA, 157 bp, Homo sapiens
gaattgtctaatttaatccctacaacaacccttctgtgttagtctcttttcacaatgctataaagacatacccgagactgggtaatttataagaaagaggtttaacagactcacagttccgcctcaggaacttacaatccttgtggaggtgaggaag

SEQ ID NO: 599105 - DNA, 1113 bp, Homo sapiens
cagtccctgggatctcctggctgaaggttctggacgtctgtctttgcgtgtcgagttcgttcctattgagcgaggccctgggcgccttggccttgttccaggatgttctatcttatttggttcggtacttgatgaccctggttcccttgttgggcccgtagtggatgacttgggtgtttctctattccccgttattgttgatcacctttgctccagtcatacgttacatacggatagtaaaatgctggtcgaaatgctccatatgtaagctttgagtgatagctcttgccttggggacaatgttgggctttcatatgtcaagaatgtgtctgtcaaggatgttcgtcgttgctaacgttgtctggtgtacagcttttattgacccagcctaatggaagcagctggctttcacgtgctctaggtgtattatcctgaacctatccaggccacaataagcgcctggctatgcccctgttattggtattgcctacacggctctactattgctatgcaagtcttgctgtagctgtaaggaaaagattgatcgccgttctggtaaaatagctggtatagatggccctaatattcttgttagtctggtgtatgctgccattgttgatatggttcctggcatagccctatgtgtgttgtagagcttctcagactatccacctttgggtcgctttgctgttcgtgatatgagtactagacagttgcggtgaggtgtctatcaaagcagtggacaagataggctgctggagctggcaaggtcaccaagtctgccctagataagctctagaaggctataatgaatattatccctaataccgtgcctaccccactctttatcagtggtggatagatacggtctctagaactgtttgtttctaattggccattttaagtttagtagtaaaagactggttaatgatatacaatgcatcgtataccttcagaaggaaaggagaatgttattgtggaccactttggttttcttttatgcgagtggaagttttaagtgagtagcttatatatgcagtactttcttaagtggaaacatctgacccaaaaatgaccgcgaaatgagacaacaaaaagaacgtcccgccccac

SEQ ID NO: 599106 - DNA, 590 bp, Homo sapiens
ttttttctaatacatgcctatttggagagggagggaacaggaaaagaagagaagagagagaaagagtcagagatggatgacaggacagagacaaacggacaaacagagacagacagaaggacagagactgagatttcagctctgaggattgagtccagggcttcaggcattcttcctacatcaccagcccaataaatatagaactaactttgctcagtgctgaaaaccaactctaacattgtatctgaaaagtacagtttgctctttattgttatatgcatatgaaaggtttccatatatatactaaagtgagtatgcatacatatgtgtatttgtgagtatgtattctcttcttaaataagaaatctaggaaatgaagtttcaaattgtgggctgcattttcataatctatcaacatttgtaatccattataaaccttattttcttcacctgttgttcttacatgtaatgttcctaaatttaaatctttacaaattattcaaaagttaattaaaaatgaataaagcaaatttccccaaagactggatagtgtaaaataaaagataagaggcgttgtatatctcctagaa

SEQ ID NO: 599107 - DNA, 508 bp, Homo sapiens
gctgttctagaggatcccggccattggcaacgcatgtcagagggtctcagtgaaacttttgtcctcagaaggtacatatgtgtcttgatatcttacacgatagtagtccacaatgcaactcttgaatgactctgtgtaaaatctcagacctcaaccatgttgtcttatgcatgtcgaactaccttccatgcctggtagaggtatttccatcccttctccatgtgagcggaaatccccggctgccattgtccgttactcaggctccctctcgggaatcgaatcctgattccccgtcacccgtgttcaccagtggtaggcacggcgactaccatcgagagttggtagtgcagacgttcgaatgggtcgtcgccgtcacgggtgacgttcgatcgggccgagggtatctagaggcaccaaagcagccggggccggcccctggccggggccggagaggggcttgaccgggttggtcatgagctgataaatgcgcgcatcccccccgcgaagg

SEQ ID NO: 599108 - DNA, 805 bp, Homo sapiens
  misc_feature (289)..(289): n is a, c, g, or t
  misc_feature (450)..(450): n is a, c, g, or t
  misc_feature (459)..(459): n is a, c, g, or t
ttttgtcttttttctacactctggtgtgcctctttatccactcaccccccagcgcgtgttgttttttttctcatcacgcggttgatccacacacgcttttctcgcgcgcgcagcgcgtgttgagtacttggttcctctcactctcgtgtcttcctgcgcgagacactcttgttgtgtgtgctctcttctcgtcgcggggcggcgcacgactgcgtgtgctgcgcacgactctcgtctcgctgacgacgtcttttcctctatcgagcagcggcacagcggcgcgttagtnttgtctgttggtggtgtggctgtcgacttctccactagagcagagcgcgcgcgctgacgcacagcactcgctctcctcacagactatactcttgtttgtgtgcgacacaccgccgagttggctgctctctctctctctcgtgtggtgctcgccgcacgctnttctttgtntctgtggcacacagtgttgttgtgtcgccgcgagagagagccgctctgagacctcgttgagacaagatgttgatactcactggggggcacaccactcatggagccacaatcgttgtggtagagaggcccccacgacggggagttgtgtgggtgaccacctgttggggagccacacccgcggcacaagaattctcacgatgtcgccattgtggggcccacacgagggcccctgttgtagagcccctgggttggggggccccccccccaaggttgccctcattttgggcccccttttggttgtttccccccccccccccccccttttattacccgggggcccttgtta

SEQ ID NO: 599109 - DNA, 224 bp, Homo sapiens
  misc_feature (63)..(63): n is a, c, g, or t
  misc_feature (126)..(126): n is a, c, g, or t
  misc_feature (134)..(134): n is a, c, g, or t
  misc_feature (169)..(169): n is a, c, g, or t
  misc_feature (182)..(183): n is a, c, g, or t
agtaaaagcaattttagaatataccttgaaatgggtctggagatgaaggctaaaccaaaactnttccaaatgcattttaaacagtggttgcaatagcttaaaaataaacgtgtagccttataaccncctgaggnaataaaattagatgcgtaggctctggcatttccgngttaacaatacgnntatttatattttaaatactgaatgttcacacaactggtagc

SEQ ID NO: 599110 - DNA, 297 bp, Homo sapiens
atcaggcgaggactgtgcgcaacatcgttcttcaggaggcaaagcacttcgtcgggatagaggagaagcaaggttcagtgccatctgacccgccacaccccagtacaagacccgacagaaggcagaatcccacatggaggtaggacagtcacagggtcctctggtggcgtgcccgggatgaacaccttggtccatccagtccagctgtcctcgagtgttccctcaggctgggaagtctgatgccaatgggccctggacatgcttcagtttcctctctcgccacagtcttcgcctgat

SEQ ID NO: 599111 - DNA, 989 bp, Homo sapiens
agttgggccgaccagtgtggagtgagtgatggtggtgaagtgactgacaatatgtgtcaccaagcgatgctcctcaatggtgtgatccctctgtgccacatggtgtgacaccatgcccatgatgccaagaagctactgcctgggagctccactgcctgctcccaatgtgagagtcatcaactggaaacataaatgacatgtgacatgatgtacaatgatagatgagtgatggcaatgaaagttacaaagatttgtcctgaccttcaggtgatttgaagaaccctgtgaagggaatttagaaaagtgcttgtcaggcaatgtgagtgaaagaaattggaagagaagttctggtgaacatcagatgtatcgaaccccccccctgtgaacccacaagattaggtcggacagcacatgacaacttgtcatgttgaacgaattgtcatacatcaatgagctgtatccagtcaaacaacgaaaaaacggatgtgaaccgttgaagctggccatgtggatgtgacgtgaggagacccgctatagaaaccagacacaacaaaaggtgccaataaaagaataagatgtacatgcctgcaatctaggacgcaaagaggagaacagcacttgggaaccaccacggcttgacacacttaacaaaagggaatacagcctgagaggccacaaatgccagaaagggaagacaggccgaagtccagtcatagggcagatgatctaacaaggacgaagaaaaggggagaaaggccagacagggaagaggcaaaaacgcagtatgcaaaggacaacgcaaaaagcacgcacagggcaagaatgtgacgacgagacatgagcgaaagggagcagaccgacacagaggaagaccatgcaacccaccggaaaaacggcgacaacccaacaatcgatgtacaaaaaggtaaagaggaagaggtagaaacgacgtacggaccaaccagcgacagaaccaacacaacaaacga

SEQ ID NO: 599112 - DNA, 121 bp, Homo sapiens
cagttaactacgcgtatattcgctaaacggtatcactgctgtatcccgtggagtgtaggctaggctaagcgtatagagctagcattgctgcgtgcttgactgcttgtacactcttaagata

SEQ ID NO: 599113 - DNA, 132 bp, Homo sapiens
cacgaggtgtatgcttgatgtgttcgcgatgtcttttacactgcatctgattgtgtcatttggacacatacatgcaaatcaaaaggctatgttctgctgtagacatgtggggaatggatatggttcatctcc

SEQ ID NO: 599114 - DNA, 1300 bp, Homo sapiens
  misc_feature (900)..(900): n is a, c, g, or t
cgcgggtgttattattacactcccctcagcgtcggcctcgtctttgtttcttggtgtggtatgcgcccctcctcactctttctctctctccccgagtcaacttgctcctactcattctcctcccctcgtctggtttttgttgatctcccgcccccctctgtagtgtagcacctccccctgcgcgggctccgctaacttgtcctatctctcctcacgcgcggtcttttctgctctcttgtactccggctccgccgggcgtgccggcgtagttaacccactgtttgcctgcccactctcggagtgccctcctcttgcttctgtctctccccttgttttttgctccctcctgtttattgttatagtgctggcgtcctcttccttttctggtccaccccactccttttcgttcgctcgcccaactctaaactccatcccccgcggctgtgttttgtccctccttgcctcccgcactgtttttctcccccgcgctgtgttttgttttctcactcctctgcagcgcctagcttcttttgatccacactcgctacctggttcttgtacactacctgccttccatcgtttggttacacacacatctctcgctttttcgttttatcttcccttgtcgctctctctcacagagcgtgtgttatgtctgcctcctcacattctcttttgttcgtgttgttgtttgtctcaccacacccccgcatgcatttggtgtgttgtttgcgacccaccacatcgtctttctcatgaaagcttttcttcgtcggagatactatttctgggggtttcaacacctctttcttgtgtgagggagcacctctctttgtgatctgctctgtccgtgagatatatccctctcgctcaagatgactgtttgatagaaatagtatntgtgagatatatttttctcttgagcaaataagtattaatagagagataaatatagagacagatatgggtgctcccacacagcagggaataatactagagcagagaagagttgtttaatgatagcaccacaagaacactcctgttgtgatgaatatttttctggcccaccagcacagaagagttgtgttgacaacagagaatatcacaattacttatattttttgtggggtaataaactgagtggtggtgtataacaacaacaggaaaaacaacacgaacaaagatttttcttcttccttgtaccgggtggtgtaaaaaaaaaatgggggttaaaaaacccctttttcttttttggaaattttttttttgtaactttttaaaacttttttacccggcccca

SEQ ID NO: 599115 - DNA, 223 bp, Homo sapiens
cccggaccgctacacagcttcccaacatggacgagcgtcctctgtctcgtctccccatctggtctggaacctgctttgccaggtaagcaatatctccatgctattgtatagtactaccgctcttgtagccttctgatttctgttactgtagagtaacacagattctttatacacatttgtaagcatttacgccaaacccccgctctcgatctcttcttctccc

SEQ ID NO: 599116 - DNA, 387 bp, Homo sapiens
tcactaaatgcgatctagtgaacaaactacaaatcataatcgcaatgtcgaaagtccggagactagaaaatcttatgctaatcatgctacacaacaatcttgttaccataaatacgcctctaaaaaataaacggatactagtcaaaccagcgattctgtatctgatcactatttgtatctattgtatgcaataaacttactccaatattttagcagtagtttgttgcatcatggtaaccagatatatatctaggggacccctggttgtattaactataaatactcatttagtctatttagactatcaagagtcaatagatatcggtcttagcctataaagtatagacacacgtgaatataatagcttagcaagatgtatctgatata

SEQ ID NO: 599117 - DNA, 647 bp, Homo sapiens
  misc_feature (13)..(13): n is a, c, g, or t
tcgttgtgtcccncgagtatggcatatgtgacggcccctcgagtaggtagggacgaagtcggtgaggaagagatggtggaaggcaacgactatgaagaatgcggtgcgtatggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagactggatccggaaacacttgccaatgatgactgtgccgccctgtgctgccaactgtatgccctgctgcctgccgcctccaacctgtgcggctctgggcctgctgcctgccgctgccccgtacctgccttcagtcaaggtggtcgctagccacctgggtggccacggccgcgaggtctcaaggagacggatacccaagcccacgaacctacgcctgccagaggctcacggggcccacgcccatgagaccaacaccttgcttcttccgcagaacctccgcagatcgttacgtcaccagtaagcatggcttgcccccgaggctccggaaaacactccgacacagatacccagaccaggcatcccccggcccaggacgcctgctacctgagggccc

SEQ ID NO: 599118 - DNA, 349 bp, Homo sapiens
tttttgtcgggggctgttttattgttcccccccccccgcatttttcaggtgttccccaacaaaaagggttgggcaaccccctgtgtctcttgagctgggggagggggggcccccccccccccacccctgtttttccctcaatggggcccccaagcctgggggcctgcagccccgggggccccccccccgggacctttggggaccccccccccccccaaaggggatccgggctttccagggggggcaagggcaaggaccaggtttgggccccgggccccggggggggggggggggaaccccccgggccggggccccccatgggggtgggggaaaaaaccctttgttttta

SEQ ID NO: 599119 - DNA, 161 bp, Homo sapiens
ccacaagcatccaccctaagtgtttctggtttacattgccctctttagtgccttcttgaagacttcttccttcaggtttcggttgttttaaataagaaagagttgctgttctaagccttgtttcacattgttccgtacctgcatttctgaaggccccaact

SEQ ID NO: 599120 - DNA, 362 bp, Homo sapiens
  misc_feature (111)..(111): n is a, c, g, or t
  misc_feature (120)..(120): n is a, c, g, or t
  misc_feature (136)..(136): n is a, c, g, or t
  misc_feature (147)..(147): n is a, c, g, or t
  misc_feature (164)..(164): n is a, c, g, or t
  misc_feature (166)..(166): n is a, c, g, or t
  misc_feature (183)..(183): n is a, c, g, or t
  misc_feature (192)..(192): n is a, c, g, or t
  misc_feature (199)..(199): n is a, c, g, or t
  misc_feature (212)..(212): n is a, c, g, or t
  misc_feature (230)..(230): n is a, c, g, or t
  misc_feature (257)..(257): n is a, c, g, or t
  misc_feature (270)..(270): n is a, c, g, or t
  misc_feature (284)..(284): n is a, c, g, or t
  misc_feature (339)..(339): n is a, c, g, or t
  misc_feature (342)..(342): n is a, c, g, or t
tttccccatcgctcccaacctaaaccgaaaaggagttgttgaccagtgccccccccggcagcccgggaggaacacaggcagctcctttcccttcacgtggtttgcaaaaancagggtganctgccaactgcccctntccaccagggnaccctgttttggtggtnangggccccttttcctttnaggctctantggaggnggatgtccttttntgccaggcttggcacatnatgtgaaaaataaatgcccaatttttnctgttcaggtttnatgtggaatcccanctgcagtgatatatattttttatcagggcttggttggttttaaataaagggcccnctnttttattatcttgttttgaa

SEQ ID NO: 599121 - DNA, 490 bp, Homo sapiens
  misc_feature (1)..(2): n is a, c, g, or t
  misc_feature (68)..(68): n is a, c, g, or t
  misc_feature (70)..(70): n is a, c, g, or t
  misc_feature (76)..(76): n is a, c, g, or t
  misc_feature (79)..(79): n is a, c, g, or t
  misc_feature (95)..(95): n is a, c, g, or t
  misc_feature (98)..(98): n is a, c, g, or t
  misc_feature (100)..(100): n is a, c, g, or t
  misc_feature (104)..(104): n is a, c, g, or t
  misc_feature (122)..(122): n is a, c, g, or t
  misc_feature (151)..(151): n is a, c, g, or t
  misc_feature (158)..(158): n is a, c, g, or t
  misc_feature (206)..(207): n is a, c, g, or t
  misc_feature (430)..(430): n is a, c, g, or t
nntgacctgtgttcttgtgcaaagtcctgcagggttggtggcaccagaaaaggccttgcacctcttcntntctccnagnaagccagctcctgagntcntnagcnagcggaaactcttcctcnagccttccgggagaacatccctcccttantggaaangaaagcagcctccaggaaatgttttctgccttcctgcttctagaaccnncctcaggtattgatgaaccccacttagcacagctgaaggggtttgtgaatactcccgcctaaatcccttctacttcactcctcaggggagtgaagtgccttaagaaacaaagccctgtcctaatttatctagcttgtcagtccagtcttagagataccctctttcctgaagtgaggcgtgcctgtagaaacactatgtggtcagcctgtccccaaggagatcntgtgtctcctctccatctctgcctttgttccagtgtgcatgtgtttgtgtgttttttaat

SEQ ID NO: 599122 - DNA, 357 bp, Homo sapiens
  misc_feature (210)..(210): n is a, c, g, or t
gataggcccttcccacttacaaatttaagtgctgaactgtaaataaacattaaatcatgattaagcaggggtttacctaaggaattcaaatatgtgtaagaagagcgagtcatttcgctaatggattaaaggagagaacccacattaactgaataggtgcagaaaatgcattagatggtatcccatttccatgtgggagcaccggtctgnaagactctaaataaagtgaaaattacttaatcggtaaaaggcttatgacaaacaatacttaatgccacttaataatacaggagtctctactcccaccttgtattatctgccccctggtattggagatcctgacacaatgcaatcagc

SEQ ID NO: 599123 - DNA, 184 bp, Homo sapiens
cagacctcgtcaagactccgtatgagtaggtactagttacttgcgcccagtttagaggtgaggaatagagcccatggtcacacaatatatggtatgtgcagatgtcaaaccctatcatcctagctctgagagaacttgtcctctcagaaccatctcacatcccgggccccaggcaaatatgcga

SEQ ID NO: 599124 - DNA, 112 bp, Homo sapiens
  misc_feature (70)..(70): n is a, c, g, or t
  misc_feature (79)..(79): n is a, c, g, or t
tttgtcagctttaagcagagatgattaaaggtgtgacttggtgatcaactatactatcaactagctcagntgaatatantcacagataaggtcgaacctgaatagcagggca

SEQ ID NO: 599125 - DNA, 198 bp, Homo sapiens
agaggtattggtacatccatattcatagcagcaataatagccaaatagttcataatagccaaagggtactacacaacccaaagggccatcaccgagcgggagggataaacaaatcaaagggtatacataaaagggaatataatttttccataaaaagagatgaagtacttttcatgcgcgtccgtgtaaagagaccac

SEQ ID NO: 599126 - DNA, 344 bp, Homo sapiens
  misc_feature (31)..(31): n is a, c, g, or t
  misc_feature (271)..(271): n is a, c, g, or t
ctttgggcccattttgtattacttccttttntgtgtgttgtctccttaaggccattagaaatggaataacaggactgggcacaatggccatacctgtactcccagcactttaggaggctgaggtggaagggttgcttgactgcaggagttcaagaccagtctgcacaatatagggagacccccatccctacaacagataaagataaattatctggccgtggtggtgtgtgtgcctgtggtgccagctacttgaaaggctgaagcaagaggntcacttgaatttgggaggttgaggctgcagtgagctctgattgtgccactgcactccagcctgggtgacagag

SEQ ID NO: 599127 - DNA, 198 bp, Homo sapiens
gtggtttccctagaaagggcccctgttgttttccccaccgcagtcaccaccccccgaaatgccagggggtcattgtgcattgccctgtttatgggcctttggggggcagggcctttctggttttgtacactgttgtacccaaatgcctacacccatccctgccacatacaggggttcaataaacccttgtagagcaga

SEQ ID NO: 599128 - DNA, 127 bp, Homo sapiens
gactctagcaggatcttttcttgccacggatcggtaatgcccaaatctttgtggaaatagatggggtatggctatttacaaaaatggcacaggctgaaagaactgggttctgcataaaacagaatcc

SEQ ID NO: 599129 - DNA, 971 bp, Homo sapiens
  misc_feature (69)..(69): n is a, c, g, or t
  misc_feature (86)..(86): n is a, c, g, or t
  misc_feature (146)..(146): n is a, c, g, or t
  misc_feature (232)..(232): n is a, c, g, or t
  misc_feature (258)..(258): n is a, c, g, or t
  misc_feature (268)..(268): n is a, c, g, or t
  misc_feature (271)..(271): n is a, c, g, or t
  misc_feature (277)..(277): n is a, c, g, or t
  misc_feature (280)..(280): n is a, c, g, or t
  misc_feature (283)..(283): n is a, c, g, or t
  misc_feature (296)..(296): n is a, c, g, or t
  misc_feature (305)..(305): n is a, c, g, or t
  misc_feature (307)..(307): n is a, c, g, or t
  misc_feature (313)..(313): n is a, c, g, or t
  misc_feature (315)..(315): n is a, c, g, or t
  misc_feature (346)..(346): n is a, c, g, or t
  misc_feature (356)..(356): n is a, c, g, or t
  misc_feature (364)..(364): n is a, c, g, or t
  misc_feature (384)..(385): n is a, c, g, or t
  misc_feature (387)..(388): n is a, c, g, or t
  misc_feature (393)..(394): n is a, c, g, or t
  misc_feature (398)..(399): n is a, c, g, or t
  misc_feature (403)..(403): n is a, c, g, or t
  misc_feature (447)..(447): n is a, c, g, or t
  misc_feature (449)..(449): n is a, c, g, or t
  misc_feature (452)..(452): n is a, c, g, or t
  misc_feature (454)..(459): n is a, c, g, or t
  misc_feature (461)..(461): n is a, c, g, or t
  misc_feature (470)..(473): n is a, c, g, or t
  misc_feature (562)..(562): n is a, c, g, or t
  misc_feature (570)..(570): n is a, c, g, or t
  misc_feature (636)..(636): n is a, c, g, or t
  misc_feature (639)..(639): n is a, c, g, or t
  misc_feature (641)..(641): n is a, c, g, or t
  misc_feature (646)..(646): n is a, c, g, or t
  misc_feature (648)..(648): n is a, c, g, or t
  misc_feature (660)..(660): n is a, c, g, or t
aatcttgacggtttctgcccgtcctaatggcagagctctctgacttgggtgtatgctgccaggcggggnactgtcatactttgttntcttgttgtgctttaaaactacgactcagcatacattttcccacatacatttttacattntaccttaggactcagtcatctccacttaaattgatgacacaagcagctaataaccatttctgggtttctgcctaaccccctaattntctgttaaagccaattctctgggtgncccagtgagnggnggcttnttntcnttccacattggcncattcaccncncccacncntggcatgtaagaaataagcattcacataatnggaaaaatcnggatttcngatgccaaagggttaaagcnncnnggatnncatnncatngatatacagccactattttatttttgatcagggcctttgggccncngcncnnnnnncngaccaccannnncagcattagggttttggtttttgtttcttttgggtatttcttttttggcacatgtgaatcttgttttgtgtaaaatgaaattactttcncttgttcnctgatgatgggtttaaaattaaaagagcatccggttttggtatggggatgatcccaggattatgcngcngnactgnantacatattagtnacttgtgctttttttttttttttttggatctttgcaagggcaaaactaccaagtaacgagttttaatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacaaaaaaa

SEQ ID NO: 599130 - DNA, 141 bp, Homo sapiens
gaggatctcttgtcccagaaccgagcaggagaattatggtgggtttgaagcacatcaagaagccatcctgctccactgtcctcagcttgatggcacccaacaatgtgctgctggtgctggtcctgtgacttcaagtgtctg

SEQ ID NO: 599131 - DNA, 307 bp, Homo sapiens
aatgtcactgttgctggtggtacttatattgtccacttctgggtgggagaactctgtgctttcaacatccacttcaatctcctctcgctctgaatcagaacgatctgaagaaatagttgatccaatgctgtccattcgtattcgttccatcttctgaggaccctgcagctgttccagtcgccactttaaaaatctctgttctcgttccaaattctcgagctggtgctggctttttctttcagcttcttcaagtttcttgatgtgtgctttggcttttgtgagcaaaccaagtgttgtgtgccgggtg

SEQ ID NO: 599132 - DNA, 180 bp, Homo sapiens
tgcctggagctccggagatcgtgagcagctggtgaagaacacatattcctgtgaccgccctgtcgccaagaggactggggaagggaggggagactatgtgtgagctttttttaaatacgagggattgactcgagatttgagatgatcattatgggctgcggtctgtttctctcgggagtg

SEQ ID NO: 599133 - DNA, 549 bp, Homo sapiens
  misc_feature (250)..(250): n is a, c, g, or t
ggtccttttcagaagtgagctttgctgctacaggggaaggtggcctctgtggagccccagcatatgggggcctggattcatttcctgcccttcctcagtttaatccttctagtttgcccagcaatataaaagctgtagcttcactgtcaggagagaatatctacagatatcatatggattactgactctttaacccaattggctcccctggagcaatggtctgtcgctagtggaaacttccccgtcccantatcctgggcctcagccacgccaagtgtagccaatcccatggagacacacttgtgttcctaggttgctcatcatgccacttgggaagggggcagagttagccaagggtgttggcccctgcccattcttccccaggcaggggcccaactccccgggaacttccatgctttaagtcacttgccttgcagaaggtctggtggctgaggccttaatcattcatttcttagctcttaattgttcattttgagctgaaatgctgcatttttaatttttaaccaaaacattgtctccttaatcctg

SEQ ID NO: 599134 - DNA, 952 bp, Homo sapiens
agcgggagctcgtgagcgccggcgcggggacgcgggtttctgcctcaggccctgccctgctctactctgcgctctctgcccgcgcctgccgccggcctcagcctcggccctgcgctgcggcgccctggccgtgctgccatggcctggccgcccgcgaagcccggcgaggcatcagagccgctgcgacggtgacgcacagcccggccgtccccccgcggcgatggagcctgggaaccggaagcgcaggaggccgacgggcaaggcgcttgggaggcccgaagaacgccgaggaaggcagcagcaccgggggcgccagaagccggcaagacccggaagagctttaaccaactccttggaagggcccctaaaaacccgggttccaaagaatggctgtgacgtggggcaaaggtggcagggttgaacagaaacgactgtggacactgcgaggcacccaacaaggtttaccccacagaggacaactggcgccacgcgcacttattcacaacggggacaaacttcccttcaattaccacttgaacattgtgggcacaccaccaagacgcaaacatttcaattctattcagggaacagtttccttggatttcccacaccgggagcagttactacatggttctacaccttggttggtccccggggggtgtgtgggcacttttttggggacggacacacatggatttggacacatgttggttccccttaatccttgtgaggggggcaggaacaccgtagcacacagccaggacatttcaacacataaatgtgggggacactgacaaccgccaccaagcttggggcgtgtaaagcgaaagtgcgggtgtgagtaatttatacacgcggaaacgggtccccccacaggagacaccccgttgtgcgaacacaacccgcgtagtgacatttatcaattacctagagagaacacccccttaacagt

SEQ ID NO: 599135 - DNA, 167 bp, Homo sapiens
atggcaacgatctctctctctactcaggcggacccccgctccagcaagccccagtccaaaggataactggggacgtttgccaggacgtgcacttcaagaacttggtgaactgaacgagtccagactgctgtcggaccaactccacctttgtccaggccttttggagc

SEQ ID NO: 599136 - DNA, 151 bp, Homo sapiens
ggcgccataaaaattaactaagcaaatcccgtgttcctaattttacagaatccgttgccgtccttaaataaaataaagcaattaatcaaacaacgaacgaattaacccttttaataataaaagcctaatttaaccgtaactaataacttat

SEQ ID NO: 599137 - DNA, 417 bp, Homo sapiens
aggcggggtactcactgtgtcggccagacggggcacacactccgtgacctggtgatctgtccaccgtcagcctcccacaaatgctcatatagtacttgtctagtgtgtcctcatgatgagattcaggttacgcatacttggccagaatactacataagtagtaggtattcgttcttaagagagctggaatttagagagacataatggtcatctgccccgtcagttttcatcctcaaccaaaatgagtgatttcttcactgtgtagttcctgtcattttctttaccacaaataagtgggaagtactttaagaccatgcaaacattcatgttttccatcagtatttccctcctggatttgaggtctattgattctcgcctgaaccatctttactacagtggttatagagtgatggtttc

SEQ ID NO: 599138 - DNA, 123 bp, Homo sapiens
ctagggatcttattacaaatttgtactatcatgtgtgtatttatgtgtgtgtgtctcatattggggtttcagctatataaagcaaatactaaccaaactgtgattaacaccaagagaacaata

SEQ ID NO: 599139 - DNA, 375 bp, Homo sapiens
tagctagacagtctaatcggtgaggttccggaagcctccctgttccgtctccacctaccctcccctagcctacccccaaacaggcctccatattccagccagggacacctaaagccagggcttagaaactcacgtgctgggagggccagttaggcaaggaaaaggggccccgtagtgggggtggggggctagagcaaataggagggtgcctgccctctcggcatagcaggggctgctcagctgcccccaacaggtgccaagggggagcacagacccagggtaccaggagttttaaagagaagctggaactctggggtttaaatgtggggaagaaatttctttgtttttaattgtaaatattggcaatacatctca

SEQ ID NO: 599140 - DNA, 314 bp, Homo sapiens
ctctagaggatctctaatatgctgtctcacctccaactgctaagtgacggcacagtgcgtgataagtgcttagttaagatggaacaggcactgcatatgtgggtggaagagatgaacagaaaacgtgttcccattgacagcaacatgttgcgccagaaagctttgagcctataccaagacttctgcaagggatgctctgaaactgacaccaagccatttactgcgagtaagggatggttacacagattcaggcatagattctcacatcattacaagaagaagaagaagggtaagtacgttacaacaagttatac

SEQ ID NO: 599141 - DNA, 630 bp, Homo sapiens
agaagacaaaggggtttgttgaacctgacctcgggggggatagacatgggtatggcctctacaacatggccccagcagcttcagtccatttatcgtctatggtcagcacagcattatgcacgacatggagagcttcatgagtgcctcctctgtgacacggagaggtcagccccattgctatacacattagtgatgcccagttgacacagaacgctattcagatcataggttccagtaatggacagtttgggtaaatgtaagctgacagaccacaggtgcggtagttctcccctcatcaggcatgatgaagatgtcggtggcattgcccaggtatttcatcagcagcagctagatggacagcttcttacagtgctgaatgttaaacatgcttaaacgcttcatcataggcactttcacgatggtcacttggtccacgtgtaagtcctattcatcggtgtcctaaacttaaaagggtctctcccattagccttgaaaaaagatgtaattcaccagagcaaaatctgtgtctctgtcaagctccttgaccaaatccacaattttccttagagtacccttctccacgtaatcgttgatctgtctcttggcctcataggtgtccctgaagttgac

SEQ ID NO: 599142 - DNA, 807 bp, Homo sapiens
gctggagagcatgatcaagaagccgcggcccactcgtggtctgaaggcagtgatgtggccaatgcagtcctggatggatcccgagctgtcgtcatgctgtctggagaaacagcctagaggggactatcctctggaggctgtgcgctatgcaggcaccttgattcgcccgctgaggcagaaggcatgctcatctaccagttgcaagttatttagaggaatctcctgccagcgcatggcgcccattaccaggcgaccccaagcaagtatagccttagcctgcacgatgggtgcctgtgagaggcctccattctaagtgactgcaagtggtggcccataatcagtcctcatccagtgtctgtgcaggtcgtgcatcactcaggatggccaagatacctgtccagcgtgaccgcccgatcattgcttgtgaccctggaatccccagtacagctctgtcgggcccacctgtactcgtggcatcttccctgtgctgtgcaaggcacccagtccaggacggcctgggcctgaggacgtggacgctccgggtgaactttgcctatgaatgttggcaaaggcccgaggcttcttcaagaagggagatgtggtcatcgtgctgaccggatggcgccctggctccgcgcttcaccaagcagcatgcgtgtcgttccctgtgccgtgattggacgcagagacacatactctagcagatgtacggaatccaattcacctgggcacatgcatgtacaataggaacaggcgatgatgtctttctgccaatggaaaaataggaacatggtacatcctggaatc

SEQ ID NO: 599143 - DNA, 210 bp, Homo sapiens
tccgctgtgatggacctgagatccccagtgtctcaagatagcatggtactaacatagaagataggcatgaatcagaataaaagtccaggaataggccgtgtgtagtagctcactgcctgtaatccatacatttcttaagtaaccatattcttttaacaccttgcttcagagcacagtaccatttaattatcaccattccttccagaatat

SEQ ID NO: 599144 - DNA, 325 bp, Homo sapiens
  misc_feature (324)..(324): n is a, c, g, or t
tgtatgttgtgggtgtgactgagtgaacttcaggtcagtggtgcaggaatagctgtcgagatgtcatggttgaggtatcttataggaatggggaaaggcaataagtgagtccagagtagaatggtgtcttgtggctaggtggttcctggtcagcaagatcagtacagaagtacagtaggatgcaaatgaagaaagtgttgctgagaatgtgtttatatccaccaattctcagaatcactgaaaacatttgggtaaatgccaaaactctaagagattttaggttttacaagttttgctttcccttaaaaaaaaagttacataggnt

SEQ ID NO: 599145 - DNA, 379 bp, Homo sapiens
  misc_feature (287)..(287): n is a, c, g, or t
  misc_feature (314)..(314): n is a, c, g, or t
  misc_feature (321)..(321): n is a, c, g, or t
  misc_feature (364)..(364): n is a, c, g, or t
ggctacagtggcaaaaccccaatctctacagaaaatataaaagttagccaggtgtggtggtgcacatctgtaatcccggctactcaagaggatgaggtgggaggaggtggaggcttcagtgagttgagactgtgccactgcactccggcctgggcaaccagagtgagatcctgtctcaaaaaaaaaaaaaaaacaaaaaaagagagagagagaagcaattaccacagccatcccagccttcagcaaccacgaccctgggtaagcagccattcaacatcaaggcaagntcccccattaggcaaaaagattttaanttacttnaaggcttcagttatttgtttagctttttttttttttttttttngaggacagggttttg

SEQ ID NO: 599146 - DNA, 112 bp, Homo sapiens
tcaccgtgtggacatcaaccttcgagaaattccagttgtcttttatcccagccgcatcgtgcctgtagaatgccggggaatggctctagaaaatggggcgcattcgcgatcc

SEQ ID NO: 599147 - DNA, 832 bp, Homo sapiens
gctgtagtggcattcgtcttcggtttatactcttccttcgcataacgcctcccggactctcgtcagcctcccagccggccgtctccttaacaccagaacaccatgccttcaattaagttgcagagttctgcatggcagcagcatcatttgcacagttgcatgtggcaacattgccaaaaccaatctgtgcactcattcaagcacccatgttggcacagcatatcgggcaatggcatgcatgcaagcgcagcatgcatgcacccgaaattcacatcattacccaaacatggtgcacattgcgaggcaaatcatctcacacacacacatggtccaattccaggtgggatgacaaacacgaaacaaaaacgggaatgcaccatccaatccatcccgtggcaaagcaatgcatgcagcacaccacaaagcacaaagcgcaaacagattggaatacttcccctggatctggaggaactcaacggaccttcccttggacaaacgatgtggacccaaaagagaaaccaccctttagatggcacacatacaattagcatcgggcgtcgacgaacaacataacctctacgaccaattcaaaacgggattaggctatgacttgattaacattgcaaaagaacgttcgtattggccaaacataattgcactccacagggggacacaaacacctcccttgaggaagcacatcggcacagaacccttcaactacttccagacggcattgcgttttcaaccttgacagcacggcaggacaaggccccaaggataacgccaaaaagaaggaaccagttgggtggtgacacgacagacaggtgaccat

SEQ ID NO: 599148 - DNA, 175 bp, Homo sapiens
  misc_feature (55)..(55): n is a, c, g, or t
  misc_feature (97)..(97): n is a, c, g, or t
ccgtcagtgctttgcccgaggttccgcaggcccagcctgtcctgggccttcaagnctcactgccgacttcagggaggatccggacccccgcaagggntaacctgggagtgggagacataatcgacacggatgactgccatccctgggcttttgccagaagtgaagaaagtggagc

SEQ ID NO: 599149 - DNA, 369 bp, Homo sapiens
tagcaaatctccgacaacttatgagtaaggagattagaagtcagataagtagagttctctcatcaaagcaaagcccaggacattatgtcttcactgctacattcgtatcaaacatttaacgaagaaatcttaccatatttttgtcacatctctcctaaacttgttaaagagcagagaatacctccgaactcatctggacactatgttgtacaaattaaatacataccattttttctgtcaatgtaaaaattaaaatacaaagcaaattaaagtttctaaaaaagaatattttgttactaaaccaattctattacaaaaaaacccacacagtgaaacctggtatccactgagggcttctagtccactgag

SEQ ID NO: 599150 - DNA, 770 bp, Homo sapiens
taaaattaattaaccactcattcatcgacctccccacccctatccaagcatctccgcatgatgacacttcggctcactccttggacgcactgcctgatcctccaagatcgaccacaggactattgcctagtccatgcactactcagccagacgcctcatccgctcttttcatcgaatcggcccacatcactcgagacgtaaattatggctgaatcatccgctgaccttcagcgccaatggcgcctcaatattctttatctgcctcttcctacacatcgggcgaggcctatattcacggatcatttctctactcagaaacctgaaacatcggattatcctcctgcttgcaactatagcaacagccttcataggctatgtcctcccgtgaggccaacatatcattctgaggggccacagtaattacaaacttactatccgcatcccatatcattgggacagacctagttcaatgaatctgaggaggctacctcagtagacagtcccaaccctcaccacgatatctttacctttcacttcatcttacccttcattattgcgagccctagcagtcactccacgtcctaattcttgcacggaaacgggcatcaaagaaccccctaggaatcacctaccattccgagtaaaatcaccttccacacttatagacaatcaaaagacgcccttcggttacttctcttccttcctctcctttaatgacctttatcacttattctcaacagaacgtcctaggccgaccagacaattacagg

SEQ ID NO: 599151 - DNA, 164 bp, Homo sapiens
ccgtggtgctcgctgttgaactgcccgagctgcccgacacctggctattgcgaacccgtcacgcaggacgtgctgcaccttcaccgacagcctgaatgacgccgtactgcgtgcaccgacacggccttctgaagccgtctggctgtgctgtgacgccaaggtgt

SEQ ID NO: 599152 - DNA, 1484 bp, Homo sapiens
tgggggggagacagcacccgggggggagaaaagggggccacacacacacacacacacacacaacgaagagggggggggggggggagggcgaggggcgagagggggggtgagagaacacacaccccccaccacccgcggggggggtgccccgccgagagaacagaaaacacaaacatcaacacacacccccacacaaacagagagagaggcaccctctccaaacacacagagagggggggacctggggcgaccaacacacaacacaccacacagcaggggggcacacccgagaggggcgaccctctctggggagccacacacacacacacaggcggcgtctccacaacaacacagggtgcacaccacacagagtgcggcgcccaccccctccaccttcaccacacacacaccttctgagagggagaggcacagagagagagcgaacaccgagaggcgcgccgcagagagaacacacggacaccacacagagtgtggagggcgagagagaaaagagagagagaccacaaagataacgcgagaggcgcgagggggggggagagaacaatcaacacacacaacccaagagagagatgagagagagagaagcgacactcacaacaaacacagaggagaaaaagagggagagagagagggacccaccaccaacaaatgagagcgcgcccacctcaacaaaagaaaccagagagagaagtgcgagaaaaaaaaacgaaaaaaaaacaaagatataaaacaaagaagaagcacaagccaacaaaacgcagcggacggagagtcgacactctactacacgaccgacgcagacacggaagacgaaggagggagtgtagaaaccaaccaccaccgaacaacaacacaccatcactcaaaaacactttccccacctcacgcggcgagacgcgccgcaactaacatcagttcgcagcgcacccagacaggaggaagcagaacaaccccaccagcaggagaagcagcatcgacgcaaaagccaccccacccccacacaaagctaaccaggcagcacaacactaccacacacacagtagtggaagagacacgaaatgaagaacaaagaaccacaaacagataagtaaggacccaaaccacacacccatacccacgcagggcgcccctccgctgcggcagacatagaaaagctaggcagacacacgaccccaaaccacacacacacacaagaagacgagaaaaagcaaggaagcgacgacaccaacagaccgagcaccacacaacacacacaccaacacaagcagcagcacagaatacatatgtcgatgccacccacaccccgcacagcgagacgacaaacgagcaagcaacgacagatagcacaaagaaaacgtaacacaacaaacacaactagctctaaccaccacaccacacaacacaccaaaacacagtctcaatgcaggaaagaacaggacaaacagcaccacccacgagtagta

SEQ ID NO: 599153 - DNA, 382 bp, Homo sapiens
ttggggccttttttccggggggctttcccacccctccaaaccccccctttgtttgggggggggacctgggcccccggggtttccttccgtttgccctggtgggggggggggggcccccttttcccggccttttgcctggcccctggttcccattttttttccgggggccttgggaaaattggggaggggtttggttttgtccacccccggtaccaagggccctgttttaaaaaaaaaaaagtttggggtccgggggggggtggggggggccccttgggggggaccaggtttttttggtttggatggttttttttggagggcatttttttccttggggggggggcattttttttttaattggttttaatgttttggcctttta

SEQ ID NO: 599154 - DNA, 101 bp, Homo sapiens
tgtctgtaccgccttgttctaactgtgccactgacttgtacctgtctgctgccagtgctttgtgacccctgctctgtgattatttgtttgcccctcttgtt

SEQ ID NO: 599155 - DNA, 937 bp, Homo sapiens
gactgcatcgacggacgggcgccagctacgggaggacctggagtggcaactgggcgcccgacggacatccccgggaccgcctgcccctcggcgcccgccccgccgggccgctccccgtcgggttccccagcacagcttacctacgggctcctgactccgcaaggcttccagaagatgctcgaaccaccggccggggctcggggcagcacgtgagggaggcgtccagacaccccaatcagctcttctcctcctgtgccagtgggctccccgggggatgagcatggtggttttccctcggaggccacactggatcgggacgtctgaggaagatgccggtcatgaggcatgtatcccttgcttcctgcagtcctggacgggctggctgcttgcctgcttgtgcccccccagcagtgggacttgtatgtgggaacgggatcgtcagaaggtggaagtggtacccttccaggaagtgtggggacgagtacatgacgggcgctggagaggctggtggacgtcgtgtcacgagtaaccacaaagagaggtggagcaatgtacaggacatcctgtgttacctgtgaggttgcacggatggttggggatgagaatctggagtgtgtgccggtggagacggaaatgtaacatgccagcatcctacagaatccgttctgtgggaccggacatccctacgttggagctgacgttcttctcacgcaagatcggtgcgcaattgccggctctgcggcgaagatgacgctgccagcaggagaccacaggccagggggaaaaggggaaacacaaagtgcacagcatgcacgtggaggcctacgtcccccagaccgaacctgacgacagaccgaccggcggatcaacgacaacacaagcccgggaacggcacacacacaccacaagaacccaaagagagcaccacacgcgacga

SEQ ID NO: 599156 - DNA, 403 bp, Homo sapiens
  misc_feature (168)..(168): n is a, c, g, or t
  misc_feature (320)..(320): n is a, c, g, or t
  misc_feature (333)..(333): n is a, c, g, or t
ggaaaactcttgagtggctcaatcttggctctccacaacctctgcctcctggattcaagcgattctattccccagcataccaagaagctgggattacagttttgaagatgaagaaaaaccgaagctataaggactgagataaaatgcccaaggacatatagcttgaanaaggcatggctagaatgtgcactcagtatgacctcagcacccaagctctttaccaatatatgctgcaatcttaggctcatcaactgcacacagtgaattgtggtgctacttcgtctaagcctgcattctccttcagagcctacacctccctntcagctgttttcnccttcactgttccaaaaaaagcagactttgaaaacttaagaaatgacattaaaaaaaatcaaaatcgaaa

SEQ ID NO: 599157 - DNA, 159 bp, Homo sapiens
tggggcactgcttgcatccaaccaccctacactgcaccctaatatgctttgtctggccaaaagcaggagaatggtgttgtttattgaatttatttgttggttgtagaagattctatgtgaatattttatgtgtaaaataaggttatgattgaatctact

SEQ ID NO: 599158 - DNA, 466 bp, Homo sapiens
caggatctcattcatatcacttgctgtcacgtatgcagtatgtacaagtagatacttgggatcagtctcgcactgtatctctgatacagttccttctacgggagtatcattccactaataggtggtgttataaaaaacaaacatgatagcttctcttctccatctctttaagccatctgttccctgtagttctgtagttccttatcctttttgtagaggctctccattttctcctttacactgtcattttaatctgggagtagagagaaagaatctgataactggcaccccctcacaccactaccaccaaagaagccactacgaattcccactgaaaaccttttgttctaaagggagagccagtcctgttcctactgcagtactgtcacctagaaaccaaaattctcagccgacataacatttcaggactaatctaattcctaagaactactcagcacagttcaac

SEQ ID NO: 599159 - DNA, 360 bp, Homo sapiens
gtttctttgacctcccaccccaccctccgcttcctagcctctgcctcccgccgtgccccaggctgtggatgtggacggaagtgggggtcccgcagtggcaggccaagttcacgtcaggcagggcagtgcagggagacagaccctctccgaggctctgctgagcggggacctggaggtgctgagtgccagccactgcggttccacctggtgcccccagtcctgccccagccacagactccacctcaccttggctgccaccaggggacactgcaggctgcagggacagcccgagctccagggtcactgccgttccctgccaacttggaccaggtggacctggtcctccaagggttaactcgg

SEQ ID NO: 599160 - DNA, 315 bp, Homo sapiens
tacgatcacccaaagatctttgagcatcacccaggcctaaatgtccacaggccactcttgtacatgctcttttagaaacaccactctgaaaagatctcgttcgctacgtaaaagaatgactacacatatcatcacaaatgcacactgatcatgactttatttaaaaattaccaaacaatactgtagaaacattgatatgtaaattcctaaaatgcctgcatcttaaatttagttggcaaagaccacatttaccaataaccatgagtttactcttccatgtagaaaccagatacactaaactgtaaaacaaaaaaa

SEQ ID NO: 599161 - DNA, 131 bp, Homo sapiens
gtcgtgtacctgcagctctctctgatgcacacaagcacactgtattcacctgtacttctttcctccccaacccatgccacgctgcttaacgttgtctctatatgctagttttcactgtatttcctgcttgc

SEQ ID NO: 599162 - DNA, 831 bp, Homo sapiens
gtaaggatctacctgaagatggggaatgctcgaaccatacaaacgtccgtaaccctaatgccccgccatacggaagatgagaaaacggggatctgatcgggaggttgcgatcaggtcgcagacccctccatagtattttgaaacgagtccctccgtaccaagcatagcagaatgtgtgcggcctccctggttgtttggttaaacatgagtatgcagcaaaacatattgagctcaggacggaccatgacggacgtgatcatcctcatccttcagactgcttggccgaagagatgttcggggcatcctgtacaaacaataattcatgctatgatctagtacgtattcatctgccctggcctgatgcacatacatcaactgtattgaagaggaatgcggataattagtaacgtcgcgtagtggatagggcgtagatggagtagacgtacagatagatcgacaaccaggggcacgagacggagggggtctcccattgttactatcttgagagctaataactatgagagacgtactgacacgctagaatatttgtagtagcattatagggggtaaacgaccatctattctggtggcgtataatggcgtacgaattgcttattcgagtcgattgactgtgtgatgaggttctattggtgcgccgtatgagagttaacttgatgaggaggacggtagtagagctgaaacaaagtatatgcattatcgggcctagtgagatgtagaataaggggaggaaaactggttactcatatacgggaagggggtctgcagagggaatggtttgggaacattcccgccccaaccgaaaagggatag

SEQ ID NO: 599163 - DNA, 108 bp, Homo sapiens
atttcgtgtcgtggtacatgtggctccctgccaggcgcaagagaaagtataacgtggagtgccaaggctaaaagacgaaataccacgacgacgaattccggcacgaac

SEQ ID NO: 599164 - DNA, 140 bp, Homo sapiens
cccatcagataaggtttaatatatatccaatacagaaatcctattaatttttgtgttggacagtagtgaaatcttgtgatttttaatcgctttgataatacttccaaattttatgatttttctgatgggacgaagactgg

SEQ ID NO: 599165 - DNA, 242 bp, Homo sapiens
tgcagtacatagtacccactcctgacgtcaagtgtgattgagctgtcacagggcaggcctgaatacactctgctttcagcttcgcagctatgtggatgaggcctgactaccgcagcaaaatagatgccaaatacaacccgacgatcgagggaatggtcaggcgacccgatatatctgagatagaagaggccacaataccatgtccattctgcaaatttcttctcccagagtgtgaactcctc

SEQ ID NO: 599166 - DNA, 103 bp, Homo sapiens
tggtcttgtgcaggaaaaaataacatccctgcatctgttataaagtataaatgaagactgtcctagtaaaaccaaaaataaaattcgtgtggtactttgctgc

SEQ ID NO: 599167 - DNA, 775 bp, Homo sapiens
acttacatgcagattttttttcaataaatgatattggaaattttgggagagatttttcaacaatttgaaaaaactcagatgaattgcacagcctagaaatatcaaagaaattaagaagctacttatgtcatgaatgtataaaatacatgtaaatactagtctattttatcacttactaccataaaatatgcacatctattattaaaaggtaaaacttaacaaaacttacctacttacagaccacacgtggcaccattctcagtcaagagaaatgtaaaccaatgtcgggatgcagtctgaaaccgtaactgcataaaattaactatagtacacagtgtgctgttaatgtagccacttcctgttgttactgtagtgagctcaagcgctgcaagtatctgcttaaaacgtgtgtgacactacccatccccgcttcagcagttcatatccaggacatctggtatcccagtaagatggaaaaagtgatttcttgcagtttttgtggtatttttcatcatgcttagtgcaatactgtaaaccttgaatcccaccatgggacccatatgaagtgccactactgatgctggaagtgctcccaagaagcagaaaacaagtcgtgacattacaagaaaaagctgaattgcttgatatgtaccacagattgaagtccacagctgtggttgctgccatttcagacagatgtttcatctcatatgtaaatacagtaaaaaccttacaataccgataaatacagtaaatatattttatcttccttata

SEQ ID NO: 599168 - DNA, 711 bp, Homo sapiens
gctgtataatatgcctggcaacactttgctcaaagctccatcggccttcaccatcagtacaaccccaagtttcagaccctgttccaaccctgtaacttgatgggagctatgcacgaaattgaagacttcaacacacatgctaacattgactgcagccctcataaaactgtccagaacactgccaatgaatttccctgtttgccaaagcaagcggcttgaatcctgcccacaaccaaggttttcatgaactcacacccacttcacaccgcgctccctgaaggccaacaatacccacgataccaccctcttcaccaacgctgacgacaatttgccacctatacgactgaacaattaagaagggactgaaaacgttaaccctctccagaccatctccctcctaccataaaacaccgaacacccactgacagtcacaatgccgcacctctgcgagcaccaaacttcctcacctcacccctgcatctccataccaccaccgccctccctcccacccctacaccgccccgtctacatagatccccccacaacacgcccgccacctatgcccggcctaccgcgtagcgttccaccaaacggataaaagattcctctcccaattctcgcctaactaaccccccacaatcaccacacccaaaccataaacggcgaacgccaacactaaccccaagctactaacacaacaccctacccaat

SEQ ID NO: 599169 - DNA, 390 bp, Homo sapiens
  misc_feature (92)..(92): n is a, c, g, or t
gcgacctagaggacccttttccaatgacaaatgggggaaatcaatcaaacaggtctcttctgaagatttatttctgctctgagctgtactgngtgacctactgctctaattaggctggaaataaacctggctttcatgagatgcaggacacggctggagggaaaaaagttgtcaagactactttaccatcatcaagtgcccacaggcctccagaaccattcccagaatttcattgattcattccataatttcatttcctgccccatttagggccacaaaacacaagacacccagggagaaaaaaacaccactgggctgatttaagctttactgaatctgcccaaggggcaggacaagagaattacacaaaacaattaagtgctgtaagtt

SEQ ID NO: 599170 - DNA, 1387 bp, Homo sapiens
  misc_feature (625)..(625): n is a, c, g, or t
gctggagccggcctgcggacggggccctggagcttgcctgcctccctcgctcgccccagcgggttcgctctgcgcagggctgcagggctgcgctgctgatgaaggctggtgagccctggtgctgccccatctggcctgcaatggcggccggtcggggctgctggctgtgctgtgggcagctggctgctgctgctgccttgtgccgatgcacggtgcgcaacatgctcttggtgttgtgcttccggccaggccctgctggtgctggtgcgtgcctgtgctgtgcctgtgctagtgctcgcgctagctacacaggtgctgtgcgctgacgtgcctgggcctgtgcccggaacggacgccctgggctgcttgttggctctttgcacgttgccgagtaattgagagcggagcctggccttaatagcccagacctttgccggtgaagggccattgggtttggcccccacacgatttaccctggccccaaacgacaccgacacacggtgcaacggcccaaaacagttaggcaagaattccctattgccaatgaccaaccggttttcagtcgggacttacaatttcaccttgtgaagcgctatggcaagactttgggctcggcattggcacntgaaccatgcaaacccgctggggcctctttgcatttcgcaagcggcaaacgatacaaaatcaaagcacctgagcccaggactgccccttgctcaaaacaaaccaaaccacatggggccctggtggagatcactttagctccccaagtgccccaggcgggccccaggaccactgacgaggaggaaccaccaacccggagttacgaagttttgggctggtccttcaaaaacaaaccgtggaaatctcacggcggtccctgcgggtcggccggtgtttacgaacacaacccactagtgctcaacgtgtgggccggaacgcacacgacaagattatcattttgctatcgcccctgtgtttacgaaaggccaccaggggctaggcactttgggtcccacaacgcgggttcagtatagccgggggaccgtggcagtcacttaagcgcaagtagtagattacccacacgatcagagaaaggggcgggaggcgcccccagaagcatgaggcatttataccagtgcctctgttaacacgccacaatatgctctattactccttttcggctaacaccacaaggacgaggatgtgtggataccgccgccattaaatttaacagcgtcagacccggtaccgcgcataattccaactgtaacaccggctctaacgggcggaccacttttggggacccacgatcacgagtcatataacccaacagcccgcgtgtctctgcgttcggcaccttctggtcgagacaaacacaaccatg

SEQ ID NO: 599171 - DNA, 645 bp, Homo sapiens
  misc_feature (270)..(270): n is a, c, g, or t
ggtagggaatggcgcctcccgcagtcgctcggaactgccgacccgtagtgcttcccgctagagggcgtggtggtgggagcggagtgggtctgggcggggcctgagcctgggcctggggccgtgttgggggtgccggtggctgtgatgtgactgggcctgcggaggacctggtggggattggtgcattgcagctctgttgatgctgccagaaggacacaggctggtgtgtcggatgcggctcttagaggacttgaatctgacatacgatanccgttgcgggggaaggaacgggtgacgcaagaaaaggtgcagtgccggtcggggcgaatgcgctttgaaacgctttggcataggctagtctcgcggagtttggcattgcgagtggaggttctacggggacaaagcaggcattgcgagtaccggtacaaatggcgaaggaataggaactgcattgcgattacccaaccgacgcgtatcgtgcactaactcccagcagtgcagcggatagtggcccgcggggagagtgacacagagaggccggggtttgcttgtaatgagaccagacagaaggccaatccccagttcacaattccatgggggccaattgtcagaagcacgaagggactaaacatgcgaatgatctgg

SEQ ID NO: 599172 - DNA, 619 bp, Homo sapiens
  misc_feature (92)..(92): n is a, c, g, or t
  misc_feature (129)..(129): n is a, c, g, or t
tgccaaaagtgttgttcatatacaaaaaacaaaaataaagggattggggccaatccttgtggaagaaaggcgtaatcttcaaccaaatctcntcaatgagacccatgccccttgcaattaatccatacnacaccatcatgtgtggcatgttgccaacgtcccagttgtactgtccactccagtagtatcttccgtttggaatgcatgcatgacatcaattaatacaaccatccacccccgtcttctttagaacgctgtattctgggatctagtgttaccagcacgtcgttgtctcccatcagctgagatgctccatccatgagggcattacgggctgatcctctgtatttgttcaatgagatctggcagttgttggcttcattctgtgcagtgaatcgtccatagttagcctttcctttgtctgcatgccgagaccgtggcgttaagttctgttctctgtgatagaaatagcaccgctttactgtttagagtaaaggactcactataaagagtgaacattatgcaacatcacgagtcaatatacagtcacggaatataagattcataaataacatggaggataactgtaacagtgctacgagatttagcagcatatacg

SEQ ID NO: 599173 - DNA, 342 bp, Homo sapiens
cttgccaagagacctctaagtgcgcaacatccaaggtgttggttatgttggaccagccacaaatccagaagttcaaaaaggccttcaccatgatggatcaaaccaaaaatggtttcttcgacaaggaaaattggcaggatttgctggcttcattggggaaaaatccacctgatgagtatttaaatgccttgatgaatgaggctccaggccccatcaatttaaccatgttcctcaccatgttgggggaaaagttaaatggcccaaatcctgaaaatgtcatcagaaatgcctttgcttgctttgttgaaaaagcacctggccccatccaggaaaattacttga

SEQ ID NO: 599174 - DNA, 338 bp, Homo sapiens
gcgtcgacatggaaaataagatgttttttttttttcggaaaccgtacgtgatctcacagcagcagacgactgctggtagatcaaaagggggaggtgttgagcttcagagagaattgaccttaataagatgataactgcaaaatgtgtttttctcaaaacaggtttagctgctgaatttctgacttcatcaaatgatccaggagcaattaatgaattaaggaatgccttaaatggtttggcattcaagtgccattggaatctggataaaaatggattttatgagatacttttgtaactaactaactgtaacgtaactctgttaacagattgattccttt

SEQ ID NO: 599175 - DNA, 141 bp, Homo sapiens
ggtcattagcttcatatacttttgacttatggggcataaataacttcatagtacctgaggcggatttatccgaacttcgtgctctgtggttagattaaccgctttaatcactattaatacacataggggaatcagttagtc

SEQ ID NO: 599176 - DNA, 849 bp, Homo sapiens
agcgggtccgtccgcccgcgggtgccatcatggcggacgcggccagtacaggtgctcctgggctccggtctcaccatccgtgtcccagccgctcatgtacgtgaaagtgctcatccagcgtgggatatgagacctcttcctccaacaataggacgaaaatatttttgggcggcaagtgtgtcagcttcctggtctcttaagttatgcgtcagcacatggccagtatacgatgggaaggcgcgggtttgttcacaggacttaactccaagactgtgttcgggagtccttggaagctgtggtccatgggtaagagttttacatgctagttaccaggagagtgacgcagggtgaggagttaggacctggaaatgtacagaacagaacgtgcgtcatcttccttgtgaccaggtgtatcaaggagacgaactcgacgagatgactcgctcgattgctgctgctaccctgcatcacacatcccttccatgtgatcactcggagatctatggtacagttcattggcagagaatccaagtactgcggacttcgtgattccataataaccatctatcgggaagagggccatctaggattgttcgcgggtcttgtcctcgccttctaagtgacatccttgctatgtggctgtggtaactcacgggcctacctcgtgcaataactatgccatggacagtggggtatctaaccatgaatgacttgacgacgtcaatctcaagcctgtcacaggaattttggcaatactgttgaacctaatccctttggtctggctgcaactccacatggctgttcaacaactggtggctcgcagggtgatgcctctttatccccacatat

SEQ ID NO: 599177 - DNA, 450 bp, Homo sapiens
  misc_feature (402)..(402): n is a, c, g, or t
  misc_feature (416)..(416): n is a, c, g, or t
  misc_feature (425)..(425): n is a, c, g, or t
tgcaagtccgcctaccagattctggtgattcttgtgcctcagcctcccaagtagctgggattgcaggcgcccaccaccacgctcaggtaatttgtgtgtgagtgtgtgtctatgtatatatatatatagagagagagagagagacacacactcacatgttttggggtttttttgttttgttttgtttttcttgagacagagtctcgctgtgttgccagggtgagtactgtggcgtgatctcggctcactgtaacctccgcctcctggggtccaagcgattcttctggcttcagcctctgggagtagctggggactacagggcgcgtgccaccaagcccagctaatttttgtagttttagtaggagatgggggttttcaccatgttgggggcaggatgggtcntcaatgtatttgantttgtgatncccgcccttcttcgggccttcccga

SEQ ID NO: 599178 - DNA, 88 bp, Homo sapiens
tgccagatgcctttggagcaggtgctttctgggctggagcgctttgccccttgtgttgtcttctcgcaggtgtatagtagtagtaggc

SEQ ID NO: 599179 - DNA, 286 bp, Homo sapiens
gtcgttttacttggtgtagagctatgtgcgtggctccgtttttattccggcagactgctagtttcgtcactgctgttccatctgctgcagtctccgagacgtcctcctgcttctcccggtaggctgagcctgtagacctgttcatgctccacctcctacgctgctgcctgtctgctgggccccctccctgcctgtgcttacaacacttgcatccaggactctacacagctatgctctgcagagccctggactcttggcgaaacacagggactgtgttggggggatc

SEQ ID NO: 599180 - DNA, 219 bp, Homo sapiens
ggtctaaatagtcgtatcactgtacgaaattcttaattacaagaattaccaattgagaaatagaatgcagctcattatgcaaagagacggcgacttcatcggcgtcttgaatagtctcctcggcgttaatactcttggccgagttgtactggatcaatagaccaacaatttattgcatcatttgtttctgcatcgagacatatggcacagggcggtgac

SEQ ID NO: 599181 - DNA, 171 bp, Homo sapiens
cattaggcaaaaagaaaaagaaaaaaggttattttaagacatgctacagataagtttgtctttggtatctgaagagagcttgaggcctaacaacttaactttaacattttatttttgctgctctggtaggaatgtctctgaaagttattatgaggctttataagcatcaga

SEQ ID NO: 599182 - DNA, 447 bp, Homo sapiens
agaatgttagagcatcaatattgtagaagtgtatttttcaccatggaaaggccaaattccctgtacgcctaactccagaatatagaaaatatcttaatcgcctggaatctatttgagttactagctgatggtcaattaaattgtcctgatatccaatgctattcaatatggttactaccaagggactctcagaaatggctactaaaagccactgagaaggcctagatcattcatattgtacattgacatttttacataaatggaattaatactacttaccatttgagtaaagaacacaaggaattgaagagtctgtgaaaatatgtcctgtttgtgaaaggtgaaactgtccaatccatgtccaatcaatgtcagtcgtccagtatcggtggtgattattaaacttattggaggtacaactttacctccaataagcttacctttacg

SEQ ID NO: 599183 - DNA, 792 bp, Homo sapiens
  misc_feature (8)..(8): n is a, c, g, or t
  misc_feature (19)..(19): n is a, c, g, or t
  misc_feature (28)..(28): n is a, c, g, or t
  misc_feature (33)..(35): n is a, c, g, or t
  misc_feature (43)..(43): n is a, c, g, or t
  misc_feature (45)..(45): n is a, c, g, or t
  misc_feature (47)..(48): n is a, c, g, or t
  misc_feature (56)..(56): n is a, c, g, or t
  misc_feature (62)..(62): n is a, c, g, or t
  misc_feature (75)..(75): n is a, c, g, or t
  misc_feature (83)..(83): n is a, c, g, or t
  misc_feature (100)..(100): n is a, c, g, or t
  misc_feature (106)..(106): n is a, c, g, or t
  misc_feature (111)..(111): n is a, c, g, or t
  misc_feature (118)..(118): n is a, c, g, or t
  misc_feature (120)..(120): n is a, c, g, or t
  misc_feature (128)..(128): n is a, c, g, or t
  misc_feature (136)..(136): n is a, c, g, or t
  misc_feature (139)..(139): n is a, c, g, or t
  misc_feature (157)..(157): n is a, c, g, or t
  misc_feature (164)..(164): n is a, c, g, or t
  misc_feature (170)..(170): n is a, c, g, or t
  misc_feature (176)..(176): n is a, c, g, or t
  misc_feature (178)..(178): n is a, c, g, or t
  misc_feature (189)..(190): n is a, c, g, or t
  misc_feature (197)..(197): n is a, c, g, or t
  misc_feature (202)..(202): n is a, c, g, or t
  misc_feature (221)..(222): n is a, c, g, or t
  misc_feature (235)..(235): n is a, c, g, or t
  misc_feature (238)..(238): n is a, c, g, or t
  misc_feature (241)..(241): n is a, c, g, or t
  misc_feature (269)..(269): n is a, c, g, or t
  misc_feature (277)..(277): n is a, c, g, or t
  misc_feature (279)..(279): n is a, c, g, or t
  misc_feature (286)..(286): n is a, c, g, or t
  misc_feature (298)..(298): n is a, c, g, or t
  misc_feature (304)..(304): n is a, c, g, or t
  misc_feature (316)..(316): n is a, c, g, or t
  misc_feature (319)..(319): n is a, c, g, or t
  misc_feature (334)..(334): n is a, c, g, or t
  misc_feature (340)..(340): n is a, c, g, or t
  misc_feature (349)..(349): n is a, c, g, or t
  misc_feature (360)..(360): n is a, c, g, or t
  misc_feature (368)..(368): n is a, c, g, or t
  misc_feature (375)..(375): n is a, c, g, or t
  misc_feature (381)..(381): n is a, c, g, or t
  misc_feature (400)..(401): n is a, c, g, or t
  misc_feature (403)..(403): n is a, c, g, or t
  misc_feature (434)..(434): n is a, c, g, or t
  misc_feature (460)..(460): n is a, c, g, or t
  misc_feature (481)..(481): n is a, c, g, or t
  misc_feature (484)..(484): n is a, c, g, or t
  misc_feature (502)..(502): n is a, c, g, or t
  misc_feature (524)..(524): n is a, c, g, or t
  misc_feature (536)..(536): n is a, c, g, or t
  misc_feature (543)..(543): n is a, c, g, or t
  misc_feature (580)..(580): n is a, c, g, or t
  misc_feature (613)..(613): n is a, c, g, or t
  misc_feature (615)..(615): n is a, c, g, or t
  misc_feature (620)..(620): n is a, c, g, or t
  misc_feature (644)..(644): n is a, c, g, or t
  misc_feature (656)..(656): n is a, c, g, or t
  misc_feature (661)..(661): n is a, c, g, or t
  misc_feature (669)..(669): n is a, c, g, or t
  misc_feature (672)..(672): n is a, c, g, or t
  misc_feature (721)..(721): n is a, c, g, or t
  misc_feature (724)..(724): n is a, c, g, or t
  misc_feature (766)..(766): n is a, c, g, or t
tgctttcngaattcatgantcttttttncattnnntttttttnananngggttttnggtggnttttgccaatttngcccaaantgtcatcgtcttttttntcttgntttgnatgtgcngncctgtgtngccttgtntcncctggccttagatttccngggcccnattctncctttncntctttgttgcnnttttccnatttngaatccctgtcaatcttannttctgccaattgnccntgntccccttttgctttccccttcttgcccncccttttntnccgtgcngtggtcttttcngggatnttccccttcccnggntcttccttggttctncccggngccatgggntcctgtttccnctgctgtnattcctntttcgnctggggtttttctggcacnncnggctcccggggggctttgcttcccgcccaantcctgttgtccgtgtgggggccaagncccggtggggtgggatctggnggngtgcctgtctcctgggtngctgtcttctgggacgtgtccncctctgagtganaaaattngagccgaatatgccatgctaaactgcatacagctganactgtcttgaactgatgaacaacattccttggnanaaaanaaatgtcattatcatatagctgantcctggcatagngaatnccttcccnccncagttgattcagttttgcatcatcaacccattggacacactgggacagnggnggttcatgtaaatctaactgcattcgttgaactacttctaanaaatcttcagcatgaaaacaaattac

SEQ ID NO: 599184 - DNA, 236 bp, Homo sapiens
gagaattcctatggatacatttatagttagcacaaaccctaacacagtaactagtagcacacccataccagggtctcgcccagtggcacgcctaggattatatagtcgcacaacacaacaagttaaagttgtagaccctgcttttgtaaaccactcccactaaacttattacatatgataatcctgcatatgaaggtatagatgtggataagacattatatgtttctagtactgat

SEQ ID NO: 599185 - DNA, 491 bp, Homo sapiens
cgcgggccgctggtcaccatgaaccacattgagcaaaccttctgtcctgtgaacagcatacagactcccaactacgagatgctaaaggaggagcaagaagtggatattctgggggcgtcccacaaccttgctacccatacgcacaccggaatccacatacgcagcaagacctacgtgctcagaccacatttgtttggcacatgttgaacaccctctatatgacacctgctgccaggctttaataacattctcatactccgctaagaataggtacaagaagatggataccatctttaccggagaccaaggctaattcctacactgtcaagagcctgaacatcggccgcctgaaagagagcatgtatactgaccattctgctaaaggtgataccgataggctgacagatcccaatgtaccacaagagggcttcattgacgtcatgatctcttgccgtgacctttatccaacaatctatagatcttcctcgctg

SEQ ID NO: 599186 - DNA, 93 bp, Homo sapiens
  misc_feature (29)..(29): n is a, c, g, or t
  misc_feature (49)..(49): n is a, c, g, or t
ggatggactggctttgagtgtagcgttancccagcccctgaacagggangagcgccctgtgattgtgctctactacttgatggctgccatggc

SEQ ID NO: 599187 - DNA, 294 bp, Homo sapiens
tccccagttaaaaaacttttaatggccccggaacgccccattgtaacgggcaggcaaaacacctctccttttcccaggctcattcaatttaaccagaaaacaggggagcttctccttcaccccagcctgtggccctgtgttgcctccccaattggccccttgcgaggccccttacacagtggcctgcctgtgggaaacacaaatatattgacaggaacacacgtggactgatatacagaaagtgaggccagaacaccacccaattgcctggtgtgcccctcccaagaaagcgac

SEQ ID NO: 599188 - DNA, 682 bp, Homo sapiens
cctgtacattgaggcgaaagtcacatggggagagagtagtacaacaacgattaaaaaaccttatcttggccagatgtggaggctcacgcctgtaatcccagcactttgggaggccgagacgggtggatcacctgaggtcagaagttcgagaccagcctggccaaaatggtgaaactccgtctctactaaaaatacaaaaaaaaaaaaaaaagaaagaaagaaaggccaggtgcagtggctcataccttaatcccaacattttgggaggccgaggcaggagaatcacttgagcttaggagttcgagaccagcctgggaaacagagtgaaccctgaccctaaaaaataaccacaaataataacaacaggcagggtgtggtggctcacacctgtaatcccagcactttggtaggctgagactggcggatcacctgaggttgggagttcgagaccagcctggccaacatggtgaaaccctgtgtctactaaaaataccaaaattagccaggcatggtggcgggcacctatgatcccagctacttgggaggctgaggcaggagaattgcttgaacctgggaggcggaggttgcagtgagccgagattgtgccactgcactccaacctggacaacagggtgagactccatctcaaagaaaaaaaaaatctttttttcttcgactctaa

SEQ ID NO: 599189 - DNA, 724 bp, Homo sapiens
tgcaggtgtctccatgagggatagtacaggtttcagagggataggaagttggtgcaggtaggtcgtaagggaagtaactcttccccttctgtattctaagcctcctttcgtcacagggtctaagagaaaggccagtggccatgggtcaaagcaacaatcctctctggaagtggtggggatagcaccagcttgtcgctgggaagagatccactgagacattgcttctcttgtccttaaactctgggctgcctaatggtgaaacttctagtcggaggacagtccaggttgggcagagccagacatataccatggaagaagctgtcccaagtgagagagtgttaggtcataacggagtctgggcaggcagtactggagcttggggacttccttgccttgtggattccgtgagggtgaatatcacaaggtttcggtgtgaattctcagctgttaagcactgtgggcacctaggccgaggaagtgaagtcacttcccgcttcatgattcccagtacgtgtgtgacctatccagaggagaaatcacgtcctttggcatcctcgttggataccaagactgcagagcagtgatgacctcagcaattggagtctctgtatcaggccagtcttccgggctctcaagctggctgtcctggatgggggccgcggatacgtctggctcccatttgcgaagaggctcggcagatggatggggagggggttgactcggc

SEQ ID NO: 599190 - DNA, 710 bp, Homo sapiens
  misc_feature (27)..(27): n is a, c, g, or t
ctaaccttctaagcatttgggggtggngggaaataccccaagacaaggtgttttttaatttgaaaagagaggaatattggccgggtgtcaagtttgttccaaaacaacgactccaaagtaaaagcgcttggaacccttcctattgtcccggaattacaggcattgggacctggcggccatccctttgggtttttttggcctggaagcccaaccgccaattctccccctttcctggaaaaattttgtttcataaacacatattttccccaaacgggtctattttactcaataaatcatatattagacccgcctatagtcaaataatttttgttaaaccataccgtctttagaccagctgtgtagtgattagtcgcaatatgtctcaaaatgtatgctccaagcactctcatccattttagcttgatgcacggttttttcacatagcttaaaaagatgcgctcttgtacatagttctggaacgtagcttcattctccagataactatcatggacacactttagggcgcttgtttcaggtaggggtgtatacatcccaggggcgtggagatgagcattccactgagcaagtagaaagatgattttttgtatttaatctcatcctttttaattgcgatttttgtgtgttttataatgtacataatatgttgcacaattgcacacttctattacttataaaacaacattaattgg

SEQ ID NO: 599191 - DNA, 637 bp, Homo sapiens
taatgtgttgccgtgcaggtaaaggcttactaaaattgtgaaaccttggcttggattaagggcgacagcgatttctaggatagtcagtaaaattagaattgtgaagatgataagtgtagagggaaggttaagggttgatatcgctagggtggtgcttccaattaggtgcatgagtaggtggcctgaagtaatgtaagcggtaaggcgtacgggccaagggacttatgggctcagaactgacctagcgcgtgaagtggttctcgacataagtaacctagctaggtgggagactaagggggatgctaggtaggcgcccatagagggagtacacgaaagagcgcggcaaagtagccactcagcaacatcactaagacgcgaaacgcctcaataagcaccagctgggcgaccacgggttacacattaagcggaggagaataagaaccacaacgagggaaaaagagacaacaacaaagaacttaacgatgaagggtcagggaagcaggtaagataaaaacactgaaaaatgaaacagacgaaagcagacccccagaaaggacaagagaccacgaaatcgtgagagacacatcaaacacaaacgagaaatacaaaagagcaacacccaaggcaaaaaagaaac

SEQ ID NO: 599192 - DNA, 395 bp, Homo sapiens
ccagatttatttcaaatttcataggtattctgattttttttatctgcctcttgagctagaggtaaacccgacaaaaagagaaacttgatatatcttgttcactgatctctcacagtgcctggtaatacattgtcaattaaatgaatattaaagaaaataaacggatgaataaaggcactcatacataatatatgcttacatgttaaataacactaatatacatttgaatttattgtatactgttgatatgttatcctgaagattatattttctttctttttttttggaccaagtcattttaccatactctaatgggaaggcccaccaggaaccagggccttaagcatgcatgtatggtaaaattttaaatacaagcaaaatattaataacattat

SEQ ID NO: 599193 - DNA, 403 bp, Homo sapiens
cctgactccagatatcaccgggcattcaacatacaaactgatagcacacggagtaccggaaaacgaaatttagcatatacccattgctcacgaaacaaaatgtccttgtcgatatagggctgaactcgcatggtgtacctcatctactgcgacaacttgaccttactctcccatattgcagtcgcggcacgatggcaactaaattaataggcatcaccgaaaattcaggataatgtgcaataggaagaaaatgatctatattataagtctgtcctatatcaccacaaaatggcacatatagaacctgatgaaacaagcatgtcatcgtaatatgttctagcgggtttgtatttatctcgagagattattttcataaagctgcagggacccactcgggggatcc

SEQ ID NO: 599194 - DNA, 807 bp, Homo sapiens
  misc_feature (36)..(36): n is a, c, g, or t
  misc_feature (89)..(89): n is a, c, g, or t
  misc_feature (98)..(98): n is a, c, g, or t
  misc_feature (117)..(117): n is a, c, g, or t
  misc_feature (193)..(193): n is a, c, g, or t
  misc_feature (208)..(208): n is a, c, g, or t
  misc_feature (236)..(236): n is a, c, g, or t
  misc_feature (253)..(253): n is a, c, g, or t
  misc_feature (273)..(273): n is a, c, g, or t
  misc_feature (332)..(332): n is a, c, g, or t
  misc_feature (425)..(425): n is a, c, g, or t
  misc_feature (438)..(438): n is a, c, g, or t
  misc_feature (443)..(443): n is a, c, g, or t
  misc_feature (457)..(457): n is a, c, g, or t
  misc_feature (460)..(460): n is a, c, g, or t
  misc_feature (536)..(536): n is a, c, g, or t
  misc_feature (538)..(539): n is a, c, g, or t
  misc_feature (541)..(541): n is a, c, g, or t
  misc_feature (550)..(551): n is a, c, g, or t
  misc_feature (574)..(575): n is a, c, g, or t
  misc_feature (632)..(632): n is a, c, g, or t
  misc_feature (700)..(700): n is a, c, g, or t
  misc_feature (737)..(737): n is a, c, g, or t
  misc_feature (780)..(780): n is a, c, g, or t
gttttatatttaaaaaaaaaaaaaaaagctaaaatntatattggatatattttctataactttctatttgggaaactattgtttaaaangtccctggncaaataactcccaaatganacactcaaccctaaggatgttttcagcccactgttagtgaagctgggtgcagaatgcaaagcctctaaaaggagtngatacaatgtcaggngagtaggggccattggcaatgctcaganccagccagactccaaanagggagcccaagtggttttnttctgggacactctacttgaattattgtttaattagtcaaccatagatcttcaaaaganaacaattagttaacatgataaaaagtgactgcattctttggactgtatcataattatagtaagcaaattctgacagttttaatgaaaatagcntccaccattttgnaggtntgaagataacttanttntccacagggcttttaatgtctgctggacaatacatgaatgataagctataaatgacattgttttatgatataaaantnntngtttttttnnttttttatttctataggcattgnntgtttgagtcaaggttaggcttgttaagtgattaaaggcaattttattacagcagcntgtacttattcttttctaaaagaatttttttcataaacagaaacaggttttatatttgtttgcaaccngcaaaattgaattattttgctgatataaaatactaanaactcacttgaggaccatgccaccttctgaaaaggccacacanctacttcttaaatgtgttaaagttaca

SEQ ID NO: 599195 - DNA, 319 bp, Homo sapiens
cattactcatgcctgattcacgagttatccattggcacgcgtactaccactatgactatgtggacaccgtctccacaattatcagtcgacaacgtccctgccattagtgaggttaccgacatctcacttgaaagacatttctgtcttcactccggcagaggacttccgggtctaggctgggagagagccccttggacatgcctgtcctgaaagcggctgcctctcatcatccattcccaagatgcctgatcagaaaccaaccatgaatgaacccctggctccttcatcactccccacgattgggtactacgctttggca

SEQ ID NO: 599196 - DNA, 1907 bp, Homo sapiens
  misc_feature (101)..(101): n is a, c, g, or t
gaggaagggagacaagtgagaagggaaactcggaaagagccaaagggaggaaacggcagagccagacgacgacacagacggacacgacgacctgaagtgtngacaggacgacgacggaccacatggggactgactgacgacgaccagacgacgacgacgacgacgacgacgacgacatgacgaccagaagacttacaggaacgacgacccgctgtgacgtcttgacatataaacacgaccttctgggaccaagacaagcacgaccaacgacttgcgacgacgacgacgacgacgacgagcgacgacgcacgctgaccgtgacgacgacgacgcactgagaaaagacgaccacgacgaactccgacgaggacgcaccagcagacaacggtgacgacgtgcggcgacagaacgaccgagtaacgctagctaacacacagggacacagacgaccgacagaacgaccgacagaacgaacggcagaacaacgacccaccataggcgaacgacaccacacggacgaaccacgacacacgatagatagatagcttgacacgcacagatgatgaacaacgacagaacagacagaacttatgaacagaacaaaataaaaatagaaaagcgaacgccagcaaagaaacaaagaacaatacaaagacacagaaaaccaataccagaagaccagcagacccggcgaggagacaacacagattagacaaccgacaagagggataagcacaccagagcaaacacgacacacacccaacacaaagcgcacagcacgcaacgtagctgtagaggaccaccaccccccgcgaccgaaagaccgaagctatgagacaaacaagacccagaccaacacaacgacacgtcgcaggcgccacaacaaagaaaaacaatagaagcaagaccgaagcagcatacagcccgatagccaatccgcattgccaagaccaatgaagccgacacgtacctccgttcagatacagcatcccattcagggcagacaaacaagcaaagaggccagagcccattacaccagacgaaccaaagtcacactaacacaaacaccagaccatacgcaacaagcgacagagccaaatagaaaagcgcgacgcccaaaacacgaaaaagccgccaacacgcacggagaacacacgaaaaaccccacaacagagacgtacgcgaaccgcgaccatatataaggaacggcaaattacagctcaaagagcccaaaataatagcaagctatccaaggatgacacgaagaagaaatatacaccaaacacaccatatctccgcgcaaagtcgagccactcagtttccctagggtacagagagtcagagacattcaacatataacctgaccaaagccacacagcgcgacaagaacagcgcacgaaaggtatgctacgtataacagagaaggagacgatcaggattaagcacccagcgcaataattacaccaaatataatacaaacaaacacacaaatcttcgaggagtcaggtgtaagagaaagaccctaacacacgataatgagtgtcaagataagatacgcatcttcgacaactaatcagcgacagaaatgaccgtccacaccgccggaaggagacaaacacagaaacgcaccgaaaaaaagacagagaacgaggatgaacacgacggtatacaacgagaacaatgcaggagcgagagagtgaagctacgaggcgatgcagacgagacgagtgctctctctcccgctcagctaagtcgagtgcgatgcaaacgatatgtcaagcacatagagctacaagtagaaacacgctatgacacgacgactcgacgtcatcacaggaggagagcaggagctcagagaagacacacgtcaggaagacgacacacgctggaatgagaacagaagaaga

SEQ ID NO: 599197 - DNA, 825 bp, Homo sapiens
atgtgagtctgtaggagatgacgcacccgggtataacgcgcgggaaatttttatggtaccgaggggaaccccctggggggccccgcacgtgggagggcgcgcaagcgtcccgggtttgtgaaccccctctaggcgtgtgtcgttctaagtatttaagtttttgaaagcgcgcacgccgggttcgggaccatagtgcttcgaaagaggtcatggggtgtcgttcgttgagaacgtgcggccccgctcggagttgtcttcgtcttcacaccacctggggaggacgtgtcagcaccatgatggtgtccgctgaaaattacccctctttatggggcgtaataccccaattccatctggaacacacttggggcttgataaaccccggaagagtgtttagaagcacaagggcgttggtcctaagtaattggttgtccacaccgccgggaaccacatttcgtggaggaccaccaaatgacgttcccgacgctacacgcgcaaagctgtgttagaccaaatgctcgaagggcccgttaatgttcgtggagaaaaaattaaagagcggttgcctcaccgaggagttgtatgcgttactaagctcggcaaacaattcattgtgcttagcaccacagtggtcaatacgtagagtgaagaggcccctcgactgccatagtggggctaacaaaagggggatacgcccactctcgggaacgagattcatagagtgaagttcaacaccactgcactgggatatgatcccattgtccactctccggatgtcgtcgtgaggggctcgcgaaataaatcatatcgccgccccacatagacagc

SEQ ID NO: 599198 - DNA, 242 bp, Homo sapiens
ggagatggaccttgtgcacgctattgaggccctgccagggtccggccacctcactgccttggaccaggacctgctgcttgtgaaagctacctctgctgccaccctcagctgccttggggagagcctcaacttgttacagcatgagtgtgcaccaggcggaccagcccagccagaagccaggagcctcggaaaacatgctgtgatggcacgggtccaagtcacattccacagagcagctgaaa

SEQ ID NO: 599199 - DNA, 109 bp, Homo sapiens
tttggcattccaagtttgtgtttttttaaatccttggaaaaacggctttggaaaccttttttttcctttccctcttttttatgttgtaataaacattcatgtgccctta

SEQ ID NO: 599200 - DNA, 87 bp, Homo sapiens
  misc_feature (41)..(42): n is a, c, g, or t
aagtaatgatcattccccaaaaatgttctgttatcaactgnntttataaaaaatcgattgtgggtagaagcagagaaaaggcactta

SEQ ID NO: 599201 - DNA, 376 bp, Homo sapiens
  misc_feature (2)..(2): n is a, c, g, or t
  misc_feature (110)..(110): n is a, c, g, or t
  misc_feature (121)..(121): n is a, c, g, or t
  misc_feature (129)..(130): n is a, c, g, or t
  misc_feature (146)..(146): n is a, c, g, or t
  misc_feature (151)..(151): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (206)..(206): n is a, c, g, or t
  misc_feature (215)..(215): n is a, c, g, or t
  misc_feature (226)..(227): n is a, c, g, or t
  misc_feature (236)..(236): n is a, c, g, or t
  misc_feature (256)..(256): n is a, c, g, or t
  misc_feature (276)..(276): n is a, c, g, or t
  misc_feature (315)..(316): n is a, c, g, or t
  misc_feature (373)..(373): n is a, c, g, or t
gnctttataggaaacaaactaatcaaagggaaaaaacaaaaaatacagatattatacccaaatggataacgattatataatcattcttactccaaaaaaaactgtattangtataaacaantataaacnncagataaataggccanattcnataaatactaatttgttatatacaacacataaacatctacaaatacnantnatangataatacntttcaaaatanntcaaacaanttatttttttccttgtgctncaattttctcatttgctaanttagggacttagcccactattcatagatttacgtacgcnnattaagttctttctccttgctgacaagaatgtcaaatcaggcacaccggggtttatnccc

SEQ ID NO: 599202 - DNA, 381 bp, Homo sapiens
tcagctactcgggaggctgaggcaggagaatggcgtgaacccgggaggcggagcttgcagtgaaccgagattgtgcgatgcattccagcctgggcgacagagcaagactccgtctcaaaaaaaaaaaaaaaaaagtataatgggatcgtttataactcaaataataaatacttgaggggatggataccccattcttcattatgtgcttttccacacggcattgccagaaattcaaaacattctcaaggtaccccataaatatttacacctactatgtaccaacaaaaatttacaaaataataataaataaatacataaaataaaatatatattgcatgccacagggaaaaaaatcactctattttataataacagccaaag

SEQ ID NO: 599203 - DNA, 336 bp, Homo sapiens
gtgcgtgggtgcatcatgtggcatatgcatggggatgcatgaagatgcatgcatggggcatgcaggcaggcatgatggggcatccatgaaccatgcatgcatggggcatgcatgcaggaggcatgcatgcgggcatgcatgcaggcatgcatgcgggcatgcatgcacagcatgcattcatgcggcgcatgcaggcaggcatgcatagggcgcatgcaggcagcccatgcatgcgccgcatgcatcgcatcaagggcatgcaatggcggccatgcatgcactcacagggcatgcaatggggcgcatgccactgcagcgcacagcactgccatgctg

SEQ ID NO: 599204 - DNA, 117 bp, Homo sapiens
  misc_feature (1)..(1): n is a, c, g, or t
ntgagtacatgctactgggtgaggtacagctacgggtgattgtacagctacgtggtgaggtacagctacgggtgacggtacagctacggttgaggtacagcctacgggttgaggtac

SEQ ID NO: 599205 - DNA, 609 bp, Homo sapiens
gacccggacaagtggattcgcgtacaatcaactcgccatttggcagcccaatttggatgtacaatgatgagccggttcatcaagcaaaatatatcttcttactcaaggtctggcgtcctatctcctctatgacgttcccttgtcttcttccacttaatcgtcttcatatttcctatcatcatcctcatcctcttctttttcagatctctctaactccctctgttcttcttctttgttcctctactttaagctgtatagtcaatcgggctataaacggggatttgaatcctttggaactaagagctcgactttctaattcttttcggaggtcatttaccttcattgtctattggatcaagttaagaccaatgggtaggtgtagaaatatctttagcttcaccatcatccttctcttcttcatcctgttctccatcagcctccttgcgttcaccctgaagcttctcgaccatatgctgcttgtatcctcgggagagggtttcccactctgagcgggtgggaaggcaatgccaaacatccgggaaaaataaaagcactgtctcccacatgagctggaactgtacgccccttgagggtctcctcaggccgatg

SEQ ID NO: 599206 - DNA, 109 bp, Homo sapiens
  misc_feature (7)..(7): n is a, c, g, or t
ccaccanttgtgcggcaaaagaagccgaaggagtacaggtgctgcaatgatgttagctgtggccactgtggattttcgcaagaacattaataaactaaaaacttcatgt

SEQ ID NO: 599207 - DNA, 529 bp, Homo sapiens
acatagcgatttgacagtgaagccagagggcgatagatgatttgttcaacgtagggcttgttctcccatcgctccttcttttcgtatgcctcaatttagaagtgttaactaattctgcagtaggatcaactatttctgtatcatatgtgattatctgtattagtgacagatcccagctggtgaggtagagaaaggcatatggaagagaaggttagcgtatttacaaaacgtgcttctgaagcactagcttcaagagagatactaagtgtatctcacaaaatgaaagtaccgactggtattagtatctgttgccacaatacaggtatcattttagagttgtacttgctcgtatttaggtagtcactcttaacttcaactttcaagaagttcataagctttttaaacttgaatgtgaccttgataaaatgaagagaaaacttaagcttgagttgaccactgttatattattactactttgattagttgatttttgtgcttaaagcaaactcccaaagtttgcagagtactc

SEQ ID NO: 599208 - DNA, 317 bp, Homo sapiens
tcgataagggccacaatcaaatgggagtacattcgtggtgtactgactgtacgtactctgtattcattgtacttggggctatggtggttgatatatctttctcgataacagtaccatgctgttttggttactgtggccttgtaaaatagtttgaagtcagatagcacgatgcctccagctttgttctttttgcttgggattgtcttggctatatggactcttttttggttccatatgaaatttaaagtagttttttctaattctgtgaaggaagtcaatggtagcttgatgggaataacatttggccccttatcgag

SEQ ID NO: 599209 - DNA, 1018 bp, Homo sapiens
  misc_feature (5)..(5): n is a, c, g, or t
  misc_feature (7)..(7): n is a, c, g, or t
  misc_feature (9)..(10): n is a, c, g, or t
  misc_feature (13)..(13): n is a, c, g, or t
  misc_feature (21)..(21): n is a, c, g, or t
  misc_feature (35)..(35): n is a, c, g, or t
  misc_feature (224)..(224): n is a, c, g, or t
  misc_feature (244)..(244): n is a, c, g, or t
  misc_feature (282)..(282): n is a, c, g, or t
  misc_feature (304)..(304): n is a, c, g, or t
  misc_feature (306)..(306): n is a, c, g, or t
  misc_feature (370)..(370): n is a, c, g, or t
  misc_feature (385)..(385): n is a, c, g, or t
  misc_feature (387)..(388): n is a, c, g, or t
  misc_feature (397)..(398): n is a, c, g, or t
  misc_feature (400)..(401): n is a, c, g, or t
  misc_feature (409)..(409): n is a, c, g, or t
  misc_feature (414)..(414): n is a, c, g, or t
  misc_feature (417)..(417): n is a, c, g, or t
  misc_feature (423)..(423): n is a, c, g, or t
  misc_feature (428)..(428): n is a, c, g, or t
  misc_feature (438)..(438): n is a, c, g, or t
  misc_feature (441)..(442): n is a, c, g, or t
  misc_feature (451)..(451): n is a, c, g, or t
  misc_feature (458)..(459): n is a, c, g, or t
  misc_feature (463)..(463): n is a, c, g, or t
  misc_feature (466)..(466): n is a, c, g, or t
  misc_feature (475)..(475): n is a, c, g, or t
  misc_feature (493)..(493): n is a, c, g, or t
  misc_feature (508)..(509): n is a, c, g, or t
  misc_feature (551)..(551): n is a, c, g, or t
  misc_feature (570)..(570): n is a, c, g, or t
  misc_feature (583)..(583): n is a, c, g, or t
  misc_feature (607)..(607): n is a, c, g, or t
  misc_feature (726)..(728): n is a, c, g, or t
  misc_feature (732)..(732): n is a, c, g, or t
  misc_feature (747)..(747): n is a, c, g, or t
  misc_feature (1005)..(1005): n is a, c, g, or t
aaaancnannagngccaagtnaaacaagtcaaacnattaaagtctctttatataccataaaatattacagaaaagtttatttgtgtttcaataaaaagactatcgttttagaacaggcagctaatagcaactgtgcagttaatgggttttgtgaataaattttaaaagagactactgcctgtccttaaattcctttttctttttataaaaaaagaactattaanaatgattgacaaattttgcnttaaaaaattgttaaaacattctctatatttaatttcnattttataatagattacaggcngncgcttatgagacagatacatttgtttcagtacatgtctttaaatgatagacttataagtatgtnaacaactatataatngnngggttcctnncnntgcctgtnagggntcngggaanttttnccataagcgntannccattccangcgttcnngacngtntccatagcngcaccagcatggcaatangctttaaccaaacgnnaacaaacaaacaaaagcacttcgcaatttgttgctgcaaaanagggagagaaaagagtgtncaaacttgatggnatcacaacagtcaatataatttangggacaataaagtcaataaggttgatggtgtttattgtttaaaaagttgaattctgctgtttgcttggggctgtttagaaagttgcattctgctgtttgcttggacaccgtaccactgnnnaaantccacagagtcttgntatccgccagcaggggtgccgtccaaactcacggcaaataagcggcatcaggggctcaccatccacaacaggaggtgttttattttcatggatgtggttgaaatacaatttcttcagcaaactcagcaaaaacttttcaggggcaaaaatgaactctgcacttaaagaaaaatagcaaatgaaaacacaaaatccctaacaagtaaataaacgctctgcatcagcacactggtatcaaacacacatcacagcacgtcntaatctacgggaa

SEQ ID NO: 599210 - DNA, 95 bp, Homo sapiens
cccccccccccgggggggggtttggggtttttttccccccttttttttgggggaaattttttgggggggtttaaaaaaaaaagggccccccttta

SEQ ID NO: 599211 - DNA, 1163 bp, Homo sapiens
ttttcctgaggcttggaaaacacttatggatcttaaaattagagtggcccatattcgtgaaattcgggttactacaatattttgggctctcccatattgttgcaatatggctctccactttttaccagattccaatacaattcttcttacagtcccaattgagaaatggatcacgtccagatccaagaacataatcgggaacatgattgacgttttaaggctagatgtgccaggccatgcatagaaggtggcatttgtcgtagaaatcttgaagcttgttgaggccttagtaaagttataggctaattagtggtgactgtttgtaagtaattaggatgttatagttgttgtgtctggtataagagatagtcgacatgttatgcaaatgcttgtctgtcggattagaacatcgatacctgttcctagtttcatctccacgctcatcattggtactcacagagatcgcttcatgtcatacgagaaatgatcctgggctgattgtgaaagaatttcttctacatcctgaactattgtgtcatatttctcttatcaccttgctgttatcttcatccagtaatctatgctttgtcatcacaaatgaactatcttctatgagaatcatcaattctttctcattctccatttatctgaaggttcttttgccgcttagttaacgctcgtcaactgttttattgctgtgattgtctagtcaatgacctagaacatatcttccatctacatcagttacttggcatcatttcacctcagtttatgtgattgccaaataataattttgagtcagcatgtttcaactatggttattcatccaacccttggatctgctgttcgagcactgactcgactaatgctccacatggataacgcgctggtacattgacaatgtggtccacattttaacatagctaatgtctctggggctgtatttttcagaatattgctgagctacatttgctgcaatcagttggtacttcagagtttcaagtttcaggagaatacagggacaatagtcatctctgcgctgttatttttgttgtcatcaagcttttccacagttcttgaaagagtactatgtttctaattgtcaggaacaccagcgttagctgtaaaagttgcagcatttataactacgtgggtgaaaatta

SEQ ID NO: 599212 - DNA, 211 bp, Homo sapiens
cgcaaaacttcgtctcagaccttcttaagatcaggtcatggctggacgaagtgcacacgccgaggatcagacaaatctttatggacgaagttgttgctgcacacgccgagaccccagaccacactcctaggtctttgtggacgaagttgttgcgcaacaacttcgtccataccgatttccattgtgacctgagtaaccagaacgccgcgag

SEQ ID NO: 599213 - DNA, 851 bp, Homo sapiens
aacacgtgctacgaccactccaaggggaacgcagaacacagcgagggaatcagaaccatggacaaatgccgacagaaccatacgcagactcggagcgatggagacacagaatgaaaaggagttcaagacacaaatcataaacaagatggcccacgcgaggggcaaacacgacaggctgtggcatgcaacaaacaatccccgggatagagcaagccaccaagcagggccacaacacaggagagacactccgtacaacaaacacaagagcacgttccaacagactgacagtcatgcgaagataaagccgaaaagtaaaccttgcccggcacgacccacctgggcaaacagaaacacacatagcgcccagaacatcgaaacaatagaaaaaggacaaaacaataaaaaacaatggaaaaacatccagacgacactccaccacacgtagaatgcaacactataggcacaacaactacacaaggacaactagagaaaacgcaacaacactaagctagagcacacaacagaacaacacaacatatgccaaaaatacagggaaaacacaagcagaaaacaacaaacacgagaacggacactcaaaaagcgcaacaacaccaaactgtaccatacagaaacaggggaaacacgcgacaacctataccatagacatacccacatatcaacaagacagcaagtatgggaacacacccaacagcacactcaaaaggacaacagaggacagaacacacaggcaaacacacaacatacacagcaccgaggccacccttatgaatgcacactgacacatacaacacacagaacgaggcaacacaacccaaaacaaaacaagcaac

SEQ ID NO: 599214 - DNA, 579 bp, Homo sapiens
tgtgaacacaaaggcgctgcgccccacgaaggccagtgcgcccgaagagccaaacagcggtcctgagaccgcgatgcccgaatgacccctttgggggaggccaaaggcgcgcaacctctccagaagtggtgcgcaacaaaaacagcccccggcgagcctccggcacccatatgacccgccctgaggcgccaacaggtgagcccggcattccccaggggctgagaggcgcccccgggcgccccccaactccaacaatggaccccccgcgtcgcgcacaaatccccaagtggccccgcagcagcagcgcgggggtgcatgccaacaagcgttccaggagcccgacacgcgtgacacgccgcgagatgcttccctgccgcaaagagacacccccccaaaggctatgcattcaatactcacccgcccaagttgcgccaggccagcccagcgtcggtcaccagagcaccaggggggagctgaggcccaaagacccgcgggagagaatgtccggcccaagccgtgaggcaaggggaggaaccccccccccccaacaaacaatctttggtcggcccaacaatgaca

SEQ ID NO: 599215 - DNA, 428 bp, Homo sapiens
cgctgaagagcgctctatcattcaaatcggtcatgcccaaggtttcagcctgcgcggtattgcctgcttgatcaaccgatccccttcgaccatcagccgggagctgcgccgcaatcgagatgcctgtggcggctactcggcccgcgtggcccagcagcagatgcaggcccgccgtcaggtgtgtcgaccgaagcaaaagctgttgccgggtagcgagcgcttcgaattggtggcgcatatgctgcgtgagcgtttgtctcccgagcagattgccggcaagctgcgcagcatgaatattcccagcctcagagatgcctacgtctgtcgcgagacgatctataacgcgatctatgccttgccagtcggcgagctgcgtaaagagctgatcatctgcctgcgccaaagcaagacgatgcgcaggccgggag

SEQ ID NO: 599216 - DNA, 158 bp, Homo sapiens
gcagacttgaccttgaccagatagtcttgaagatgccaaactggggcggaggcgcaaaatgtggagcctgttaaaatgaccgtctaacatgcagatgatatcacagtggcaatagtgaaggagctttgacacaaagaacgtgttttaacatgacatgg

SEQ ID NO: 599217 - DNA, 974 bp, Homo sapiens
gttcctgttggtatagactatgtgatacctaaaacaggggttttactgtgaagctgtgcttcactcgtttctatacaaatgacagaagttgcaaagaatactcatggcagcagcctgtcctcattatcagaagattaccagaaatttctgaataaattggcagaagaacgcagacagaagaaggaaacttaagatgtgcaaggagatttaatgattgcaaagaaaataatggttctttgtgtcttaatgttaaccttgtttaaatacgaatactgatgagttagaaggaaaactattgtactctgtggttgtagtggagaaataatagatgtctgtctcatgtgtccaagtgtaatagcaggaaaaaagtacacatatggtctaagttaaggaactagtatcgtcttatcagaatggcaacagacgagaagtactttagtagagatcgagcttccctaaggctaccttacagacaacgtggcacccattaaagaacaacacagggctagaacacatttgggcacccattgagaagtccaagtaggttccaaagtttccgacagcacatggtcaggcatcttaattcccatggcgataaagaacaaagacccacatagccggatccactactgacctttgtccatcctgaacagcattcccaactcgttctaaattctggaagccttgtgccagaacattccacataggggagcttggaaaccacggattctaggttgcgcctcctcgactcctaccggagagaagagcttgcacttatacccgtcgaccaaccgcgcgcacttgggacacctgcccggggtcgccacgaactcccacagggcacaaggccacatgccggcaacggcacaagggaccacaacagcacacgtcacccacgcacactggggcctaagcaccccggcaaccgcacgccccccgacaaacccggacacgaactgccgaatcacacgacc

SEQ ID NO: 599218 - DNA, 402 bp, Homo sapiens
ttccctatacgtgtccggggttgtatccgtgtcggggttttctggatgattttcccattgtgatcaaacaccagtcgagtcccaaccttcgccgatacctgacaggtagaaatggtgacatcattaagcctccgaagtgttcttcttctaccccacatccattgcctgaaacttcaatgagatccatcccatagtccttaagctttagatcaacattagcggcaccagcatccagactgttttctactatcttcttcatccagtgcttagactcagtaccacctgcccagagcaaatctgatggactgacttccgatcaataggtttgatggccttagcaggttctgtacttcttaatattcctttgaaaatccttatggcgcacaggtagcgtagaaaata

SEQ ID NO: 599219 - DNA, 562 bp, Homo sapiens
gaagtggaggctgcagtgaactgagatcatgccattgtactccagcctgggcaacaagagcaaaactccatctaaaaaaaaaagaaggccctcaccagatgtggctgcttgactttggaattcccaccctccagaactgtaagaaataaatttttaaaaataaagtacccagcccctcaggtattctattgcaacacagaatggactaagacagtgtttatatgtcaaaatctattttcctgtgtttaaactgtcttccttctccttgcagagggaatataaccttagccttttggagtgataatttcatgtttgtctgaagtagcttcttctcacattttctttttttttttttttatgttcaaaatgcttttatttctaggaatttagttttatttttaattttttaattattatactttaagttttagggtacatttgcacaacgtgcaggtttgttacatatgtatacatgtgccatgttggtgggctgcacccaataactcgtcatttagcattaggtatatctcctaatgctatccctcccccctccccccacccc

SEQ ID NO: 599220 - DNA, 428 bp, Homo sapiens
  misc_feature (337)..(337): n is a, c, g, or t
gctttttggttttgaacttgaagtccctaaactgcaaaatttaaaagttgggtggttattaaaatgcttttaaaaagttaactgtggccccaattttaatgtaatccaacttgtgactgtttttttttgttttgttttgtttttgggggggggggtgtggggcactgggaaaagtggaaacaaacatgtattgaaaaacatattggaaataaaaatggtttgagggtcagtgatattttcccaaaatgtacttattttacctcggcatgtactgtagtcactcagtatttgtaaatgttgctaaaatttaaattgtaaaaaagtgaaattttaatgngttcatttgtttttaaggaaaaaatgtcttgctcaaattatttggtttaaataaaacacccttgaggtttgtagcttttccttatcctata

SEQ ID NO: 599221 - DNA, 662 bp, Homo sapiens
ttactctcgtagaaactacgtaagaacccgagagggtagaattgagaaaacggagacggcgctcgaggccacgggagacgtcaccgacgacgtcccggaaggagacgaggaagaagaagagatcgaagactccgccagttaagcttccgatgagactggcactgatactaattaagaggcaaacatactaacactccagtcattacccatccaccttatccacggactaactgaattaactccattacagtcgccagacacctataacagattaaactagaacggattccactacagtccaaatccttccgaatcgaaattgacatcgtgcgatgcgagacccggccccatccaatccgaccgcacttactcacaataccttcagcctcaccctttattcgcaagacgtccaatctgacccgattgacctactcacgccctagtcggcgaacgtcttactcggcgtggctgtagcatttgtagtaaagaataaggcggcataagtcgaggtgattggagtcgaggatagcggaggcacagacagcgattcctaagtaaggccggacaattccagaaaaacgcgaagttcccttcgccctcgcactacaacaccatcgaggtcgactatcccctaacccaaaagtaaacgccgtaaatgaagc

SEQ ID NO: 599222 - DNA, 156 bp, Homo sapiens
gcaacagaatatattgcttttgttgtaagcttttgtagtacatgttttcactaataatttcttgttctctaggaaggctttctatttccgccctatgggcaaatggaatccttcatgtcttcttgtcattgttgacacacttgcagtgtagcccag

SEQ ID NO: 599223 - DNA, 494 bp, Homo sapiens
  misc_feature (63)..(63): n is a, c, g, or t
  misc_feature (67)..(67): n is a, c, g, or t
  misc_feature (70)..(74): n is a, c, g, or t
  misc_feature (76)..(77): n is a, c, g, or t
  misc_feature (79)..(79): n is a, c, g, or t
  misc_feature (90)..(90): n is a, c, g, or t
  misc_feature (475)..(475): n is a, c, g, or t
aggactgaagcactgggcacctcccttgtgacaactgaaaatgtctgcagacatttccagatnagcncgnnnnntnngnatactcccttngaagaaccaaccgtgacagacatttaaaactatatgcgcaagattttagacttgcataactacagaacacattaaaattccaagtgagttatcactctcttccagaccaaaacaagaacaaagaaaacacccctgagatccacagcagcccctgagcaccactgcttcatcttcaaaggagaggtttctccctgtccaagtgcggaggggcaggaatctgggtatctcccagggtctgggatgcagaggcgtagaggagaagctggtgcgtgtgaacatcccaccggcctccacctgctagcatccatgctggccgggatccaccatccctctctaagaagcagttcccacatctgcatagagccaattccatacctactccggngagtgatgctttgagggga

SEQ ID NO: 599224 - DNA, 1678 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcagtgagtgtcggagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgtcaatccacaggagaagagacttgcagcgcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 599225 - DNA, 280 bp, Homo sapiens
gaatataacaaatgttttttttaatcaaaaagcgttttttggcagaaataccttctcgaacatgtgaactttcatgtgccttaatatcaaacttgaatgtcatctgtaaatacgaataaaattgttaaattgtgagcccagttggtttagccacagaacaagtatgccaccttcccactagccatgattggctgagataatgagtgggctggaaatgacaagagatgagtttggattggtctgcagtgaagcatcttgtgtctataaaatgagtcgacgc

SEQ ID NO: 599226 - DNA, 1847 bp, Homo sapiens
  misc_feature (3)..(3): n is a, c, g, or t
  misc_feature (831)..(831): n is a, c, g, or t
  misc_feature (848)..(848): n is a, c, g, or t
  misc_feature (854)..(854): n is a, c, g, or t
  misc_feature (859)..(859): n is a, c, g, or t
  misc_feature (900)..(901): n is a, c, g, or t
  misc_feature (929)..(929): n is a, c, g, or t
  misc_feature (937)..(937): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcagtgagtgtcggagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgtcaatccacaggagaagagacttgcagcaggtgggtagctggagcaaactgggcctggggcacaggaaggggtctgcttgaagaggtngggtacaggaggtggtnctttancaggntgaggctgagggaatcctgttgggctgagagccagtacaannagtggagccactcacactggtggcctgncctctcancttgcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 599227 - DNA, 1748 bp, Homo sapiens
  misc_feature (5)..(5): n is a, c, g, or t
  misc_feature (49)..(49): n is a, c, g, or t
  misc_feature (52)..(53): n is a, c, g, or t
  misc_feature (56)..(56): n is a, c, g, or t
  misc_feature (58)..(58): n is a, c, g, or t
  misc_feature (61)..(61): n is a, c, g, or t
  misc_feature (64)..(64): n is a, c, g, or t
  misc_feature (81)..(81): n is a, c, g, or t
  misc_feature (83)..(83): n is a, c, g, or t
  misc_feature (92)..(92): n is a, c, g, or t
  misc_feature (95)..(95): n is a, c, g, or t
  misc_feature (732)..(732): n is a, c, g, or t
  misc_feature (749)..(749): n is a, c, g, or t
  misc_feature (755)..(755): n is a, c, g, or t
  misc_feature (760)..(760): n is a, c, g, or t
  misc_feature (801)..(802): n is a, c, g, or t
  misc_feature (830)..(830): n is a, c, g, or t
  misc_feature (838)..(838): n is a, c, g, or t
cgccnaattaaccctactaaagccccaattaaccctttctgggtcgccnaannaancntcnctnaagtgctgggattacangngtgagcacngcncctggcctaggagtagtattaagtggcccaggcaagaggaacatattcagactcggaggaatgaaggatgaaatgtggggaggggcagtgtctatgctgagggttatttccaaagaatgagaggctgggctgaacattgggcaggaagttagcaaaaactaaggagggtaggaatcaaggttagagggaagagaagaatgaaattgagtagggagctgagaaagcagggcgaggggcatttggacttacattttcttccagcaaaggtttcttatttaacccctgtgggcttatcttgcagccaaacccatccaccagcatgaagaccgctgcttgaggttgaaggtgactgtcagtggcaaaatcagtgagtgtcggagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgtcaatccacaggagaagagacttgcagcaggtgggtagctggagcaaactgggcctggggcacaggaaggggtctgcttgaagaggtngggtacaggaggtggtnctttancaggntgaggctgagggaatcctgttgggctgagagccagtacaannagtggagccactcacactggtggcctgncctctcancttgcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 599228 - DNA, 702 bp, Homo sapiens
  misc_feature (672)..(672): n is a, c, g, or t
caatatctgataggaagatgtaatataaagaagggggatcaaatcctgcccttaaggtagacagaatctgtcaaggctttagagtgtaccatcaaagagttaacagccaacagaacaaaatttagcatcatcacaattttggaagtttttcaacagccctatgatttataaactgtcaatcactatttttacatataaatcatttccagtggtagtaaatgtgctaatattctcgatatatgtgaaaaatatcacttaaaattttttcttggaagaagcacttaataatttgtaaatcagaaacaaattatatgtactttctaagtagattagtgtatttctcatacatagatgatggcatagatttgcttttttagtaaattgtcagatatcagactctaacttatggaacaaatgaatataagtaaactcactcccatttgattgttttgtaaatgaaaaatgtaatattaaatttgtgagatgaatgtgtatgtagtaaatacattaataaaaatgtgtagatcattagtaattttttaatcttctttatactagaattatgtctgcctaacaattacttaaatatttgaacttttaatttattatcacaattttctaagtcactatgtatgaaacatcatgattgtatttaacttgacaatataaaanttagtcaagaaaatatagttgttccattta

SEQ ID NO: 599229 - DNA, 1395 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggag

SEQ ID NO: 599230 - DNA, 1390 bp, Homo sapiens
  misc_feature (1085)..(1085): n is a, c, g, or t
cttgatgttcaccccttctcttattgcgcctcttccctcgagggggtgtgcgctcatcatttgtgtggttttcctcaccacggtcgcgctttctggcgggtcgatcacaccaccagtggtgtttgataaaagtgggttcatcttctcacccaaagatcgccgcctaagtttgcccctgttctcataggtctctcttttgggagttgtgactccctttcctcccctttttcgggggtgttctaccaacacagggggcccgacccccaccccgagcctcgaatttttttgtgggcccaccaatacaccaaaggaaattgtccttgatgtatgtgggcgaccttttctccctgcttggagcacaacacccgagcaccaagatggtgtcttccttgggagtgccttctggggggattttgcacccccatgtcgtgagatcttatttgggggaataatccccccttggggtgttttgtgctcacaaaataacacacactgtgctccccgaggattgtaggaaccccccacatcccaggaacaattggggggtgtttctttttgtgggttccccgcagtgttgttctgcgccccttactcatacgtaagcttagactccctccttttctgagtcgggtctctccccctgtttgtgccttgtgggacacaaaaccaatgggtgtccaaagaggattctgtgagccacctcgggccgttttacctcgcgcaaagaccttgtatgaaggacccacaccccaccccaagttggcgcaccaccaacaagggcgtatatctttggagaccaccccgggggatccctggtcttccttctccaagagttggagatccccccctctctgtggccttttctctgtgagagcgcccacaagtaggttgcccccccgcgccacatgttttatatgggagatctctctctccacagaggcgcacaaccacccctttttacccacaccgctataaatgtgtgtgggggacacaattaatcacaacacgccccctggtgcgtctctacacccctatacaccgcgtatcactgtgcctgtttgttgcctttccacaccagagcgccnccacgccactctccaaaatctctgtggaatttattgaagggaaagaatctcattggtagatgtaactgtaagcccagaaagattactccagtatcccaccctgccagagccagaacccacccccacggtgccaccctcccctggccctgggtcttgtctgtatgtgcccagaacatcttgttttgtcctggcgtaaccacggaccaccctggtgcgagatttggcccggtgaccccgtggcaccccctagaaagatttttggccgagcctttcacccaattaaaaaaaaactggctttttctgga

SEQ ID NO: 599231 - DNA, 1178 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 599232 - DNA, 1225 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 599233 - DNA, 335 bp, Homo sapiens
gtattggaatatgatgctaaggggttagtggggaggacgagggtttgtgagaaagttgtttgatgtaggtatgagttaaggatgggtcagcacttggtaatcttggatgggttttggggaaaaactgaagtcattgaatgataagagaggagcagtgaaggatttggaacttatgcttgtaaagagttgtttgatgggtaatggtgacaaaatgggtcttttttgagtagttttgaaaagaaaaaatgtggggtattgatgatgggcttgattttttgggaataataaaatgaaataatagttttattttttgaataaaagtttgtgactgataa

SEQ ID NO: 599234 - DNA, 873 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcctctggattgacaggcctctggagttgga

SEQ ID NO: 599235 - DNA, 406 bp, Homo sapiens
  misc_feature (11)..(11): n is a, c, g, or t
  misc_feature (189)..(189): n is a, c, g, or t
atttcggcagngggataggactagggcgaagctaagcagcatctatcaatcatcccttcagctcctgattgatcccgggccaaagctggtccaaagctgagccacacgtttttcaagacagcctgtgaactaggcacatatccttcccttcccagtccataaaaaccctggacccagcctcgtagaggncaccactttcagatacctatctctgctggcaaagagctttcttctcttgcttcttaaactttcactccaacctcacctttgtgttcacgctccttaatctccttaggaggtagaacaaagaactctgggatgttatcttcagactacggaggagactgttaacatcttgggtggcactgctggaggactacggacacttgggttttctttggacttt

SEQ ID NO: 599236 - DNA, 102 bp, Homo sapiens
tatttccgggggaaattttttaaaattagttcccgggggggcaaaaaaccatccccaaccccttgggggggggtttaaatcctcccctgaccctttaaacgg

SEQ ID NO: 599237 - DNA, 339 bp, Homo sapiens
tttttttaatccagtaacacggctagagagaaaacttgtattaaaaacttgtacctggctgggtgtgatggctcacatctataatcccagcactttgggaggccaaggcaggtggactgtctgagaccaggagtttgagaccagcctgggcaacatggtgaaaccctgccttgacaaaaaaaataaaaaattagctgggagtggtggtgtgcacctgtagtcccagctatgcgagaggctgaggtgggaggatcgcttgagcccggcagcagaggttcactccagcctgggcgacagagtgagaccctgtcttaaaaacgaaaacccatgcctcaatca

SEQ ID NO: 599238 - DNA, 691 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctgtgagtgcctgtgaggggacagtgtctgtgtttcttttttgccattacatacatgccttgggtacatgcttggtgtagagtccagcagcagagggccccttccgatcttgaattctattttcattcatctacatcccaatgtgagtgagcttctactatgtgctgggcactctgtttagcgctatgagcacaaaga

SEQ ID NO: 599239 - DNA, 239 bp, Homo sapiens
  misc_feature (65)..(65): n is a, c, g, or t
  misc_feature (141)..(141): n is a, c, g, or t
gtgtgctggtatctaagacgagtgtctcaaccctatgaggaaccatggcagcagccttctgagangcagtggatcaggcatgtattatctcgtggctccttgacttttgagacagagaaaagaacacatcaactctatgtncgcggtgtcatcatggacagctgtgatgagttgatacagagtatctcatttatcgtggtgtgttgatctgagatctgccttgacattccgaaaatggt

SEQ ID NO: 599240 - DNA, 148 bp, Homo sapiens
gtgataaacttgaagtataatgttaagagaaccgttctcttaatgtgtcagataatatgtatgtactctctctcgtctcaaataattagtatacattgagatagtgtcatatatacagttttgtagtgtaaaataagagatggagtct

SEQ ID NO: 599241 - DNA, 521 bp, Homo sapiens
ccttttattttattgacgatagagtctcactctatcacccaggcctggactcaaatggagcgatcttggctcatctgcaacctctacctgcccaggttcaagccattctccctggtctcagcctcgctaagtacctggggtattacagtgttctttttccaccacgccctggcgtaatgttcttgtaatgttgtagctacgatgatctgagaatttacacccgtttttgttccacggcttgccttcttcgagcatcctgacctcgtgatccatctctcagcgcgtcaagacctcgtcaaagaagaccatatggaattacaaggcacgatccactgcacccagcctaatttttataatatatttacttacgtatgtatcgtgtgtgtctttgtcactcacttggtctcacgacctggtctgtaattcctcacgctcaagtgatctgcgcacctcggcctaccaatatttccctgggataaacaaatgagacacacacccaccccccgcccaacataacacaa

SEQ ID NO: 599242 - DNA, 382 bp, Homo sapiens
ctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataataatagaaataaagtgcacaataaatgcaatgc

SEQ ID NO: 599243 - DNA, 282 bp, Homo sapiens
gtggagcgtgtctcagcctctttcagtttgtcggacagaagtttaatttcttcttcatatttgtcctccttatcagaatagtgtgggagaaaccaaaacattgctttaagaaaaggcggcccagccaggcagggtggctcatgcctggaatcctggcactttgggagcctgaggttggtgaatcacaaggtcaggagttcgagcgcagcctggccaatatggtgaccccccgtctctactaaaattacaaaaactagccaggcttggtggcatgcagctgta

SEQ ID NO: 599244 - DNA, 217 bp, Homo sapiens
ccacgaacgcgatttaagtggctttggcaatatgctgtttatggcgttaatcggcattgtgctggcatcgctggtcaacttctggttgaaaagcgaagcattgatgtgggcagttacctacatcggcgtgattgtctttgtcggattgacggcgtatgacacgcagaaactgaaaaatatgggtgagcagattgatacccgcgacacgtcgaacctg

SEQ ID NO: 599245 - DNA, 181 bp, Homo sapiens
ctcacccaggacagccttcgtgcggccacagttcccaactgacacgtggagacttcacatcctacgtgaaaggccgagtctctccccagatcctaagtctctccttcggtctcctctctgcttcctctcccggactctctattatcctctccttttcttctcttcctggctggttccgctg

SEQ ID NO: 599246 - DNA, 237 bp, Homo sapiens
tgtggcacaacacactagacgggagtagagacccactcacgctggctcaagtcacggagtctgtagtggggacgcacgtggaccaataagggctgctgccagaaataccaagaacataccatggcctggcctacctcccagcaggggcacgctcctcactacctctaagtacttgtgctagctccccacaccttctgatgcctaagaagcttctgtttccttgtatagcatttcaga

SEQ ID NO: 599247 - DNA, 305 bp, Homo sapiens
ctggccagcaccatagcagatatccaggagcacgatctggagaaaacacggcagtactctcaaaagctagggcctgctgacttagacaactacagagcctgactctcttcctacagacaaacctaaaggggaggcctacacaggagacccttctgtctgagtacagcctgtcctcccacccaggacacaccctctgtctaagtgacaggccctctctgggaagactctagacagcagtcgcagatgagagccagactcatctcctgtgcccttgctgggaggtcacaggtgtgctatcacccgag

SEQ ID NO: 599248 - DNA, 123 bp, Homo sapiens
  misc_feature (117)..(117): n is a, c, g, or t
tttgatataagcacaacacattgatacccttgattggagaatctgcgttcctctaagtatatccccagaactaaggcatttaaccagtgtaaacagactctatcaagcgccccaagnttatat

SEQ ID NO: 599249 - DNA, 209 bp, Homo sapiens
aggtatgaccatactccgtatatacttagatcacttatgcagaaacctcaactgtgttgaacattgctgagagaaatcaacaataatcttaacagatatgaggacagtaaaaatagattgcatatctttttgcactaaaactttcatatttattgacaagcgggaactccattctgccacagagaccctgacaattctcctttgaggta

SEQ ID NO: 599250 - DNA, 867 bp, Homo sapiens
ccataattgtcacgccctctggggtatcctctttgcgaggttcttgagagcccccccaccgccgtgtgctcaagggaagccccctctcaccggggtgggaaaacacggtgtggccgttccacggcggctccctatgtaggggtaggcgcacggacgggtggcctgggagtttaagccgccccagccgcactttttccggggggtttaggaacaggaaggcaagattgagattcctcggacgggggtcatggggcctgctcccccgcccaggacagctccaccagggggttttaagaggcgctgccccacacagctcacctggctccggaaacacagttaaccgcgttcccacatatcaatcaagatcagcaataacctttattacgcgggattgccatctagtgccccgacacaaatatgtgtccccccctccctgagatcatcccctcttcaatcgttctatcccctctggcgagaacaacccaccataacttcaagagattctcaacgttttgttactccacagccgagagatatatttttcgctctctgcaccatcttttaaatatcaccaatatccaacctcatttgtggtgcgaaacacttgggggtatccccgtcgcgtgttatctccttttccttaaaaattctcctcgaaagagagacgcctaaaattgagccaaaatggtgggaagagtaagtgtgtaaaccgtgatcttcttccacttcgaagaagacaaagaccaagcagccctccatgtctccccccatcgtatatatttggcacaccacattgtccccctcccctcgatcttagtacaccccccccccccgtttaaaaaaccaaaaaaagcccccaacaaaaca

SEQ ID NO: 599251 - DNA, 364 bp, Homo sapiens
cacgagggcgatgctgaccttaccggggaggaggaagggggcctcgccggtggcggaccagtcgccttcacccagggcggcacggaggtcggcgcggctggcccagaaggcctcggcgatctcgccgtcggcggggacgagggggacgtcggggtcggcgacggcgtggaagccgaccatcaggctgcgggggaacggccaggactggctgccgaggtaacgcacctcgctcacccgcgccccgacctcctcgtggatctcgcgcagcacacatgcctccagcgactcgccggtctccacgatcccgaggagcacggcatagcggggctccggccagctgggttggcgggcgagcaggacctgg

SEQ ID NO: 599252 - DNA, 209 bp, Homo sapiens
ttattcattagtctagaggtccatgcatacttaatattatacttcctcaacgctttatacttccgtgatggaattcaagtataatattaagtatgcatggacctctaggaagtataaagcgttgaggaagtataaagcgttgaggaagtataaagggttgaggaagtataaagcgttaaggaagtataaagcgttgaggggtaccgagc

SEQ ID NO: 599253 - DNA, 884 bp, Homo sapiens
taggtgttggggaatatgggaagggtctcctatctattcaatagagttgtctcagttattttcctgccttgccctgtgattctccagaaaaggtgggatctaggaagaaagaatccgagtgtagaagttgatgaagaacttgaaggtttgggtatctggataaggtacactgtcactaggtgctaggtgggccgagcgtaaagattcagtggatgaactgtgtgcagtgcctgacaatgaatatagaacagtattaatccctttgagaaagtcatagtccagcaggacagtggcatttggacggaaggcccacttagtttcttgggagcaagagcgacgtatcatgaagtgctagagtgtggctcttcggtgcatgctgcttggggatacagcgtataggtgcacgaccatgtagacttggaagcaagagaagtagcaggctctgggtgcagtcagccagacccgaagctggaaggatctggttcaacgtagcaaaagccttaggaaactatgtaattaaccgtcactggatgtgtaatccagtgaagattaccttttgcgggtgtgtatgtgggcatgtgcccatttctatgtgggtgtcgacgtgagtcagtaccaaaagcttcatgtgacttgacctgaggggtcggttggaactctcacgaggtggagctgaatgcctaagctcaggaggcaagggtggtggcgagcaatttaaattcttttggcgagggggtggaacctaaggtaccttgcctaatagggggttagatttcctcctttattgttagcggcacaccttggttcacggggcacagtggtggctcggggcctggtcttcaaacacaaaaaaaagcggcgctaactgtggcacaatctatatc

SEQ ID NO: 599254 - DNA, 519 bp, Homo sapiens
  misc_feature (13)..(13): n is a, c, g, or t
  misc_feature (17)..(17): n is a, c, g, or t
  misc_feature (20)..(22): n is a, c, g, or t
  misc_feature (25)..(26): n is a, c, g, or t
  misc_feature (33)..(33): n is a, c, g, or t
  misc_feature (36)..(37): n is a, c, g, or t
  misc_feature (484)..(484): n is a, c, g, or t
  misc_feature (489)..(489): n is a, c, g, or t
  misc_feature (494)..(494): n is a, c, g, or t
  misc_feature (499)..(499): n is a, c, g, or t
  misc_feature (504)..(504): n is a, c, g, or t
  misc_feature (509)..(509): n is a, c, g, or t
gggggaggtgagnccgnggnnncgnnggggggnccnncttgagttatagctcagcagtgtcagataaacacttggaagagggtcggctttatcctcctttgaataccattacagatgtggctctgggggttgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaggaggggggggaaaatacagaccaaagttgaccagtaggataatagcaaacatttctaactctattaatgagggctttaaacctttcataatttttaaagggtggaatcttttataatgattcataagacacttagattaagattttactttaacaggctaaaaattgctagaagaatatcgatatagattggggataaacatcacatgngacanttggngttantttgncttcngggtatttat

SEQ ID NO: 599255 - DNA, 941 bp, Homo sapiens
  misc_feature (13)..(13): n is a, c, g, or t
  misc_feature (17)..(17): n is a, c, g, or t
  misc_feature (20)..(22): n is a, c, g, or t
  misc_feature (25)..(26): n is a, c, g, or t
  misc_feature (33)..(33): n is a, c, g, or t
  misc_feature (36)..(37): n is a, c, g, or t
gggggaggtgagnccgnggnnncgnnggggggnccnncttgagttatagctcagcagtgtcagataaacacttggaagagggtcggctttatcctcctttgaataccattacagatgtggctctgggggttgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaggaggggggggaaaatacagaccaaagttgaccagtaggataatagcaaacatttctaactctattaatgagggctttaaacctttcataatttttaaagggtggaatcttttataatgattcataagacacttagattaagattttactttaacaggctaaaaattgctagaagaatatcgatatagattggggatgtagctgtgaggagtagttcttagtgtcacgcctgctctaagtataaagggaatttgcctaatttacatcggcgtcggtatttgtagtagcggagggggtgatacgggaactcgtagtttttgagttaccgtgcacgatcggggtatatcaatgggagtgtaatgatgttattggtcggaaaagagggtacgctgtcacggcaggtgagagatgttatcaaacgtctacttcattctccgcggtgcgtggatagtatgttgatggtgaaaggtggtgtacagtatcggccgggtccgtcgtgatagcgtcgtaatataataatctatatctgtgctacatctgctcgaggatgtgcgatgtgaggaggcggaatcttgctagttgatgcgtggcgtgaggcgagtagccaagcgcgtggttcggtagaccacttcttgtgcgaggttaggagggcgcgtggaggtatgtg

SEQ ID NO: 599256 - DNA, 226 bp, Homo sapiens
ctgctgggctcttcctgctgttggaaacttacccggcccttacagagggaatcttcctcctctcttctgcccttgaatgttttcccaaacatgaaggtgataagcttattcattttgggtgggtttataggagagttccaaagtttttcagtccctcctctccagtcaactgccagtgggacttctatgccccttgtcagatgcaatggctgtaccagactagact

SEQ ID NO: 599257 - DNA, 314 bp, Homo sapiens
tgcacatcagtcataattactcactctttatccccctaataaattgcatttgggtcaaagcgatggctcacgcctgtaatcccagcactttgggaggcaaggtgggcagatcaagaggtcaggagatcgagaccatcctggcaacatggtgaacacccatctctattaaaaatacaaaaattagctgggcatggtggtaggcgcctgtagtcccagctactttggaggccaaggcaggagaatcgcttggaacacggggagggcaagacctttgcaggtggaagctggagatcgcaccatttgcactccaaatt

SEQ ID NO: 599258 - DNA, 706 bp, Homo sapiens
agtaaggtcatgctaaataagctatcgggcccataccccgaaaatgtcggttatacccttcccgtactaattaatcccctggccccaacccgtcactctacatctaccatctttgcaggcacactcatcacagcgctaatgctcttcactgattattttagcctgagctaggcctagaaataaaccactgctacgcttctattccacgttctaaccaaaaaacataaaccctcgttccacagaagctggccagtcaagatatttcctcacgtcgaagcaaccgcatccataatccttcgtaatagctatcctcgttcaacaatatactctccggacaatgaaccataaccaatactaccaatcaatactcatcattaataatcataatggctatagtaataacagctaggaatagccccctttgcacttctgagtcccagaggttacccaaggtacccctctgacattccggctgcttcttctcaccatgcacacaaaactagacgcccaatctcaatcatataccacatctctccctcagtacaacgtaaagccttctcctcactctcatcaagtcttatccatcatagcaggcagctgaggtggatataaaccaaacccagcttacgcaaacatctcagcatactcctcaattacccacatacgatgaatactagcagttctaccgcacaccctaactaagcct

SEQ ID NO: 599259 - DNA, 545 bp, Homo sapiens
gtaatcgatgccacagcgggtgtctcgcgggggatcggctactctttggtgatgcacaccagcgcgggtgcagaaggctcgggccaagcccgggcgtcccccggctccggccgggaggagtttagaagtgcgccattcatcgagtgtcagggccgggggaccggcaattactacgcaaacgcttacagctttgggctcgccaccatagagaggagcgagatgtccaagaagcctacgccgtccacctggagggcaggggagctgcgcacgcacgtcagccgctgccaagtcggtatgagaagaacataaggaagccggactcagctaaggtcacaacagggtggctacttcttcttcttttggttaacagcaacgaaccctagaaatatatccggtgtacctcactggtccaatatgaaaaccgtaaagtgccttataggaattggcgtaattaacacacccggtttcatggacctctactggcggaaggagaaaaagacggcgataagctttcaataggggcatcgataaacaccgggtaccga

SEQ ID NO: 599260 - DNA, 428 bp, Homo sapiens
atgcgagtaatacggatgtgtttaggagtgggacttctaaaacatccgtattatcgcatcagagtatgaatcactgactcacatagtctatagaaaacaacgaaaccaaataatcaagcactgcttattacaatttactgggtctctatttacctcctacaagcctcagagtacttctgagtcgtcccttcaccatttccgactggcgatctacggcgtcaacatttattgtagccacaggcttccacaggacttcacggtcattattggctcaactttcctcgactatctgcttcatccggccaacataatatttcactttacatccaaacatcactttggctttcgaagcccgccgcctgatactggcattttgtagatgtggtttgactatttctgtatgtctccatctattgatgagggtctta

SEQ ID NO: 599261 - DNA, 294 bp, Homo sapiens
caaggtgcccaacctgggcaaaatcaatcgggacctgtttgatttttccacgggttttataaaggggccggccaaataaggcccggaaaccccggcccaaggggcccaggccttaaccccatgcctcccaaaaaccaggggccggggggggggccccccccagcccaggccgggactttccccaattttgggtggggttcgggtttttcccctgtgaaggggcggtcttggtgttttggggcacgcgtcccaagggggttattttgtttttaccaaaaaaggatgaaaacccca

SEQ ID NO: 599262 - DNA, 1216 bp, Homo sapiens
  misc_feature (45)..(45): n is a, c, g, or t
  misc_feature (253)..(253): n is a, c, g, or t
gtgcagaatccggtgagggtgctactgcattttctgaccttcccntcctggtatggaattcattgtgaacctgaagctgtgacgccgatgctcatatcgggatgcgaggcgagtatatacggtatgcggtgatgtgcacgtgggtgggcccccttcaagagaatgactatcaggacttctccgtcgtatcgcacgatagccttgatcaatggcgtgctccgatggtacatgtgactattgcgcgcagtactanatgctcgtatgctcttccaagctattactgcctgtacgcatgagaggatgatcctgaacataataatactctcgcacaccgaatagtgattggagatgaggcgagtatggtgaaatcctggattgtcgccaatctgagacgtcgtaagcgtatgcgcgatggatatcatccaatcagattctctgggcgtccattccgtaagattgaacaggtagcgagcctgatttagaatggtataactgggcggagctcttgtggggccgatcctaggattgaacataagctggggctggttggacgttaatggagattccatgtacctttgtccgaccaggaatataaggtggggaatccacgttgccatagacgccttcatgggaggatagcaagcaacagattccgtcataacttcgaatgaccgcaaggaattgttgtccgatgggtttgtgaagagacgatgagtcagtattggaattatcgataccgtttcatcactaaaatactactggagaaggaggaataaaagtgggtagacagattcctaaaggtcgtctctttagcatagacagggacgctcgtaataaaaaccccttgggtttgtgactgtttggaacttttggaattcttgcgtgcgcaccctggcaaatctcatgggtttcaagcctggtctttgtgggttaactagaaggggctgggcgtttggcttgggccttaaccccagaaattgaaacactttttggaccacgctgtccacaaacttccacccaggccttgaaccaaaggaaaagtaaactcttttgcccacgtgggcgcctaaccaagggacctgggcgcgacctttccaaacttaccaacctcttaacttgtcaaatgtctcgcggaccacggccatctctgcgaagcgcatccacttgatccccgacaacgcttgggaagcaatcctgaacccttctttaaaccttc

SEQ ID NO: 599263 - DNA, 413 bp, Homo sapiens
  misc_feature (63)..(63): n is a, c, g, or t
  misc_feature (91)..(91): n is a, c, g, or t
  misc_feature (119)..(119): n is a, c, g, or t
  misc_feature (386)..(387): n is a, c, g, or t
catacgtccaaccttgctgctggagagattggggtttatttttaactgacttacatgaacgtnaccccatttccgaggcctggcgcctttntcctcctgtaagtcttcgctcgaatgtnaccttgcgagggaagttgttcctgatcaccctgactatgtcccctaccggtactgtatcctctgtctcaacaatctgttggtttcattcctaacccttaaagcaaagtgtttatatttttatatttatgtatttgttgtctgcctcccctactggactatcaaatcttctaggatagggcttgagtctgtcttaatcactattgatgagcagcaggtgcttagcacagtatttggtgtacctgtggaagtgcccaaatgtttgttgnntgactgagtaaccttccccatataat

SEQ ID NO: 599264 - DNA, 254 bp, Homo sapiens
gtgagggtccagaatcgcacacccttccctatcccccgttccactggctcttagagctgaggcacacatagtaggcgctcaggggacatgagcccaccccgtcttatgggccacagagcgaaatcagtgtcaatgcctgaaacatgcatgtctctgtgatggaggtgagagcttgtgaggtaagattcgcattgtggtgtggcagagtttttgggggattgaagttagatccttgttactcagtaaaccacctc

SEQ ID NO: 599265 - DNA, 188 bp, Homo sapiens
gctctggtacacactatgtagcagctaacaggtcgtcatggctttcagtctttctattatataacagtgtctgaattgtttcagaatgcagtgtcttaacaaaataagattagtcattcttacctggtgctatattataccagccatttgaacctgccacgatcaccacccagtgcttgcctccatct

SEQ ID NO: 599266 - DNA, 100 bp, Homo sapiens
tcgagtcgggccccatttgaagcctgtttttcccgttgattctgtgtttacttttcttctttcttttccttgggtggatgggttctgcgtaattagggtt

SEQ ID NO: 599267 - DNA, 1000 bp, Homo sapiens
  misc_feature (45)..(45): n is a, c, g, or t
  misc_feature (142)..(142): n is a, c, g, or t
  misc_feature (191)..(191): n is a, c, g, or t
  misc_feature (198)..(198): n is a, c, g, or t
  misc_feature (204)..(204): n is a, c, g, or t
  misc_feature (326)..(326): n is a, c, g, or t
  misc_feature (384)..(384): n is a, c, g, or t
  misc_feature (389)..(389): n is a, c, g, or t
  misc_feature (409)..(409): n is a, c, g, or t
  misc_feature (419)..(419): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (445)..(445): n is a, c, g, or t
  misc_feature (449)..(450): n is a, c, g, or t
  misc_feature (454)..(455): n is a, c, g, or t
  misc_feature (462)..(462): n is a, c, g, or t
  misc_feature (465)..(465): n is a, c, g, or t
  misc_feature (476)..(476): n is a, c, g, or t
  misc_feature (504)..(504): n is a, c, g, or t
  misc_feature (513)..(513): n is a, c, g, or t
  misc_feature (516)..(516): n is a, c, g, or t
  misc_feature (520)..(521): n is a, c, g, or t
  misc_feature (523)..(523): n is a, c, g, or t
  misc_feature (526)..(526): n is a, c, g, or t
tgttgctatttagtaaactagcaaatgatgcatgtatttgttttncatgtactgggcaatatgagtaaaatctgtcccgttttccccctttgaatgaggtcttccatgtttgagggaaagtcttgcactatgcatatatttnggggacacagattttcatagtttccattttgggggggcttaaggatttnttttttntcctgnttggaaacagttttatactttctggatatagtacttgaaattcttaccagaaaattacttgggagtttggaaggcctttataaatactacttttaaagaagcagtggttttatggtcaatgnttttttttcccccaagcatatttctggtattccggttcccatattattattattttanaattnccaatcaggatatggcccgncatccatganaacggtncgggcnccnaaagtnttgncaanntgtnncggtgtnctnaagacaaagtngagcaaagagccttcagcttcagtcttnacataccangantaanncnttnaaacatcatatgggagaagtctacatggttgatggtcaccggcagtacgtggggagtttaaacattgttgtcctcttttcaggtgaaacagagtaaaaatattcatctaccattagtgttatggcggatgggaaaatgcgagggaaatatagctatccttatgacattatgtgcaacccaaattggttttaccatcttgggttttagtaggtttagaagacactggttacatctttatggctgaagggtgtaagcattatatgctagtagaatctagttaattgttccggtggaagtatcttggttccatatggatgtgttggttaacaacataatttggtgttggaaaaaaacaaaaaaaatatggtgggctgggcagaagtttaaacatgtgggggccaaggagatggtacttcagagatggtaagtgttacaaagcggggggttaaccagttggtttgtaggaaaacgggg

SEQ ID NO: 599268 - DNA, 446 bp, Homo sapiens
  misc_feature (9)..(9): n is a, c, g, or t
  misc_feature (23)..(23): n is a, c, g, or t
  misc_feature (52)..(52): n is a, c, g, or t
  misc_feature (79)..(79): n is a, c, g, or t
  misc_feature (193)..(193): n is a, c, g, or t
gaggccccnggattggcccacgnagacgggctatcatcggtgccccacaaanactgcccatggtcccttgtattgacanacccggtctaccaccactacccactgatggtgaaggacaagacttccctggcatccccatcagcaaagtctcaccacagcctccaataacaactacagtctggcccaagtgtgngtgtcacgcctgtaatcccagcactttgagaggctgaggccggtagatcacgaggtcaggagttcgagagcatcctggccaacgtggtgaaaccctgtctctactaaaaatacaaaaattagctgcacatggttgcacatgcctatagtcccagctactcaggaggctgaggcaggagaattgcttgaacctgggaggcagaggttgtagtgagctgagattgcaccactgcactccagcctggtgacagagc

SEQ ID NO: 599269 - DNA, 156 bp, Homo sapiens
cgtacgtgggtaccttgaagggaaaaggcagaagtttattagccaagtgggcaggctatataggaccaggcatgtgatggcttgtctctggagtgctttactactttcataaggccagtcgtttaatcagtgaactctccagctcttagatctcat

SEQ ID NO: 599270 - DNA, 144 bp, Homo sapiens
tactcacgcgtcgtccagaatttagtcagctactaaactcagatcatgccggaagggtccgaagtcgcatgaagatgtgtcctgccacacctatataataccgtccttccatctcaattcatacttcaatttgattagctctgc

SEQ ID NO: 599271 - DNA, 174 bp, Homo sapiens
  misc_feature (39)..(39): n is a, c, g, or t
aagttacaaaaaaatctgacagcaacaaacttaaatatngatagttacctctgtatgtacaacacgcatgcacttttcctctttaggtttgggaaagttcaagtaatagtgaggctgcgccctggtggggtgacacgccgggagaaatcagttggtgggccagcacaagggtgg

SEQ ID NO: 599272 - DNA, 413 bp, Homo sapiens
  misc_feature (128)..(128): n is a, c, g, or t
  misc_feature (132)..(132): n is a, c, g, or t
  misc_feature (135)..(135): n is a, c, g, or t
  misc_feature (139)..(141): n is a, c, g, or t
  misc_feature (143)..(144): n is a, c, g, or t
  misc_feature (282)..(282): n is a, c, g, or t
  misc_feature (296)..(296): n is a, c, g, or t
aatttttatcctttcctctgagtttggacaggagccatctcaaacttaatgataacctctatttatgtagcaccccacaggtacaaagagctcctttcatgtgatctttatcatctgtgtggaaaatntacnatnatcnnnanntgatagctgaataaactgaggctccgggaagcttatgtgttgctgtgggccatatgactagtctatatcaacattagtgttgaatgtggggcgttagctttactctgagacctccatagacctcagtgtgaacacttnacactcactgtgangagtgtgattagattgccccagaattgctggcatgaactttctctgtctttaggacagctctgtcatccagaggacaaaggtttattgggctcacactatttcttgccactccgcta

SEQ ID NO: 599273 - DNA, 378 bp, Homo sapiens
cctgggtcttcgccctgtcatccatgctggcgcgatctcggctcactttgacctctgcctcctgggttcaagcgattctcctggcacagggggctgagcagctgggattacaggcaggcaccaccatgctgagctaatttttgtatttttagtagagaccaggtttcgccatgttgcccaggctactctcgaactcctggcctcatgtgatccgcccacctcagcctcccaaagtgctggggggacaggcgtgagccactgcaaccagctggaacaatcttgatattagggggaacaagggatttcatagctttctctgaaggaggaaacactgggagcatccccccgagaatcaacactgtggatcattctggggga

SEQ ID NO: 599274 - DNA, 636 bp, Homo sapiens
gaggcgcctgggcctctttcccccgtttcacgcccacgtgggacccctctccctggcccccggaaccttccacggcgtgttggggggtctcgaggaattgtctggggagccccattttcgcccccacttcacgaggtatccacgctccccctccacgggtgtagaagacccaccccccctcggttacctgagatgtttggccccccgagagggaacctcggccgtgttcgcccccctttcaccaaccccaaccggggcgccaacattgggggagagttatatttactcccgggttgccctctctacagagagctcccgcgagaatgtggccctgtttcggctcctgctcttatccccaaaagccaccccacgccattatccagaggtggaaggtggagtccaggccagccttccatgaatgctgtgctctggctacagccacacacacacattgggccagactgaagacccctcgccctatcttgccatgagactgatccgcctgtgcccacccttcgctcttgaggagctcaaccggtctggccgggcacccaggaggctttttgggctttggactcccccggaatgcgtgggccaaggaatttgggctaagtagtcataataaattaggacccc

SEQ ID NO: 599275 - DNA, 373 bp, Homo sapiens
  misc_feature (324)..(324): n is a, c, g, or t
cctgaaaatagccgacggaggagaaaaaaggcagttggggagttctgtcatggtgcagcagaaatgaatctgactaggaaccatgaggttgtgggtttgattccgggcctcactccatggatccggccttactgtgagctgtggtgtaggtcgcagaagcagctcagatcctgcgttgctgtggctctggtgtaggctggtggctgtagctcagaacggacccctggcctgggaacctccatatgccttgggtgcggccctaaaaggacaaagcaaaaaaaaggcagtcgggatttggacagggcatggtactggcatatatangatcaactttaggggacgtatggcgtcgcgctaacttttcccgggctac

SEQ ID NO: 599276 - DNA, 998 bp, Homo sapiens
tgagtgccctgtgattgcaccttgtgatttactgcactccaggctggcaaaagatagcgagacctcatctccatactagaaaacataaactctatggtaaggaatgatgttctgtagagatggtctactcaacttgaggagtactcgagtctagtcatgcgttcttcctcagcctcggggagcacgcagtattttcgacatatgtaaagattcatttcacccatctatcggtttttgcactggttagcaccatctgtgtatgttcgtcattcttgagtttgcttggtaccacttcttgcgtgccttacttatttgccatttgttggaatgctatcgttacatctgtcatttttgtaccactaaaaaaatcgctatatatgggcaggggtgagaagacatctcattgagacatctatggtgatgccaagccctggcattatggcaatatcggtggaagagcgttcgtggcactcaatgtatgccttgtcttgcctcgaggtcctcatataccggggtttgttctctcatgtcatatgcggaactctcgaatgcatgagattgtatcttgaaatatccatggagcgtcgtccctgttttgaggctagcccgtgatcatgctgttgtcgccgggtcaaccagggtctcgcaaattgaattcatccaggtcagggcgcagatgtgtgaaaggagacccctatatcgcggatgtgcgtgaaccctggtctcggggagaatgagactagtcaggctatcagtgttgcagaatgcccctctactttgtattccacttagtgtgaggccccggtggcatctgctgaatgggacagaaacttggcgtggttcaacacggggacccacaaaaaaacgcgggggggggcacaaatctaacatcgtgggcggccaagtcaggtcagtcccacggcggggggcgcacaacaccgggcgtccacacttgtgtttctcgtccccgccccctcgggacacgcagcgtcaacgca

SEQ ID NO: 599277 - DNA, 200 bp, Homo sapiens
gcctttggctctgagcataatggttcacacatttttatacaaacgcctcgatttaccaactctattcaggatccagcaaaaggacactgactatctagctagctatttgtggtcaagtaaacacacaccaccaccaggggctaaaaggtccagtctcagtgtagagcagtctcagggaagacatcaccaaatgtcgacgc

SEQ ID NO: 599278 - DNA, 168 bp, Homo sapiens
gagccagcgctgacccctagtgtagaagttcaactagcgatatagatagcttagaatctatttacagaacaattagaaaagatgacagaataacaacagaaggattgaaaaactttattcctgctttattattcaatgaacgtcgttatagcattatctggggatcct

SEQ ID NO: 599279 - DNA, 238 bp, Homo sapiens
tatacaccaacttcctagtgtgcagccaggctgtgggccccgtgctgggcttttttttttgagatggagtgttgccctgttgccaggcagagcttgcagtgagccgaggtggtgccactgcactccagcctgggcaaaagagctagactctgtctcaaaaaaatatatataaaaaaaatttctaagtgatgaatgcttagggtatagctgcttatttcttactgtacgggggtatcag

SEQ ID NO: 599280 - DNA, 380 bp, Homo sapiens
ctgtaccctcggtctgtctgtgtagaaagaagtagacatcactttgttctgtactaagaaaaattcttctgccttgggatgctgttgatctatgaccttacctccaaccatgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggcctcagggtcctctgcctaggaaaaccggagacctttgttcacttgtttatgtgctgaccttccctgcactattgtcctatgaccctgccaaatccccctctgcgagaca

SEQ ID NO: 599281 - DNA, 242 bp, Homo sapiens
aacgatacgattgccagatggctatgcgtgcatcagcttgcgtcatcatactttgacagcttcgtggcttgtatgactccgcctggtagaccctcattcaaactattcagccttctggacgaagcacaaggatggcatggttcagctctctctggccgagtggctgtgctgcgtgttgttctgacccggggtttcggacatcagtgacactccctgccccactgcttgcttcttgtcacccc

SEQ ID NO: 599282 - DNA, 771 bp, Homo sapiens
  misc_feature (3)..(3): n is a, c, g, or t
  misc_feature (27)..(27): n is a, c, g, or t
  misc_feature (41)..(41): n is a, c, g, or t
  misc_feature (43)..(43): n is a, c, g, or t
  misc_feature (52)..(52): n is a, c, g, or t
  misc_feature (57)..(57): n is a, c, g, or t
  misc_feature (72)..(72): n is a, c, g, or t
  misc_feature (77)..(77): n is a, c, g, or t
  misc_feature (83)..(83): n is a, c, g, or t
  misc_feature (92)..(92): n is a, c, g, or t
  misc_feature (111)..(111): n is a, c, g, or t
  misc_feature (129)..(129): n is a, c, g, or t
  misc_feature (138)..(138): n is a, c, g, or t
  misc_feature (158)..(158): n is a, c, g, or t
  misc_feature (170)..(170): n is a, c, g, or t
  misc_feature (175)..(176): n is a, c, g, or t
  misc_feature (179)..(179): n is a, c, g, or t
  misc_feature (186)..(186): n is a, c, g, or t
  misc_feature (196)..(196): n is a, c, g, or t
  misc_feature (218)..(218): n is a, c, g, or t
  misc_feature (239)..(239): n is a, c, g, or t
  misc_feature (245)..(245): n is a, c, g, or t
  misc_feature (248)..(248): n is a, c, g, or t
  misc_feature (250)..(250): n is a, c, g, or t
  misc_feature (253)..(253): n is a, c, g, or t
  misc_feature (258)..(258): n is a, c, g, or t
  misc_feature (266)..(266): n is a, c, g, or t
  misc_feature (277)..(277): n is a, c, g, or t
  misc_feature (279)..(279): n is a, c, g, or t
  misc_feature (295)..(296): n is a, c, g, or t
  misc_feature (300)..(300): n is a, c, g, or t
  misc_feature (313)..(313): n is a, c, g, or t
  misc_feature (319)..(319): n is a, c, g, or t
  misc_feature (322)..(322): n is a, c, g, or t
  misc_feature (329)..(329): n is a, c, g, or t
  misc_feature (345)..(345): n is a, c, g, or t
  misc_feature (367)..(367): n is a, c, g, or t
  misc_feature (374)..(374): n is a, c, g, or t
  misc_feature (382)..(382): n is a, c, g, or t
  misc_feature (395)..(395): n is a, c, g, or t
  misc_feature (397)..(397): n is a, c, g, or t
  misc_feature (402)..(402): n is a, c, g, or t
  misc_feature (413)..(413): n is a, c, g, or t
  misc_feature (425)..(425): n is a, c, g, or t
  misc_feature (441)..(441): n is a, c, g, or t
  misc_feature (443)..(443): n is a, c, g, or t
  misc_feature (449)..(449): n is a, c, g, or t
  misc_feature (458)..(458): n is a, c, g, or t
  misc_feature (462)..(462): n is a, c, g, or t
  misc_feature (490)..(490): n is a, c, g, or t
  misc_feature (588)..(588): n is a, c, g, or t
  misc_feature (632)..(632): n is a, c, g, or t
  misc_feature (670)..(670): n is a, c, g, or t
  misc_feature (672)..(672): n is a, c, g, or t
  misc_feature (686)..(686): n is a, c, g, or t
  misc_feature (704)..(704): n is a, c, g, or t
  misc_feature (743)..(743): n is a, c, g, or t
tgngttccaaaaaattttatttatggnctcttaaatttcananaattttcanttgtnaaaaaaaaatttcanctgtnattgtnaaagaaaantattttgatttttttaatnattaaaaaaagtaaaaancactctcanagcccttaaattaaaaaggnggggggccaganttggnngcnggggggngtttgcagancccagttctagagggggaaacnaatggtttaatgaccaaagcngcggcncananaanaaganagaaaganatgggccgggngnggggactcaggcctgnnatcncagcactttgggngactgnggnggggggntcacttgagggcaggngtccgagaccagcctggccaanatggggnaaccccgnccctactgaaaananaaaanattagctgggngggggggcatgngcctgcaatctcagcnantggggnggctgaganaggngaactgcttgaacctgggaggggggggntgcagtgagccgggatcccaccactgcactccagtctgggcgacacagcgagactccaactcaaaaaaaccccaaaaagacaggcagggtcagaagtntgagttctggattccaaggtggcaggtgttatcagggagctaanaattcattatttttctcattcttggtccagttacctananaaatggctcctgtnattacaagaccaggaggnagggccaggccctggggagaggagaaggggctggcagtncaggagtgagagtcccagggaatggccc

SEQ ID NO: 599283 - DNA, 148 bp, Homo sapiens
aacaacgatctgagcctgggatgcaccaactgataatgcgtctgtcacgggtactcccagtagtgtctgcaagaaacatgccttgtctcccaaattgcactcagtactcactgttgcaagcatcctcccagttccacagcaaatcact

SEQ ID NO: 599284 - DNA, 133 bp, Homo sapiens
ggagttggtatgaggtgcaggtgggcttcaggaatggctggatccaggtatcatgttcctgactgtcatgattcgggctcatttgtaatacggcccctgtgtgttgaggtcgctgtagacatccgacctctga

SEQ ID NO: 599285 - DNA, 940 bp, Homo sapiens
ggaggagtggagtggccgtctagtgtcgacatgctgctggaggaggttcgcgccgtgagaccggctgagtggggcggcggccggggcgacgtgcaggagtgtgcgccgccttctgcaccgcgagctgagtgcatcccgacgccctcaaccgcttaccggcaaaacggcgctgcagagtcattgatgctttgtgtcatgcgaccgccgatcgtccgtggatctgccgtgaagctaaagggtgccatcccacaatggtccaggacaccgtccgtgtaccagtccagtccatgacgcagccacgcactggtattcctggtacacaccttgaaggtccatagtggagcacgtgggctgatgtcaacgtgcctgatggcaccggggcacttccaatccatctggcagttcaagagggtcacactgctgtggttcagcttactggcagctgaatctgatctccatcgcagggacgccaggagtctcacacccttggagctggcactgcagagaggggctcaggagctcgtggacatcctgcagggccacatggttggtcccgctgtgatctggggctcaccctctccagccacgagaaccccgtggggttatgtatcagacagagagggggaagaaacactttctcttcttgtttctcctgcccactgctgcagtaggggaggagcacagttttgtggctaataggtgtaggaaaggacggtgtgagtgtagggggacgtactcaattagtaatctcactcctttaggtgtgttggacagagaaggggctccttgcaggaccatagtcagctaaagggttccagttcttctgcgccttcagcttgctgggccctcaaacgagacccagggccagagcaatttagaagtgaagtattgactccaggagctaaaactggtgccttggccgcattggactacagaaact

SEQ ID NO: 599286 - DNA, 1359 bp, Homo sapiens
ctattgttggacgtgctccttgttagtaggctgtattgttttgtttcaccgacgacgaacgctgtggaggggtgctgtcactacaaaggaggtcactctacctaccgcgtactgggtgtttttacagggggcccgtgggggcaacagaacataatttctctagtagtctactctagtgtctcccggtttgtgtcgtcctggttggtttgttccctcccccctcctcatttggtgtcgagcctcagcgtgtgtgacaaccctcttgttgctacaacaggggcggcgcccccccggaggtgtttttctccgccctccccggggggcgtttatgctaaggggccgtggcgcgtgttggtgtctcgctccctcgcgggggttgctcccctccctgtggggggcgtttgtttataccgcccccttctctttcaaggcgtggtttatcagctcgcgggcgcgccaatggtggttgttggtagagcaggtgcgtggttggtgtccgcccccggggtgtaatagagtgggcggttttttatgagagaaaggttttgtcgcgcccaaaaaacactgtgttttgtctcgcgcccagtgtgtctctactgagagaggagagagagagggcaacacacgcttttgagagcataccttgtgtggagagactctccacgagaacacccacacgagggggtggcgcccgagaatatttcttcttctctcagagatatctctctacagaaatctcccgcgccttgtgagatgaacctgggagagagaccgcggcgcgtgagaaaccccacatgtgagagggtgtgcgcaataacacattgtgtgagagaatacaaatatatgtgagaactctactactctctctctctctctctgtgagaaccggcgacaccacaacgtgtgccaccctgaccccacaaagtgtgcccccgccactttgttgggagacgctttctttggagaccaccaccttctccctgcgaataagacaccgcggtgtaaaaccactctctcacaaagaattgtggggacaacaccgggccacacaccttggccacacaaatgtggagagccccccaatatttgtggctttcggcggaaatatattttttttgacacaagacacacccctcgggagaaacacactgaatataatgtgaaagtataacctcccgggtataattttcccaataaacccgtcgggggagactttcccgggcacccaagcacgcggcacacgacaacatttggggttttccttatccctttttaaaaaatgtgcccccaacacacccccctaaatttttttaattgtcacccctcccttcccaaaaaaaaaaattgtggacccccaca

SEQ ID NO: 599287 - DNA, 1609 bp, Homo sapiens
gggcgctgtccatggcgggagtgctgcaagcaagcaggctcaagcaatattgtacacaaaagcattcttgcatgttcattgcaggcaacatcccatcaaaaaatgccagccatcatcagcaacagtcatcaccagcaaccatgcattcacaaacatgcagcaatgcttggcatcatgtgtataaacagctgtgcaacccagcattgttcaacacaacattccagcacagcaccgcaacatatccaaatgtgctgtgtcccacattacagcaacagccagggtggcattccttaccgtggccttgtgcaaccattgcacaccttcaccaatcattgcggcccaaggcaaaacaaacatatgcagggtgcacatgttgcacacaacatacaattggggtagaccgcactgtccagcttgtcgaaccatgacatgactccattccccatgtgccccctgtcaattccatagatgtggtacacaaacctggatgtcacccaaaagttaacttctaacgtgtatacgttatcacacatgcatggaagccactaatatagggagaaatgatcgggattagtctacgttgtaggatggcacaaaaacaacgtttgggacagattggattaagcactgtcgtacaacaagcattcacttacatcccgatgtgtgatatatgatacacacatatgatccacacagcgcacagtcagcacgtgactagtggcttcgctcccgatgttgtcacagtttcgtacatcacattcggcgacacccaacaaataatgcactcactgagtgctcacatattgcccgcacacatcgtagatcgcaaaacacaaggcagttgggcacagtatcagatgtacagcctaccacttcacacactatcacgattggctgctcacacgggacgtgagacacacgtcaacaacgcacactgggtgccacagcgcatcacacagcacgagcagcacgactctgactgaggagcgatatcgaggacaactctactcacccattggagcggctttccaccacctttgcacacatggagcgaatcaccaacagtctggacatcggacacgaacgagtacccacacaacatcaatcatcacctcacgtcgacgaattgatacgagcacatgacacgcacagacacggatcacaccgtaccacaacaccacctgccaccatacacgacagctatatggcactaataccccacaccccgtacgagcaccacattgggcaccatgcaaccgatacgaaccccattagtgcactaggtatagacaacgatagatgtacacgtcaataaggcggtgcatccacacataggttggtaggataacaagagaaacacatctttatgtgaagtacatccgcatcacctttactcacatttttctcacactacctgttgcactaactatccaatctttaatccctacgtaataccaactgatacatattgctaatgcaacctcaaccgtgtggtccaagagtacaaagtggacaaaaccccaccagctcatacacccttttacaatagatccaccgactgagtaataaacatacgattagtcaatcgatttattccagtcgatctcgg

SEQ ID NO: 599288 - DNA, 275 bp, Homo sapiens
ctacgcgcctgctgaccggtgatgagcgggaagtgcaggcggcgtttgcccgcgccgcattcaatgtggtgttccacaaccgtgatgatcacccaagaaattttgcctggcgactgggtcgtgattctcgctggcggctggctcctgctttcgatctcaccttcagcgaggggccggcggggcagcacagtctggatgtgggtggcgaggcggacgtcatcacccggcagcatctactgaggctggccagggataacgacatcccggccgctgtg

SEQ ID NO: 599289 - DNA, 508 bp, Homo sapiens
caccttttatatacacttactgtaattttaactttcatgttgtacatttgattcctttcataggatctagatctctggtgaaattctctgtctcttcttgaacatattaatctcttatctgaaacagattatagctatagatcttatagctccaatttctcagtcacttttggatctgttacttttggttggttttctgtcttgattattggccatttgttcttgtttcctggcatgcctactactttctagtgaatgacagatacactttttatggaaattgtacaagttttgaatgatgttatctttctccaaagatgatttgattttcttctggcaggcagatagagtacaggaaaatcatcttaatccagttgaggctggtatatttccagtttgctcttaccctaggttgtagttcttcaggggcctcaaggaccttgagtatttccatggtcctacttctttgaaagccctgaactctgtgagacactgagactgctacaat

SEQ ID NO: 599290 - DNA, 140 bp, Homo sapiens
ttagtatcatcccccgctgacggccgcagccagacatgcctgaacgcagaaacatactacctatactacacccatagtaggctccctacccctactcatcgcactaatttacactcacaacaccctatgctcactaaaca

SEQ ID NO: 599291 - DNA, 281 bp, Homo sapiens
  misc_feature (238)..(238): n is a, c, g, or t
attggctcactgcaacctccagctcccaggttcaagtgattctcctgtctcagcttcccaagcagctgcgattacaagcgtgcaccaacacgctggactaattttcgtatttttagtagagatgaggtttcgccatgttgcccaggctattcttgaactcctgaccttaagtaatccatctgcctcagtcttccaaagtgctgggattgcagaagtaagccaccatacctgttcctgncctgggctgattttttaaaatttatttttttgtaggagagagg

SEQ ID NO: 599292 - DNA, 209 bp, Homo sapiens
  misc_feature (55)..(55): n is a, c, g, or t
ttctactctctgcttctatgagtctattaacagatgaatggatatacaaaatccncgctgcggggtgcaatggaatattattcatgcataaaaaaagaaggaaaccctgccatttgcagcaagatggatgaacctgcaggacattgtgctaagtgaaataagccaaacactgaaccttctctagattgatgttcctcccactgtgtttc

SEQ ID NO: 599293 - DNA, 627 bp, Homo sapiens
gtgggggggggtatatcaaagaaaaaacggcgcgcggcgggcggggggggggggtggtgtttttttttaggggggggggggggcaccccccccccccccccccccccccccaccaccccacgtttttttttattttaaaaaaaaaagccccctccttctctcccccccccccccttatttttttttttttgttttgttttaaacacaaaaccctccgtttgtttgtataaaaaaccaccttttttttttttttttttttttgttttggggagaaaaaaaaaaaaacccctcttcttttcctttttaaaaaaaaaaaaagagagagggtggtgtttttttttttggagaaaaaaaaaaaaacccttcttttttttttttttataataagggcccccttttctccggggaaaaaaaaagagcccccccatatttaaaaaaaaagaagggcccccccccacacctttttttaaatccaaaaaaagggggggggggcccgggtctttcccccccttttaataaacacctcttttaaaattgggggccaaaaaaaaataaaggcttttccccttaggggcttaacctaaggcgaaaagccccttggggaaagtccccttcaaggtccggtta

SEQ ID NO: 599294 - DNA, 508 bp, Homo sapiens
  misc_feature (17)..(17): n is a, c, g, or t
  misc_feature (39)..(39): n is a, c, g, or t
  misc_feature (491)..(493): n is a, c, g, or t
  misc_feature (497)..(498): n is a, c, g, or t
cagccctgacgcttccntggggccacttccttctttgtntcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcnnnctannggaattcaat

SEQ ID NO: 599295 - DNA, 421 bp, Homo sapiens
  misc_feature (404)..(406): n is a, c, g, or t
  misc_feature (410)..(411): n is a, c, g, or t
ttgtaaatgcagaagttctggaggttagaagttgaaatcaagatgtccgaaggctcatgctgtctctgaagactctgtgggaggaccattccttacctcttcctagcttctggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcnnnctannggaattcaat

SEQ ID NO: 599296 - DNA, 416 bp, Homo sapiens
  misc_feature (399)..(401): n is a, c, g, or t
  misc_feature (405)..(406): n is a, c, g, or t
caccctggctacacatccaatcacttggaggacattttaaaattttttccattcctgggactgcaccccaaaccaatgaaatcagaatctctgaggccctaggaaatgggtattttctaaagactgaacaggtaattcatacgtgcagatagggtgggaaaccatctgtctgcacaaggtccctgtgatgttttgaagaaaaaagaagactagttgaaatattccttgattaaatttaaattaagggtgaattgattttatccatctctccatagataaggaatatcttctgatcgtcattcagaatccatgtgaatagacctgcgatggccaaggctgtttaagcgacactgggttggaaacacttggctctctcatgagtattaaaattctatttcnnnctannggaattcaat

SEQ ID NO: 599297 - DNA, 1050 bp, Homo sapiens
  misc_feature (17)..(17): n is a, c, g, or t
  misc_feature (39)..(39): n is a, c, g, or t
  misc_feature (1033)..(1035): n is a, c, g, or t
  misc_feature (1039)..(1040): n is a, c, g, or t
cagccctgacgcttccntggggccacttccttctttgtntcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaagggaagaagactaacaccatgtcacagagcaagaacttcagagcagactcactatagacaagatgttcaggggagtgcatttcatataaaaatatgttaacttagtactcaagtagtcagttaatggcttctgaaagatttatgcacaaaaatgttcatcatcaccccattagctataaaaaatataaggtaccaaatgaccaaacaataggagattgattatatgtccataaaatagtgaagtatgcagttattaaaaataatgttgatgacattgtcaacaaggacaacttgtatgttataattttgtgaagaaaaaagcaacagtcaagtttgtaaatatagtttcacacaactatacttaaaaatctacgtagcgacaaaaggatttgagggaaataaactaaaattgttaccagagagggataagccatcacttttttctcttctttacaactatcagtattttccaatacttccacactgtacttattacttttctaatcagacaaaaatattaaccaaaattaaatttcataataggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcnnnctannggaattcaat

SEQ ID NO: 599298 - DNA, 81 bp, Homo sapiens
ctagaagattcagcaaagtacttttgtgctcttggggatcaaggggcattcgcactgggggaaaacaccgataaactcact

SEQ ID NO: 599299 - DNA, 102 bp, Homo sapiens
accactttctcttctctctggtacaataggaggcacaatgttccccatggttctacacaaaggttctattgcactaagttgtaaagccttgtgtatacacaa

SEQ ID NO: 599300 - DNA, 543 bp, Homo sapiens
cacgaggggccatcacgttttcgggcacggttcaaccattgacgagttgcgagaagatcaggccactagcgcagatcgtcctccaaatgagatcctggcagatgctttcgcggccttcgtcttgatgccgacacttggcctgcgggaagcttttgcgaagcgcggactggatccgaaccgtgcaacagcgctcgacatgtactccatcgcctgcaacttcggagtaggccaggcgactctggtgaatcacctcgcctatggcatcaacatgatcaaccaagcgcagcgtgatcgtctcgggcgtattacgccaaagatgattcgcacggagttgctcggcgaagtcgtttccacgcccctaacggtagcggatcagcattggaattcaccgacgctcgacacggagcaggacgcgctgctgctgcttccttcgggcgtggtcgtggacgcctcaatgcttgtgcccgagcgtgagctggctgctgggcgactttttcgcgctgcaaagtgtggcatcactcgagcggctatacccggcacacc

SEQ ID NO: 599301 - DNA, 80 bp, Homo sapiens
ttccttttttctgttgttgttgaggatagatcacgatacagaaaaaaggaataaaatatcctttgtttcctagtgaaaaa

SEQ ID NO: 599302 - DNA, 221 bp, Homo sapiens
gctgcttcgtggaggtaacttcaaaaaagtaaaagctttcctccgcctcatcttagacttgtttgaaataacccccccgtttctattcttaaaccttaccatttttgttttgttttttttttttgagtcggagtttttttctttttccctaggctggagtccagtgagctgagatccccccttcccctcccccctgggtgatagaccaagactctttctca

SEQ ID NO: 599303 - DNA, 209 bp, Homo sapiens
ggaccggtccgttctgcacttcggatcatataaaaagaaactaggagaaacaagcaaaggtaacccaagcatcattaggaattgaactcagtaattcccaagaacacaaagtagtagagaatgatggagatgttattttaaatatgaagaaaattataccaagtcacatcataatcaaagtatttgaagccagtaataaaaaaatctta

SEQ ID NO: 599304 - DNA, 205 bp, Homo sapiens
ggcacgaggtaatggaggaggtgcctcacgactgtccaggggccgacagcgcagggcggcagaaggggcttcatgtcagggatgcccaaccagcggctgtgcgcttctggagcgggggccactgcgacgcacggtagtagagcgaggtcaggggacggatggagacgtgtaaaacacagaggtgtggagaatttcttggaaaagc

SEQ ID NO: 599305 - DNA, 139 bp, Homo sapiens
ttcggtcgcgcccctcccctgtggttctgcccactgctccagtctcctgagacttctgggattctgctcaacatcaaacgatcttccccctctctctcagcgtttgttttacatccatggatgcaataagcatggcagt

SEQ ID NO: 599306 - DNA, 100 bp, Homo sapiens
tagaacatattgtcattaggatgagctgttattagatgaaatctacacatcatttcattacaaatagtgccttagaaaacgcaaagctagtagcacatgg

SEQ ID NO: 599307 - DNA, 202 bp, Homo sapiens
attggcattcatagctgcagatggttgaacacacatacacgttttttttatcagagacagggtctcccatcagtcacccaggcgggagtgcaggggtgtgatcatagctcagggcagccttgaactccggggctcaaacgatcctcgggcctcagcctcccaaggtagctgaataataggcatgcaccatcgtgcccagctg

SEQ ID NO: 599308 - DNA, 198 bp, Homo sapiens
ttcatatggccagtatgatttattgtttatttttttaaccaaaaccccccccagtaatttataatggctttccagtaatgtgtatcaaataaaaagccctggaaaaccgatcgtttttaggataatatgcatgtttcaagtggtattgaaaccccccctgatggatatgtaataataaacatatctgttttttatata

SEQ ID NO: 599309 - DNA, 329 bp, Homo sapiens
ggatggtcatagactaaaaggcatgaaaagtagcaaggggtgaagccatgggtatgcacggttagttcggagagcaaagagactagctgcagttgactcgtccactgatcaaatgatcagctggtagggctgtacagagtaatatgtcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttaca

SEQ ID NO: 599310 - DNA, 997 bp, Homo sapiens
ggggtcgtggggacgggaacatgtgcccgaccgtccatcccgctcgctcctccttaggatgcataacctaccttgtttttgtttttaaattttctttccaggtagagtagctcttggtacctaaggaatacttgaaaaattaatgtatgatgtatgagaagacagagtctcctagtttggcatcttgtggtatgactgccatgagttccaccagaaagccactctatttgggtctctgtgacattttaaatgcgtgacagaaagtgagcaaataaagtgaggaagaaatcaaaaaacaaaaacaacaacaacaaaaaaacaacctgtttggtgcgccgcagtactacgcccgtggtagaaaggcttttgctcgatcaccacttctttttgtggcgcaccgcacggccacatctacggcatgacgtgacccaacgtggccataacctggctggttcccaaagaaaacactcggtgcgcctacatacagtatcgtgagattgccccacaaattaaaaagccggccggcgtggcaccacggcggctttgcggaaaaacctacccgaggtgagtcctgaaggcacccccacgggggcgacatcacaccgggggggctccaccggggaaggtcatgtcatttaatatattagccccccccccgggtgaggttctattccgcgcctactccacctcgtcatctacccgacgccccgtgagcttccccagaacaaacataccaggtcacgcaactaacgcacaagccatcaacagacaacaccaacagcgtgtcgctcagcaccaagacaagctaatcaaaacagacaaacgacacaacccgatagtaacgtaagaccagcacacacaaactgtaaaaccaacaagacgatgaacctacactacgacaccgagttgcacaacgtagccgcccacatcactgccaaccgcaccccgatagcagccagaccacgcgccacctccagcctcctaacaccaacacgtg

SEQ ID NO: 599311 - DNA, 973 bp, Homo sapiens
  misc_feature (16)..(16): n is a, c, g, or t
ggggtttccgaacgcnggcttctcctctatttcattggggggtttgcccccgctctttgtggtttccccgcccccttcatatcctgctgtctccattagtggtgttcgcatagtgcttgctgtgtggccccccttttgttaagcacgctgcgcggcgcacctagctgcgttgcttgttagtgtgcactcacttttcctcacggccggtctccgggcgatgtatgtggacgccctgctgcgtgatgtattgtttccggccgcgcgcctcactatcatatgtgagggtggctgctcatgtgcggcgccactcgctcacattcacttatcgcggctctgtctttatttgtagatgatgcagcgcagcacgggggtgtagcatagatcttcctccctccttttattcgcacgctgccagctatgattcgttggtggtcacgcaccccagcgttggggtgtgagttttcactctcgctcgagtggtcacaccgccgcttgctgtcgcgcgtggggctggatatattttattcttacctcgctctaacatatagtgttgccccaccgtatttttcgtttgtaggcacgccgcggggtcgctgcggggtctcctcttctggtgctgggtcacgatctgctgtgtgttgtttttcctccgcggtggtggcaccctcctcttgtgtgttgaaggatagttacgatcaccacgaagatgttttgcccttctatgggaggtgtcaccccactaagtggggttatcagcaagaaggccactttcgcgcgaggttgttgatcaccccacgcccttcttcccccgccaaccgcccgcgggggttttttttccgagggtcctattttttaaattttggggcccacccccctcttttttccccctttttttgaattatttcccccaaaattttttaaaaagggccccttttttcccttttcccccccctttcccccctttaggccccca

SEQ ID NO: 599312 - DNA, 681 bp, Homo sapiens
agcatctaaaaaccataattttactctatatttccatgagttgactattttagatacttcacatagtggaatcaagtactatttgtctttcttgtactgtcgtatttcacttggataatgtcctcaaggtatatctatgtaacagaattttcttctttttatggctgaataatattctattgtataaatatatagtacattttctttatccatacatatgctgataaacttttaggttgtttctaattcttttcttttttgagacggaatctcgctctgtcacccaggctggagttcagtggcgtgatctcggctcactgcaagctcgccgtcctgggttcacgccattctcctgcctctgcctccggagtagctgggattacaggcacctgctgccaccggctcggtaattttttttcattattttagttagagctggtgtttcacccatgttagccaggatggtctcaatctccttgacctcgtgatcttgcccgccttcggcttccaaaaaatgctggcgattacacggcttgagccaacggtcccgaccagttgttcttaattccttatctatggtgaatactgctgaatgaaccacggaagggcaaatttcttcctgtcctgtttcagctcttttggtaactgccagaaggggatcgtgatccatgtcaattattc

SEQ ID NO: 599313 - DNA, 810 bp, Homo sapiens
  misc_feature (22)..(22): n is a, c, g, or t
  misc_feature (96)..(96): n is a, c, g, or t
  misc_feature (105)..(105): n is a, c, g, or t
  misc_feature (114)..(114): n is a, c, g, or t
  misc_feature (236)..(236): n is a, c, g, or t
  misc_feature (240)..(240): n is a, c, g, or t
  misc_feature (260)..(260): n is a, c, g, or t
  misc_feature (310)..(310): n is a, c, g, or t
  misc_feature (498)..(498): n is a, c, g, or t
  misc_feature (510)..(510): n is a, c, g, or t
  misc_feature (517)..(517): n is a, c, g, or t
  misc_feature (521)..(521): n is a, c, g, or t
  misc_feature (526)..(526): n is a, c, g, or t
  misc_feature (529)..(529): n is a, c, g, or t
  misc_feature (533)..(533): n is a, c, g, or t
  misc_feature (551)..(551): n is a, c, g, or t
  misc_feature (561)..(561): n is a, c, g, or t
  misc_feature (565)..(565): n is a, c, g, or t
  misc_feature (589)..(589): n is a, c, g, or t
  misc_feature (603)..(603): n is a, c, g, or t
  misc_feature (634)..(634): n is a, c, g, or t
  misc_feature (650)..(650): n is a, c, g, or t
  misc_feature (659)..(659): n is a, c, g, or t
  misc_feature (750)..(750): n is a, c, g, or t
  misc_feature (808)..(808): n is a, c, g, or t
gggtgcagaagggagaaccccnaggtcagtccaaaagcaaagatactgggagggaagatggcgctgggcgaggaactcagcactcatcctcacccnagcaggcanaagggtttncggccagccaggctggaccctggagccgaggttggggtctcctcatccccttctccctcctcatccgcatcccggtcctcctctccctcctcctcacaggagctgctcagctcttcctcttncctncctcccgccccgttcacctngcttggccccacccttgccctgcaaaaccaccagctccgtggtctctggnatgggactcccaggtgctttctgttcactgtagcctgggggatgaaaacacaggctgaggcggccgtccactgcgcagccgcaagagactgttggctgctctgtacacatcattccgagccgccttggctgtcttgtaaccacgtttctctgcccaggcttcacagatgtcccaggcacaccaggggntggttccgcctnaggggtncctnagccntcntggnttgcgcaggatggagcanggccatgcangggnaattcgggtagcccaggtaacccnacactatgttaggnctcctgggatctgggcgaatagggttagatncctgtccagaaactgncaaatggcntagggagaagagatggggaagatgaggcctcgggcagtcacagagcttcacagagggggtaagaaagtaggtctgaaagtatcgggtatgnccggggttctggagacactcacgactttccgcccaccagcccattgatcagcgaggantt

SEQ ID NO: 599314 - DNA, 84 bp, Homo sapiens
gcctcggactccgccatgtattattgtgcgagacgcgatatacccctgagaccgtactactattttgacccctggggccaggga

SEQ ID NO: 599315 - DNA, 102 bp, Homo sapiens
tggggggggggggggaaggggggaaaagggggggggggggggaaactttcccttaaaggggggcccacacccccaccaaaaaaaaacatataaacgcctcct

SEQ ID NO: 599316 - DNA, 855 bp, Homo sapiens
ggacagtgctgacactacaagggctcggagctccgggcactcagacatcatgagttggtccttgcagcccccggtaattgaagttctctagcttcgtatgctcgttttattgtctctcttcaagcagtgtgtagcatgattgttgctaccaagagacaagctgcgtgcatcttacggtgaaacgattctggtagttacttgcccatactaccctgtggcattgcagcatttcctgagtctacttgtcaaatccaaagatagacgaaggatctacagatcttgtggaacgacatcttacagtcaaggttgaaaagcaagaacagtcagaaagtcaagacgagcgtgatgaaaagcagatccatactcgacttagtaatccgtgatgaactcatctaaaatcaaatatcgatacgacgctgcttactttgacagtcgcaggagaaatgttaggaagaaaattatgacgactcagtgcaccgcattcgacttttaactacatgtactcaacgtattcgatcagtttgcaggacaactatataattgcacggataatccaaaacgatgtgttaaccgtggaccagagaagcgtagccccaagctctgaagcacagttgccagtgaaccttggcaaaggacacggtgcaatatccatgatatcacctgggaacagattgtcaagacatagccaataagggagctaaacagagcgggctttactttatttaaacctctgaaagctaagcagcaattcttagtctactgtgaaatcgatggggtctggacacatgggatggactgctgtttcaaacgagactgatggcagtgtagatccccgaaacacctggattcaatata

SEQ ID NO: 599317 - DNA, 186 bp, Homo sapiens
gactccctgaggtcctcatcttgtcctgctcttattctgtcagcagatctgatacactccttggtgtgttgacccttgcctcctaggctgcccccgatgcctagctgtcctggggaaactccccagaactctcggggaaagtgcccgacgaaccttcggagtgatgcctccggatccctcactcgc

SEQ ID NO: 599318 - DNA, 1234 bp, Homo sapiens
  misc_feature (834)..(834): n is a, c, g, or t
ttgttaatagaccgtgttgtttgggtggtggttgttccctagattgtggccgatgatgtgctttttatgttgttgtgttctcctccatggttgttgtttgcgtggatgtgtgtgtgtctcgaggggggggggggggggtttttattttgtgtgtgttttttcctccctccccgctcgtgtgtggttggtcctccgcgcgctccccacgagtttggattgaacgacatcgccccccttttatggggtgaatcccaaaacaccccacaactaacacggattttttaagggggcgaacacccttatgttaaggagacttcctggcagagggaagtcccccccccaaagggttttgggcacccccagaaaaaaccccacggcgcttttgtgttataaaaccgacctcgcgccccacgtataccattatttacacccgggtctcttaaaaaggtattgcctgaaagcgcattcggggtgtgggcgcaaatattcgcgctcccacgccagaggggatagagggaagatcttctctctcctctcctctctctctcttatagagactcgtagagccccccaacacggcgcgatagaggcttctttaaatagagccctcacaagagagaagagcccacgcttttgtgaaagagagtgggttcccacccacagcctcacccccaataaagagaagaaagagtttcccgcccaccgcttcacaccacacacactctttccgcgccgcgcgccgcagagagaccacctcggcgagatctctccgcgagagacacacgccccccacacaatattctctctctcgcgagaagagaggcgcgctctccncacagggaggaatacaccacagcgttggagaccacactaatggctaattcactctcaacagtgttgtccgctctcgagaccacactcgagagttctcgcaccactcgagaagagaagatatagagaagaccacaccacacacaccacctctgtggtttcacttgtggagttgttataagcctcacccacgcacccacgagttataaccacggctgtgagaagaaagctgtatgaccacttgaatgtggcccaacaggtcacaccacccctgaattcggcctgagtggagagaagaaagaaaggcactaatgttcgactgggctcctgaattacgatgctttggatgttgccccacccaaattggggtcatctataactgagtccccctgcctaattctga

SEQ ID NO: 599319 - DNA, 439 bp, Homo sapiens
  misc_feature (136)..(136): n is a, c, g, or t
  misc_feature (149)..(149): n is a, c, g, or t
  misc_feature (153)..(154): n is a, c, g, or t
  misc_feature (156)..(156): n is a, c, g, or t
  misc_feature (165)..(165): n is a, c, g, or t
  misc_feature (317)..(317): n is a, c, g, or t
gaggatgctccccctgcctacagctgctatacccacttgcctacatgctcatggcctaggtagaagtgagaggttataggaggtggatggtggctgatggagagtttggagggggctgatgagatgttgtaagggncatgagatgttgnaagnngncatgagatnttggaaggaggcatgagatgttggaaggagcgatgagatgttggaaggaggcatgagatgttggaaggaggcatgagatgttggaaggaggcatgagatgttggaaggagcaatgagatgttggaaggagggatgagatgttggaaggagcnatgagatgttggaaggagcgatgagatgttggaaggagcgatgagatgttggaaggagccatgagatgttggaaggagtgatgagatgttggaggcgtcatgagactgctggaccgcgcgaa

SEQ ID NO: 599320 - DNA, 517 bp, Homo sapiens
  misc_feature (395)..(395): n is a, c, g, or t
cgacgtaccatctcaccacagatccagacctctgagcccactttccccatctcatcacagatccagacctcctgagcccactttcccgatctcatcaccagtgatttctgggccctgcattagttttctattgctgctgcaacaaacagctacagactcagtggcttccatttctgtcttatagttctgattgccaaaagtcctaagaggatctcaccaggctaaagtcaaggtgctggcggggctgtgtccgccatgagatgttggaaggagcgatgagatgttggaaggaggcatgagatgttggaaggaggcatgagatgttggaaggaggcatgagatgttggaaggagcaatgagatgttggaaggagggatgagatgttggaaggagcnatgagatgttggaaggagcgatgagatgttggaaggagcgatgagatgttggaaggagccatgagatgttggaaggagtgatgagatgttggaggcgtcatgagactgctggaccgcgcgaa

SEQ ID NO: 599321 - DNA, 355 bp, Homo sapiens
  misc_feature (233)..(233): n is a, c, g, or t
tatctcatggttagaacattcacacattccccagcagcgtgtgcgggctgactaatgtttacaattccaactaaaaatcaccctgcttccgccatgagatgttggaaggagcgatgagatgttggaaggaggcatgagatgttggaaggaggcatgagatgttggaaggaggcatgagatgttggaaggagcaatgagatgttggaaggagggatgagatgttggaaggagcnatgagatgttggaaggagcgatgagatgttggaaggagcgatgagatgttggaaggagccatgagatgttggaaggagtgatgagatgttggaggcgtcatgagactgctggaccgcgcgaa

SEQ ID NO: 599322 - DNA, 255 bp, Homo sapiens
taccagatcaagccgatctggacctacacacagctcactggaacactggatccttaagccactgagcaaggcaggatcgaacccgtgtcctcatggatcctaatcggattcgtttttgctgtgccatgaagggaactcccccttgtcttctttctccttgtctccactccagtattctctgaagccttgcccttcaagccacacctcctccacaaagtcttaccaagccgaccagattcttaagcatcactcctt

SEQ ID NO: 599323 - DNA, 104 bp, Homo sapiens
aaaaaaccggggggggccccccccaaaaaaccccccgggcccccctttggggggggtttttttcgggggccccatttttttggcggctttttttttgggcccca

SEQ ID NO: 599324 - DNA, 329 bp, Homo sapiens
  misc_feature (207)..(207): n is a, c, g, or t
atgagatgtgggaaggccaacatctcatggcgggaagaggaatgagatgttggatgtggaaggagacatgagatgttggaaggagcgatgagatgttggaaggaggcatgagatgttggaaggaggcatgagatgttggaaggaggcatgagatgttggaaggagcaatgagatgttggaaggagggatgagatgttggaaggagcnatgagatgttggaaggagcgatgagatgttggaaggagcgatgagatgttggaaggagccatgagatgttggaaggagtgatgagatgttggaggcgtcatgagactgctggaccgcgcgaa

SEQ ID NO: 599325 - DNA, 487 bp, Homo sapiens
ggtcccaactaactgagaagccgctgcagcattactaagacacaaccttagccaaaccatttacccaaataaagtataggcgatagaaattgaaacctggcgcaatagatatagtaccgcagagggaaagatgcaaaaattatataccaagcataatatagctagaggactaaaccccatataccttctgcttaagtgaattaactagaaataactttgcaaggagagccgagagcttaagatccccgaaaccgagtacgagctaccataagaacagctaaaagagcacacccgtctatgtagcaaaatagtgggaagatttataggtagagggcgcaaacctaccgagcctggtgatagctcggttgtccacgtagattcttaagttcaaccttaaaatttgcccaaagaccctctaaatccccttgtaaattaacctcttagtccaaagaggaccacctctttggacactggaaaaaaccttgtg

SEQ ID NO: 599326 - DNA, 768 bp, Homo sapiens
agccagattaggccgggtgcggtggctcacgcctgtagtcccatagtcccagcactttgggaggccgagggctggtggatcacaaggtcaggagatcgagaccatcctggctaacatggtgaaaccccatcgctactaaaaatacaaaaaattagctgggtatggtggcgggcgcctgtagtcccagtctacttgggaggctgaggcaggagaatggcgtgaacccgggaggcggagcttacagtgagccgagattgtgccactgcactccagcctgggggacagagcgtgagactccgtctccaaaaaataaagagagccagatggtatttgacacttttcagtccccgtggtcttgcctgcagatactcaagacgtgccccttgcagtgacgagtgaaagcggccgtggatgtgggtgagcagatgggagtggccatgtcttgagtcaaacttctgttgttgccacactgaaatctgaagttcagcacattttcacatggcatggaatcttatcttgcaagaattttacttaatagttagaaaggtgtaaaattaactcttagctcacaagcttgttgcgcaacagtaggtaatgggcagaagtagctccctgggctgtggttggcaaactgcggtggcaggttgtcaagcagtattgttctagagaggtggggcctctggggccccgtgggtggacgggtggcctgtccaaaaggttctgatcctcctgcaggtgttgcggccaggggcagggtgaaggaggccg

SEQ ID NO: 599327 - DNA, 157 bp, Homo sapiens
atcagctcgtacctttaaatctacaccaagtcaatgcctaatgctaacaccaatattagtatctttaaaaagattaggacaaagaaccaaactaagactcttaactgaaaaaccatgcatataacatgaaagatttgtatgttgcagtgtgcttccg

SEQ ID NO: 599328 - DNA, 105 bp, Homo sapiens
caattcgatccggtaccctcggataaggggcaagccaaggacaggagcaagtgtgccctcatttcgtttctacttttaatttctgtgtgttggcccttatgagga

SEQ ID NO: 599329 - DNA, 290 bp, Homo sapiens
  misc_feature (268)..(268): n is a, c, g, or t
tagaatttcaactcactgcaacctccgcctccttggttcaagcgattctcctgcctcagcctcctgagtagctgggattacaggtgcccaccaccacgcccggcttatttttgtatttttagtagagatggggtttcactatgttggccaggctggtcttgaactcctgacctcaggtgattgcctgcctcggcctcccaaagtgctgggattacaggcgtgagccatcacgcccagccagtacttgtggaaggactagctggaacanacaggtgcttgcagacctgaca

SEQ ID NO: 599330 - DNA, 296 bp, Homo sapiens
gggggggggggcccccccccaaattggggggccccccgccccccctcgcccaaggggggggcgcccattttgggggggggggttttttttttttccccccccccccggggggcggggtttaaaaaaaaaacccccggggggtttttccccccccccgggggggggtttccctggtccccccgggggggggggggggggggggggtccctcccctttttttttgggggggccccccccccccctttttttttttttttgggcccccccccttcttaaaaaattttgggggcccccca

SEQ ID NO: 599331 - DNA, 131 bp, Homo sapiens
taataccatatctcatgcgtataggaacctggatgctggagagcactttagtggagcactaaaacctcatctccactatctatataacgatgctacctaaatatccatggacgcgatgttcattcacctct

SEQ ID NO: 599332 - DNA, 792 bp, Homo sapiens
gaaaccttttaacatgagtaaggtcagtgtggtggctcacgcctgtaatcctagcactttgggaggccaaggtgggtggatcatgaggtcaggaatttgagaagagcctgggcaatatggtgaaaccccgtctctactaaaaatataaaaattagctgggcatggtggcagacgcctacaatcccagctcctcgggaggcttaggcagaagaatcgcttgaacctaggaagcagaggttgcagtgagctgagatcacgccactgcactccagcctgggtgacagagcgagactccgcctcaaaataaaggtttccctggctgggcgcggtggctcacgcttgtgatcccagcactttgggaggcctaggcaggtggatcacctgaggtcaggagttcaagaccagcctgaccaacgtggagaaacccagtctctactaaaaatacaaagttagccgggcatggtggcacatgcctgtaatcccagctactcgggaggctgagataggagaatcgcttgaacccagaaggcggaggttgcagtgagcgaagattgcaccattgcactccagcctgggcgacaagagcaaaactccgtcccaaggaaaacaaacaaagaacgcaacaggtttccccaagaaaataaaggcaaagattaagaacacaacaccgaacacctctgcgaacacccgtacacagccgtgactctcactaccgccacgagacattcaccttcattcctacactccaaccatcgaaagacacaaagagcggcaacacaccctcaaaaacag

SEQ ID NO: 599333 - DNA, 189 bp, Homo sapiens
ggatcccccgaacggtgcctggggaagtaccgactgacgatggggtaagagagatggtgggtccaggatgccactttgcctgggagcaccgcggtccttataactaccagctgtctctggtgaggtgcaagacctctctggttctctatatttcatgtgcattcctataaccacacccttttctgtgcc

SEQ ID NO: 599334 - DNA, 997 bp, Homo sapiens
  misc_feature (299)..(299): n is a, c, g, or t
gcgctcgccatggcggtttgggcggctgagcgtgagcggctccgcggacaccgagcagtggtccccggcgcgcgacctgagccgacagccgaagcagcccgggggctctatgcgacctgactgctgctgtggtcagcatgcttgctgcctgctcgcgagctcttctgccgtccgtcgccgcggaccctgccagaccctctttcccaggtgcccgcgtccttcagccacgccgcacagattcgcctgtcactaacgcagatccaggtctctcgtagttgggagcgcgagtgggcgccatnggagcaatagcgacagaggccatgttgtcgtaccgtgaggtgcagtttgaaagtacacctgacagttaaatgtgttcacgggccgagcagtcatgtccagtagggagtgaagttgtacacacgatcacaggcagacagaggtgtgacgttcactgaccgacgagtgccctcaggcaggcttcccaaatggatttcaaatgtcagctctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgataactccacgtgctttttttgttattatgtccattactggcaaaccacgaggaatccaacaggtcaaagggcctttcagaagcgactccattcatgggtaattaaaacctccgaatgtctgttccagtccaggcaattgtttggcacagtgcctttaagcggcgttatgcaacatttttgtcaaacaaagcgggatgcccccggagtcatcaggatcgaatcggggaggacactatggatccgagggagaccgtttccggcgacaataggggcaacatggtaccccgcgtcccactaaagtttaacacacccataagttgaggacacc

SEQ ID NO: 599335 - DNA, 1272 bp, Homo sapiens
cggaaggagcccggacgccgaaccgccggcatgagctacgaccgcgccatcaccgatcttctcgacccgacggacacctcttccaacgtggacgtacgcgcacggacggccgtcaacgaacgggctcgaccgcggattggatgttcgacggaacgacgaccacttgattgtatctatggatgtggacgaacgacagtcacgtgtgccaacacctggccagagcatgcaacagcacaccagtagcggtgcaagcactcactgtgcatatatgcgcatgcacccacacagatcttgccaatggcacatatatgcgcagagcacatcaaccagcaccgcaatgccacacggcatcagatccatcaaaactacgggacacccggagaatgagcacgctgcacaagaacgacacaaacaccaggacctagcacatgatagcgcagagaacgcacagaggatacaccctgagtgagacagctcaccaattcaaacacccgagcattaaccaatacagggcaacgcaaggagaccactgggacaaaaagagcacaaccaaccggctcacaccataaccacacaaccacccacaccaaacacacgccaacaacataggcggaggaccagcacccaaacaagggagcaaccagccacacatcaatgggaggagcgaccactcaatcacaccaacacggtcagctacacccaaatcacaacaagacaactgcacacagtagacaggagaagatcaacaaagcaaacaaagcagataaaagacacgaaacgtaaggaagacaaaaccacacaacccaaacaagaacagaggaccactcacaatacaaatccacaacaaacaacgagtaggcaacacacacccacacagatccacgagaagagagacaccacacgaaacataacaacaaccaagaaaagggacacacaggatgcggaacaacagagaggcgccccccaacaccaacaacacacactcgccacaaacgaatcacacaggaccagccatcacccaagcagggactggcgcggcatactgagcacccacacagaagacagcacataccgccaaatggcactagagaacacccaccacgaaaagcgaactcaacatcccacccactgtgcggcacacaaacccaaaccacagcaacacacaacaatacaaaaaatcacacccgaaggcgcaacccgcgcgacacaccaaggacgacaccaacacaagcaagtgaacacacgaaaccaacacacgcacacagtctcgac

SEQ ID NO: 599336 - DNA, 749 bp, Homo sapiens
tatggaaaagttcttaacaggattattgtaaatgacctccagggtcgcaatgatgatgacgccagtggcacttgggacttctatggcagctctgttggtgaaccagatgatgaaaagtggcttcattgcattgctctatatagccaaccccccaggaccagaagaccaggcatgatgatgacgatgcctatagcgcaatgtgttcgaatttgaattttcagagacccccctcgttaccgtgttataacatccaagtatcctgtggctcaggggccacctgaaaacctgggtctaccctgcgtttttcgggatgatccctttacagaacagtgtgagcaaactggttcctccccggacagttaatctgccgccgtggccaaaatatgtttccccaaaaaatcgctgggccaacaccgttcgggtccagccccacgtttggcaaggaacgggcccaacggcaacgttttctaattcggtggcacagtggcttctatccgtcgcgccacacgggttccattacctatatggagttaacaccttcccttgtgtggcacaattcccgcaaagaataggctaagcccccatggggcaaaaggacacattagtccaaaacgagccccatggaaacccaccagcgttcacacggggcgaagggcccatggcgtacaggaaattccttggggtggcggaccaacgtttccacacctgtaaattacccggtacactcacgtgagtttttcccaagccac

SEQ ID NO: 599337 - DNA, 465 bp, Homo sapiens
  misc_feature (33)..(33): n is a, c, g, or t
tctcgattcttgcctgtgtaaattgttatcgcnaaacactatcggaatgtgactgtcgggcctccagaaaacattgaggtgaccccaggagaaggctccctcatcatcaggttctcctctccctttgacatcgctgataactccacgtgctttttttgttattatgtccattactggcaaaccacgaggaatccaacaggtcaaagggcctttcagaagcgactccattcatgggtaattaaaacctccgaatgtctgttccagtccaggcaattgtttggcacagtgcctttaagcggcgttatgcaacatttttgtcaaacaaagcgggatgcccccggagtcatcaggatcgaatcggggaggacactatggatccgagggagaccgtttccggcgacaataggggcaacatggtaccccgcgtcccactaaagtttaacacacccataagttgaggacacc

SEQ ID NO: 599338 - DNA, 150 bp, Homo sapiens
cccaagctcacgtatcatgttttgataagaaaaatccctttctccacaagttggaaggtccaactcaattggccccgtgcccctaattcctggaacccatatgtataggagagtatatgtgcgcacagtctctgtggagatatgttcaca

SEQ ID NO: 599339 - DNA, 200 bp, Homo sapiens
  misc_feature (44)..(44): n is a, c, g, or t
  misc_feature (49)..(49): n is a, c, g, or t
  misc_feature (194)..(194): n is a, c, g, or t
cacgagggctgtacgccttcgacgccgattgtcgcgccgccgangtggngtggacgctgggcgccagctcggcggtcaccgcggtgctcgacgacaccggtcacgacgccagcttcccgatcatgcgctcggtgcacgaggtgctgcgggatcgggccgacgccatcgcggtccgccgccggatggcgttgccnctggtc

SEQ ID NO: 599340 - DNA, 350 bp, Homo sapiens
  misc_feature (108)..(108): n is a, c, g, or t
actggggctcccttaggtttttaaccatgggggtggccttttcgggggtccaaaggggggcccccttaagcttttccaggccggggataagggtgtgttttccctccnccaaaaaagggcttaaactgctggggccctgttttttaaggcccaaccccatttttttcccccccggggggagggtccacaaaccctttgttttttttatggtttgaccaaaaacccagtttcccccctttttggggaaagggggggattcccccccaaaataactgccttttggtcccccaccccccccccccctccctgggcccccccctgggtggcctttaaaaaggggttgggtggga

SEQ ID NO: 599341 - DNA, 818 bp, Homo sapiens
  misc_feature (59)..(59): n is a, c, g, or t
cacacaaaggtgaactaagaatgcacctaggttaattatcgcacgtatatatcgatggntactcataatagtgggtgatgccttctggtgcttgttaggcccagcaccagtatattatgccttgcctaaagttctgaactggggcagtcatttcagtcgtggtagaataatggagtattgagtcctgatcgctcctgtgcacctcgtgtggatctgcacagttgggctttccggcacaaaagtcatttaaaaacaatctgagtaaatgttcacatattacaagaacgatattcttcctgtaaggcatacaagtatcccaacgtcaaagtggccatttacgatcctctttgtgaatattagcataatacagatacttgagaaagtcgtgggtgtgtattgccgagaaaatgctttttatgggtgcctatatgtaacaattatttttaatgcatggtatgtgaagtaagggtcagttacattgtgcaccatgtgtgtaatgaaagaaaattacagtttataagtcatctgtagaagtctgagatggattgtgcaactcatgtcatggggttaaatgaattattttttggtaaagttaaacgggagaaattgttacatgtgttatttgaaagttacaaggagaatggggtccaagagtacaactggatgggtatcaagtataggattcgtcctggagacgtgctagggaagcaagtcaaggaaggggtcggaaaacaattaatttagggcaagtgagagaaaaaaaaaaattggtggcgtcgtgaataaaactttgggcggcacggttcaatgagcgtaaa

SEQ ID NO: 599342 - DNA, 321 bp, Homo sapiens
  misc_feature (18)..(18): n is a, c, g, or t
  misc_feature (64)..(64): n is a, c, g, or t
  misc_feature (92)..(92): n is a, c, g, or t
  misc_feature (147)..(147): n is a, c, g, or t
  misc_feature (237)..(237): n is a, c, g, or t
  misc_feature (274)..(274): n is a, c, g, or t
acctcatgtacattgccnaccttggaccccgacattgccccctctgccccggcaccattccagnaactgcccaccttccacactgaggtagnccgagcctcttcaaggcagacctacaagatggggtactaacaccacccccaccgnccccaccaccacccccagctcctgatgtgctggccagtgcacccccactcccaccctcaaccgcggcccctgtaggccaaggcgccaggnaggacgacagcagcagcagcaagtcttcttcagttcngggagcttccaagggaagttggtgaaccctccgttggttgggcaatc

SEQ ID NO: 599343 - DNA, 158 bp, Homo sapiens
tgagctagtgaaggatagggtagcacacacattaggctaggagcgctaggccgggtagccggatctcaccgatccgttggtagaggctaggtggctctggtaacttacatgcagcaagaatgaatagctcaacgctgctagctacttagtcactagga

SEQ ID NO: 599344 - DNA, 836 bp, Homo sapiens
  misc_feature (43)..(43): n is a, c, g, or t
  misc_feature (429)..(429): n is a, c, g, or t
ctctcggcctttactccatggtcagggggtcctctacactatnacacccaaatcacagagtaaacaaatgcacaccctcctgcccaaaataagaaaaccgaggctccactccaaataaaccactagcttgttcctccgggggcgcccctggagcccaaacatctaatgcacgactctgcggggggctggctcaagcctgggaactgcatgctactgtctacaccttatctcactgtatctataacttcatgggcgtctgatcgacactctcctttgagacccaccttgctcataaacaaaatgcccatgttggtcctctgccctggacctatgacattctagactattgctgggtttatctggcggccggtgtaacaaccatctaatacattacctcttctggtgattagctgacgatttactggccgncatttaacaacctgggagactgggaaaaacccttggcgttccccccctttaatccgctttgcaggaacatcccccttttctcacagttggggttatagccaaaaaaggcccctccccattcggcttttccaaacattttggcaaccccttattgggggtttgggaacttgtacccccttaattttttttttaaatatccccggttaattttttggcaaaaaaacttcattttttatccacaaaggccgaattgggaaaatcctttaatatcaaaagaatcccccgaataagggtgggtgtggtggccactcttggaaaagattacccttttaaagaggggggctcccacttaaggggggagctgctatgggggggcgcccttccttatccatacctttttttggggg

SEQ ID NO: 599345 - DNA, 1080 bp, Homo sapiens
gagaatgtgagagtacaaatgtgcagtagacttcaacaatcttgagtgccaatgaataatacagaaaaagaagacatgttgatgaatgagtttatagggttctaatcttaagatggtcacaactgtcgaaagacctctgcttggtttatccggcgggtatacggtttcgttaaacaaagtccagaatctaagcttattatagacccgttacagcgtcaccagcacctttactccttcattgaattaagctcacagacttgcctcttggcaaagcgacaggagctgcttgacgttacagacaggcatacaggtagctcctgaagacatgcagcagaccgttatttggtaaagcttcccagtactatcaaaactagactctgatactatacactggatgtctctgcagatgaccactggcgcttcgtagtttgctactaagcccatttttcaaccttgggcactaagtctaagtcacggtccctcagtgaacttgtaattcccctacaagtggtggcttactttgacaacagccgtaagtaggccatagcccttcagttgaaagcaaaagtaacaattggcttgaggtaattcacccggggcacggacacaacacaccactactttcaccccctctccatggacaactctcggacgttgctcggctacggccgtacccccttacatcgactgccactagtagtcacacacggtacacccctctgcagacaccacaccgacggacgaccagcacccacggagcatgagcaaccgcatgacacacccccctgcaacgaacgtcccggacacacaacaccttgggccgaaaaggataaaccacagggggccgcctacccgacaccaccggcgatcccccagcaacacagcttcccacaaacagcccaccaccgcatgcaccacagcccacgacgcccccaactccacacaacattaagtgggggaccgggcacgggccggcggaacacaccacaggcaagaccaacacagacagcggaacaacgcagaacgccgaaggagagcgcaccacgcgcagtgacccataacaagcgcccagtacctaaa

SEQ ID NO: 599346 - DNA, 705 bp, Homo sapiens
atggccgaatccgcactaccgtaaggacggcacgcctttctggaacgagctatcgctttcgaccgtgtacaacgaggtcgacaagcaaacctatttcgtcggtgtgcagaaagacgtcaccactcaagtcaaggcacaacagcgtgtcgcccaactggaagctcagttggccgagctcaagagcgagctcgccgcactcaaggcgacgagtggatttaacaaactgtaaaaaatgcggtctttagagcgacaatggctttttaatgcctcagccttgagccagatcaatgcaacgcgacacgctattgacgcaggacgagctggattttatccaggacatgacacacaacccgcagctcaacctgcgggatgcatggtcgagcctgacggttaatggcggcgcacagattcgcgatctgctcacgcggctagcggctcacgaccaggtcaccatccaggcgcagttcgacaaccagcaactcaccttcccgttgcacttggtggaagatgagtttcatgctgtgcatttacgcttgggcgtaccgagcatttttgaagatgggccgatgatccgcccgtggcgcctggcgcttgaaacgccggtggcgctggaaaacatcaagggctactccagcgcgctgtgggtgcacgaagtgtcattcaaaggggtgctggtagaggtgcgtggccgggtcaaacggcaaa

SEQ ID NO: 599347 - DNA, 649 bp, Homo sapiens
acaagaaggggtgagagtgcgtctcctagccttaatgtgggagggtagtttcagtcactcatcggctttcattattgtgcggaaatattagaaaacctcattgatcaatttgctgatattcaaatacataaaatgatcaatgaggttttctaatatcagcaaattgaaattttccataattatcattaatttgtaaccacatccagtgtcatgcttactccttagagttcagatgaattcttaaaattaaaaaaaaactccatagtactaattttgtttctttatatagtttgcgtttgatattagtgcttgcaattgtattaaagtcaaaagctgatttttatggcatacacaagaatgccactttttcttttatttcataccaataatttaaagattgatatgctaaaaacaatttgcacagcactaaagcatgagctactttcatctaaacctgtaaaaatatgaaagatttttatattttttcactgggaagaaattcttcctggatgaaattacaaatatgtgtagaatatatttaataaaagacttataaaatacctaactacaggacttaaaatatagattggcgcgtagtatatagaacaattatccatatcaataagtttagccttccatacacactgac

SEQ ID NO: 599348 - DNA, 239 bp, Homo sapiens
  misc_feature (35)..(36): n is a, c, g, or t
ggggaacagttgtttttaaaggttttggggtctcnntccccagtcgggaggcccagtggtgagagaaggtatgggggctcgtcccaggtcaggtttcagtggtgagaaaaggtatgggggcccgtcccaggttgggaaggaacagtggtgagaaaaggtatgggggctcgtaacaggtaaagaagaaacagtggtaaaaaaaagtaaaaaggatagaaacaggaaaaaaaacaaaagta

SEQ ID NO: 599349 - DNA, 139 bp, Homo sapiens
  misc_feature (93)..(93): n is a, c, g, or t
cacgaggggggtgggggcgggtggtttcctgcgggaggccgccgcgggtcatgtgaccggaagggctcctcacggacgccgtccctcctcggngcggcctgagcgcccggcccgaccccggtcatggggtgctgctaca

SEQ ID NO: 599350 - DNA, 150 bp, Homo sapiens
actggctggtcatgtcatcaactctgcgctctctccggcttagtgtctccggcagtggtcaagcctacacacagtgctatttttagagagggttcacatgtgccaactgtgtaactctggctaagcatctcctgctagctccaagtctgg

SEQ ID NO: 599351 - DNA, 958 bp, Homo sapiens
tgcttcgcctcccaaaaagggggtatgcctcctcccctcgaccgaaccactttagtaactttctcgtctgttccaaaaagggccacccctctgtagccccggcgttgaccatttctctccgcgacctacctcttccttctaatcccttaattaacctcccccacttggttcgcctcactttggttaagaccccccgaggtttctccggagcattgtgaagaaaaggaaaagtaaatgaaggagagagattgaggggaaagggacactggaaaaacgctgcccacactttgtgatgggcttgtgaaaacgtacgaaggagccttacaacaccccaccaattcaacaagtgggccccggttattctcgcacccaagaagattgtgtgagaatgggtctctcggccttgcttctctgatgagttccgttggaagccgtgagccctttgacacaaaccccgggaggcgcacaacagagttcccggggctccgggagacacccccctttctaatatttggcacgttgggatggcctctctaggctaagccacgaatgtgtctgtgagcttcttcacttgagggcaaggctgctgagaccctgcctgcgccagcaatgtatcaggtggccagcaccaccaaatctggcaagtgccaatgctttctggcctccacacccattccttctgccctgccttctctcttcgtgcacacaggaggcacccctgagcccgagggcggaggacgagaaattctccggcccctgcagcacgccgtagcgacagcgacagcggagaacgagggcgatgaatacgacgaccttgtggttcacaacaaccgcagccacaaaccggctgccttcacaacccaacctccaaacctttttctgacgaccccccccccctgtgaattggttcattggtaaaataatttcccaggttaatgaacccaaaccctaggtggac

SEQ ID NO: 599352 - DNA, 480 bp, Homo sapiens
agttcgacggagactctcctagatcgtgttttgtgacaaacactgaggcagtgcttctctgcttttggctactgcgtccctaggtgatagctagtgaaaggattgctagtaggataaattatatatacctgagtatcagatatggtattgaaactgaataggaaatcgtatttgcgaactttgacttagacatacagatctattttgaggtatggtgactttctaagcagtttcctctttaggggtctttttaaaaaacttagagaaattcttttcagtgggactgctgaatcaagtgtttatatgtattttgaatttggataggctattagctatacattttaatgcgtaggaaagtagtcaataagaaaagtaattggttataaaaaaatttgtttcattagtactcttctgttctctatatggagacatgtaacatgaaagttgttactaatcaaatgaaagtaaagtcatggttaa

SEQ ID NO: 599353 - DNA, 738 bp, Homo sapiens
  misc_feature (12)..(12): n is a, c, g, or t
  misc_feature (88)..(88): n is a, c, g, or t
  misc_feature (122)..(122): n is a, c, g, or t
  misc_feature (130)..(130): n is a, c, g, or t
  misc_feature (167)..(167): n is a, c, g, or t
  misc_feature (188)..(189): n is a, c, g, or t
  misc_feature (196)..(196): n is a, c, g, or t
  misc_feature (202)..(202): n is a, c, g, or t
  misc_feature (205)..(205): n is a, c, g, or t
  misc_feature (207)..(207): n is a, c, g, or t
  misc_feature (218)..(218): n is a, c, g, or t
  misc_feature (223)..(223): n is a, c, g, or t
  misc_feature (225)..(225): n is a, c, g, or t
  misc_feature (258)..(258): n is a, c, g, or t
  misc_feature (260)..(260): n is a, c, g, or t
  misc_feature (270)..(270): n is a, c, g, or t
  misc_feature (273)..(273): n is a, c, g, or t
  misc_feature (276)..(277): n is a, c, g, or t
  misc_feature (284)..(284): n is a, c, g, or t
  misc_feature (288)..(288): n is a, c, g, or t
  misc_feature (323)..(323): n is a, c, g, or t
  misc_feature (327)..(327): n is a, c, g, or t
  misc_feature (425)..(425): n is a, c, g, or t
  misc_feature (438)..(438): n is a, c, g, or t
  misc_feature (466)..(466): n is a, c, g, or t
  misc_feature (565)..(565): n is a, c, g, or t
  misc_feature (595)..(595): n is a, c, g, or t
  misc_feature (606)..(606): n is a, c, g, or t
  misc_feature (735)..(735): n is a, c, g, or t
aaaacaaatgangtacaaaatatttcagatttacatagtgataaacaagaaagcacttatcaggaggacttacaaatggaagtacacnctagaaccatcatctatcatggctaaatgtgagnttagcacngctgtattatttgtacattgcaaacacctagaaaganatgggaaacaaaatcccaggnntcttgtntgtggngtncngggttttccancacgncntcattccagcattctgagattagggtgattggngntcattctggngtnggnntgttcancaanagtgatgttgttaggtaaaatgtacaacttctggntctntgcagacattgatggtgctttgagtctggcttttactctgctgtttctttcacactttagattttaaaagtacgtctgcaaggaatctttctttccantttgagagctcanctgctctttaaaatggaaacacgcaacnaaaaacagatgctgctttctagaactccattgtcatgaaatataatatttgctaaaataagagatttactttaaaaattagagtgcttatttcttgcanagtacaccatgggaaaccctcgggggaaanttgttgccaantgtatccattaactgtatttaaaatttctgattgcctttttgaccatgttattgctaaatagcaaaacaaccaaaaacaaatacaacaaaaatcctatatcccagctagatttcttcctttaagcatanggg

SEQ ID NO: 599354 - DNA, 128 bp, Homo sapiens
ttctatggtgtggggctttgtatgattatgggcgtgattagtagtaattactggttgaacattgtttgtgggctgtatatacttgtaacttgagactggctcgaggcgggggatccctctagcagtcg

SEQ ID NO: 599355 - DNA, 220 bp, Homo sapiens
tcctgtgggagacaggaaatctatttttgcagattgctcaataagcctcctgagccccctaaataaccgctgttaacccctttattccccggggtccactgcccccgaacagattcttttagggggtccccccgccccctgggctttcaaatatttgtttcaatggccttttggggcctttgttttttccgagggcccataaattttttttgggccccca

SEQ ID NO: 599356 - DNA, 301 bp, Homo sapiens
ccccccccaaaaaaaaaaagggggggggcccccggggaggactttttttttgggggggtttttttccccccccaaagggggggggttttttttgggaaggggctattttttttgggaaaagaaaatttttccccccaagggttttctttaaaactttttggaaagggccccttttcattgggggttgaaaaaatttttggaatattttttttggaacaaccccttcattccgaaagaattgaggtttttggtccctccttaaaagccctggggggtcaagtccccataaatgggccgccca

SEQ ID NO: 599357 - DNA, 135 bp, Homo sapiens
aggtcctttgcaatctaaaaggccaccccatttctctctagggagatgttggccagttcttctccacagttccacaggggggaacataatagcatggctacggggtactttttttagtgcaaaatttttataatt

SEQ ID NO: 599358 - DNA, 218 bp, Homo sapiens
tcggtgactctacaggatcttcacggctgtgcctttataagttataacatggataggtgctggaatggtgattcacaattaaaaaacactggtaatccaaacttttttttaaactggtagatcaggcatgtgatggtaaatgtaaataggtacaatggtggtaatgggaagagaaacacacatgccttaaaatttaaaaaggcagggcccaaatgctt

SEQ ID NO: 599359 - DNA, 406 bp, Homo sapiens
  misc_feature (215)..(215): n is a, c, g, or t
gactcagctatcgtcacttgtacaactgaattggtattagatctagactggcggggtgtggtcacactgtaatctcagcacttgagagctgaggccggtgatacctgaggtcaggagttcagaccatgttgatggttaatcagcagtagttgggctatagcaagcagtcattgataatattgagccattttatgtaatgtgagccttctaataantaggtgtagttacaaacataatgggagccatgctcaaactgtgcaatattgagaaaaactgaattcctggtatttgaaagtgtctaattatctgcgttaataggtaagcccctcctgattttctacttaaacatgacacttcttccgtggcgcccatcttcattctcttgaacattgaaccggatagcttg

SEQ ID NO: 599360 - DNA, 228 bp, Homo sapiens
aaggcctttttgggtgatccatctgcctttgggggtgctgcccctgtgggtgttgcccccccaactgctcctgttgttgctgcagccccagctaaggttgaacccaaggaaaagtcggaggagtcggccgaggatatgggatttggtctctttgactaatccccaaaaagcaacccacttagcccgttttttttgccaaccaaggaaataaaggcttccttcttttta

SEQ ID NO: 599361 - DNA, 820 bp, Homo sapiens
caggcccgggggctggcctgagcccccctcccctcctggtgctgaccctcccggggggctctataggggggagatttgacccggaggttctgggagggtgcttctacaacgctgactacctggtggccgagcccggtggcaggtgaactgcaggcaggaagaggaggaagccctggaggggtgcaggtgattggatgtattacctccggtactcagggctccacctcttcaccgggcccgtagagccagggctggtgcagaagttctccctgcgagactgcagcccactggtcagtgaagaatctacaccgctgccgcatcacgcaacctggatggggctagtgggtggccgtgcccatgctggatatggctctctttgagcacggagcaggccaaatagcactatagccccgctggttggcccctaacctacattaccttaccttagtctgactaagacacaggaagggcaatgaagatggtggacagatagagaatgtatgcctgtataataaatatgacaatgtataaaatgtttctgcaaaaaaacaaaggggtggcgaaaaataatctgagggacaaagataaagagaacagatatttgtaaaaagtgtccaaaagagagaggaaaaagagaagaacggcacatagataaacaaatgatgatcactggacacactgaaagagcagatctttgacggggaccaagtttgggagaggatcattaacattagttaaaaataaggataaggaaaaaagttaaagtgtaatgttaaacaatgattgtgtgtagagtgactggatgttagagtaacaggat

SEQ ID NO: 599362 - DNA, 519 bp, Homo sapiens
atcgccacgtgcttctttcaagacttgcccattttcacggaccatggtctgagcaagttcttctttgcgagcttcgagcagatgagcagccttgaggatgatctctgcgcgatggggagcaggagttgctttccatgcaggaaaagccttgtgggcagcatctactgctgctttgacatcgttggcagtggatagcgggaaaaagcctatcacttcatcgttcttggccggattgtatgacgcaaaagtctcgcctgattcagatttgacttgacggccgttgatatagtttccgtaggtttgcggcttgccggcctatagtgtcgcttgttccggtttgcttggagtgcttgtactcattgcattttcctctaaggatttgtttgagaaataattggagatctaggcgatctaagcggtcatggccttttcaagaatgtcgagggccttgttcatttcttcttcactcattgtgagaggcggaatcagacgaatcacctgaccaccagtaccgcaggt

SEQ ID NO: 599363 - DNA, 574 bp, Homo sapiens
agaggacccgtatgcaggttcacaacgcgcttcctgttgcgcaccaccttcgcaagcacagtgaggcacaacctatgtgtgcaatgtgtgccaccgtgctttccgcgtgggctgctggcctgagccatcagtgcactcacgccgaaccgaccgccaacccttcttttgccgcctctggaactacaaggccaagcaaaagttccaggtggtcaagcacgtacgcaggcaccagcctgatcaagccgacccaaaccagggtgtgggcaaagatcccatcgcccccacggtgcacctgcatgatgtgcagctggaggatcccagccctcctgctcctgccgctcgtcacactggacctgagtggctgatagcgtgcctagctcctgtatgggaagagggtatggtctgagatgtgcagactgggaccagcgctagcctgaggagctcagagcctacggaaagactggcttgtggggtacaagggtgactagaaccttcctgggtctctggctatagtactttgaaattatcacccatataacagagggacatggactatcacgttgattacttattg

SEQ ID NO: 599364 - DNA, 396 bp, Homo sapiens
cagtcagtagtggggggctctccaggagtgcaaagctactccacgaacatctttgagtgctttccctcaagacattggagttacactgcagctaatttttgtatttttattagagatggagtttcactctgttggcccggcttatcccgaactcctgaccccgaggtgggcggatcatgaggtcaggagatcaagaccatcctggctaacatggtgaaaccctgtctctactaaaaatacaaaaaattagccgggcttggtggcgggcacctgtagtcccagctacttgggaggctgaggcaggagaatggtgtgaacccgggaggcggagcttgcagtgagaagagatcacgccactgcactccagcctgggggacagagcgagactccgtctca

SEQ ID NO: 599365 - DNA, 430 bp, Homo sapiens
ctactactaaattagcggccggtgcgacgtgagccatgatcttgccactgcactgtagcctgggtgacaaagtgagatgctgtctcaaaaaacaaaacaaaaaacccaaaaaacttcttttccacaggaactgaggttcgagattattttaagaatagaataggtgtttttggccaggcatggtggctcgtgcctataatcccagcactttgggtggccgaggtgggcggatcacctgaggtcaggagtttaagaccagcctggccaacatggtgaagccccatctctactaaaaatacaaaaattagccgggcatggtggagggtgcctgtaatcccagctactcaggaggctgaggcaggagaattgcttgaacccgggaagcggaggttgcagtgagccagattgtgacactgcactccagcctggg

SEQ ID NO: 599366 - DNA, 682 bp, Homo sapiens
taccgggctggcggcctggccgttgccccgggctgctagcgggtccaccgggttgctagccgacagccggccttcttcctcgcagcgcgccgcgattcagcagcctggtcccttctgcggagagcgatgccgcttcccgaccccatgttctgcgctcggctgatccacattcccccgtgagctggccggacatcctgaaagtcaattcaccaacgtgctgcgcatcctgctaccctagtctcggcacgactggtgcttgctggctggatcctgcgtggctgatttcttcatgcgtctagtcagatgcaggagatccacctttcgctgtaaaggtagcagaatgtgaatagtgctccacgtgcaatcccgagatagatagcagacacaggcctgagtcaaggactcctgaaagttattgcagcaagcagtgtcaccacaagcggtatgtggcattatcagatcttgcatgccagaagtggcaagaacttgtgcctgccgaagggaacaattcaaagcgctcttacaatatggattccttgtgacaaaaccacacatcaagtggataaacttttaagcgcttggagtgcagcatgcttggtgggtccttgaatcactgcggctgaaggcacctgtgcgagcatcctcacggactgatccggagggcgggcccgatctgcatccc

SEQ ID NO: 599367 - DNA, 396 bp, Homo sapiens
tcagggaccaggagagcggttacatgcagtcactgtgtaataaactctctgtaataataaaatgagtgaacagacacacaagctctgtggacactgttcttccacagcttatgaataaagccatcggagtagggcaatgaaacccagccagcaagtgggtagaccgggatttgaacctaggttgcttgactctggtcctgtggtgtgatctttccccctcccacctgactgcctaagagtccagactctggtgagaaacagtgtgccaaccacttgactttgggacaacttggaagcagatagctgacccaccatgtttctacacaagggatttccagtggtgtccgtggctttaagtgcagagattgagagaagtgggactaggtagaaaacgag

SEQ ID NO: 599368 - DNA, 367 bp, Homo sapiens
gaacagaaatgatgatgtacagctgaaattaccaacatcatcagatggaggagtccttgtgaggaaatctgacttcgcaagatgccaattatccttaggggatctatgtggtcgctttcggttccatctgccaatccccatgaaggctccgctgtagatctaaaagagctaacagatgacccttgaccatcctaaggttgctcattgtgtctgtccctcttgggggagcacagagaataattttttgtggctactgaaatcttaggactcttccagtttaagtaagtcttaaagaaatactggccttgactttaggatccaaaataaacctgaatccttgtgagtgtctagacaacaactatagaaa

SEQ ID NO: 599369 - DNA, 266 bp, Homo sapiens
gatgcaccactgtgtctattaaccactaattccaggacacttctatcagctaaaaaagcctttacctgtcagcagttactccatccctggctgctaatctatcttcccttgctctatggctttccctatcctggacatttcatatgaatggaattatataatatgtagccttggtgtctgaacaatttcacttagcatgttttcgaggttcatccatgttgtagcatataatagtactgtattccttttagtggcatcgataaaca

SEQ ID NO: 599370 - DNA, 338 bp, Homo sapiens
aacaatgatatgattttacttcatatttccgtaaatgactaataacgctgaacatacttgcgtgcgattattggccatccatgggctcattttgatgaactgcctattcacatctttggtccaattctagataccctggcaagcattggttattattctaaccttgggttgcctaacaataaaatttttgttctgtttttggttttggtttttgagagtctccctctgttgcccaggctggagtgcagtggcacgatctcgactcactgcaagctctgcctcctgggttcataccattcggctgcctcagcctcctgagtagctgggactacaggcac

SEQ ID NO: 599371 - DNA, 150 bp, Homo sapiens
aagcagtatgagcacaacatcatcaactataagacactgacaagctggagggagaccatcagctcatccaggaggcactgtcttggacacaagcacacgactacacgatggagcacattcgtgtgtgtggcgcctactgtcgacaccttc

SEQ ID NO: 599372 - DNA, 204 bp, Homo sapiens
tggagagaacgggggagcctggtcgcctggggaccctgcagtggtgggacctgctgttgctggacccaaaggagaaaagggagatgtggggccctgctgggcccagaggagctaccttgagtccaatgtggaactggggcccaccctggcttggttcttcctgggagaccctgtgccccaaggtgagaccctgtgagacctggg

SEQ ID NO: 599373 - DNA, 395 bp, Homo sapiens
tggtaatatattactacattacgaggggagtgggttgctttttaatgtcttatatttaaaccgttacagaggtaatgggtggcgactttgcggtttcggtgaagcttcatcacgactgggacgtgagttagttcttcaacgtaattttaatcttggtttaggtctcagtgaccttgaaagaaaatggtacggggtctaagtcctagtctgtggatcaggaaggctaccttcgtgatctgtttcaagtggactcggattatcagggtcacttataacaaaaatacacctatcactataccagttacttaagttcaaccttaaccatctttttgaaaaacgacttctgtgtcttcgtttcttgggtaaaagatgagtcctgtgtctaaatctgaacc

SEQ ID NO: 599374 - DNA, 348 bp, Homo sapiens
tgttctgaggatccccgtttgggatctaagctgtatgctctgtcttatggtagtcttaggctctaaacggaagtctgttgctctaaatgggtgtcttgtgctctaaaatggggtctgtgctacaaatggggtcgtgctcaaatgaggtctggtgctcaaatggggtctagtgctcgaagtaatctgttgggaacatatatgaccaaatacaacaccagtagtaagacctatacattttactcgagaggacacctggttctagctgcaggagcttatagtccacaatcaaccatcggtattaaagaccttttggaagctactgtttttaaaaagggagactaaaagtgt

SEQ ID NO: 599375 - DNA, 256 bp, Homo sapiens
tttttcactcagcttctttcatttgatcgcataagttcgcttccgaattcccgttcatactctttagtataatggggcaaattcttgttttccatgtttctcgttcctttttcgttaatttcgttaatgtgcattcgtttattttgtttcatttgcgcctattcttcctcgttttgcatgctttgactgttttaatgttacaaatcgtcgtttcctgtatcgcttccattattttttcttgaagtgtcttttggta

SEQ ID NO: 599376 - DNA, 270 bp, Homo sapiens
cctttttgggggggggcaaactggcggtaaatttgtgatgtcaaaatgcaaactacaatgactgtaaaatggcctggggtgtaaaaacgttttcagggaaagcaaaaggtattaaataaaaaacaaaacctttattccatggggtttgcttcattttggaaaaaaatttttggctcgtgaaccaaattgtaaactttcaggtatttttgtacaaaaaaaggactgatgttttgttttttgtaattaaaaaaaaacattaaaacagtgtta

SEQ ID NO: 599377 - DNA, 413 bp, Homo sapiens
  misc_feature (129)..(129): n is a, c, g, or t
  misc_feature (200)..(200): n is a, c, g, or t
gtctcacatgtgcatgtggtcattctgactcaggtgatcaccactcggctccaaagtgtggattaaggcgtgagcacatgccagaagaatttgttgaggtgcagcagctcaagagtctatgggcagtgnggctcctactttcctactttctggcacaccatcacattgatactgtgcactgtcttttctggtatcagcanaaccgagcaaactctcagtttttaaaaaccacctggaaacactcattgtctacaagagacacatatgtgatggccacgtaaggggagtgaataaatgtaacccagattaaccacagggtaaacacaaactctttctcaatctttcccccgagcctcacaggtgggctttctggtctttaagctttgattgtaacatttctgccttctgtcccc

SEQ ID NO: 599378 - DNA, 957 bp, Homo sapiens
ggtgtggtgagggttcgagtggaaggtgataatgacaagaatgaaccccagtgtatggagggaatgtgttcccttcatttttgtattggcaccctgagagaacatcagcaatgcccagtgctttgcttggatgtatcacctctcctacctgcaggagtgtagagcatgcttcgcttgtgagagtgctacaatatatgattgatgcatgcttctgttgcagatttggggctaggtgctttcatgcccacttccatgtatgacgctgtgggctgtgtggcaatgcatgtgtgtgaatgctgacaatggcttggatatagcacttgattgaagaggctcctcctcctccctccatgcgactcgaacctatgtgtggtgcatgctatgagtgggccgatggactgtgagaccggcaggacagagctggtccttgcctatggccaccagactcaagattgttgtcatcacatgctatcagagacttgagatcaggagaatgagagaggagcccaaatcgaggctggtgcactgtccgacatagtgatccccccaaacccgaggtggaatgaacgcgcccgagcaaggctgggcctgaatgggtgtggccagacgaatatggggtacacccaaacttgcccacacatgtgaaccagaccagatagaataacaaaaacttacaaacatactaagcctccagaggaatgcaagtaacccagaacagagaaatcacaaacaggaactataggaggagttcatgaaccagaagccccgtgaagagtcacagaacagggggaaaccacgccagaaagttccagagacggaaggacccagaagcgacgggaactggataagaaagaataggaatgaaaggagggcgaacacaagtgaccacatagaaaggacaagcacaaggaccttgacactcagaaaagtgacacacacatgaggtggaagaagaag

SEQ ID NO: 599379 - DNA, 518 bp, Homo sapiens
  misc_feature (167)..(167): n is a, c, g, or t
  misc_feature (253)..(253): n is a, c, g, or t
  misc_feature (279)..(279): n is a, c, g, or t
  misc_feature (382)..(382): n is a, c, g, or t
  misc_feature (390)..(390): n is a, c, g, or t
  misc_feature (425)..(425): n is a, c, g, or t
  misc_feature (436)..(436): n is a, c, g, or t
tcttgtagatgacttgcttttaatatcttggaagtttaaaggagtacactgaaaattagttactttcctgaacaattaacagtaatcaactggggaacaataaaagaagacccatttatttatttttcgagatggagtctcactctgttccccaggctggagtgcantggcacggtcttggctcactgcggcctctgcctcccagattcaagtaccacacctgtaatcccagctactcaggaggctgaagcangagaatcacttgaactcaggaggcanaggttgcagtgagccaaaattgcaccattgctatccaacctgggaggcatcaaaactccacctcaaaataaataagtaaacccaaagaactaaaggaagccanatgtgaanaattaaagaaagtattctaatgtctcaccaaatanagaacataganatataaatttgttttaaagaactaaattaaaattctggaattaaaaagtacaataactacaattgtaaaaattactataaag

SEQ ID NO: 599380 - DNA, 932 bp, Homo sapiens
ctgcgcgcgtatcagcagcggcgccgcgtgggcggggggcgcagatgaccctccccaatcccggcctgccaccacctgtgctcgcgcgcagccccggcccagaatgccttaacctgcgccgattgcatgcctgccgaggtgcccctccccgtgtagggacctccgacgccgtcagtccccgttcctcctttcgccgcaggtgcgcactgcatgtgcttgcgggcgggtgggcgcccgcacgtctgcggtcgcggtcgccgctggtcctcccgccgagccccggcgcgggggcatgaggagcccccgggtgccgacccaggagaccattcaggcctgcgcgcaacacactagccagcggacagacggggacatgagcagacgcagcacgggggtcccggagcccgggctggtcaagccctatcccggccggaggccaggcggggtcaacgcgttgcccgggagaaatgaggccaggaggcccgggacgtgaaagacactccagttgtaaacccacttactcccttcgacccatttccgttgcgagacatccagaggcggtcgttcagagggatcacgggagaccgaggacttgagtcgaatacttgatcgatgttgacccccggaggtcagccacacataaaaagcgaccactttccgggcatggccagacctctattcgcggaataaaagccctggctaaaggggccacgaattagaagtgcagcatttatggcacaaacaaccgggaatgggttaaggtcaacatagttggaaaaactggatttgaagaacaggaggggaggatcaaggagaagagaaagggttaaaggagggagagtggattaggcacaataggctgggggatataacatcgggaagcaatagttagacccgagactttgatgaatcattaatgaggtcatcgaaattaa

SEQ ID NO: 599381 - DNA, 167 bp, Homo sapiens
  misc_feature (24)..(24): n is a, c, g, or t
  misc_feature (77)..(77): n is a, c, g, or t
  misc_feature (87)..(87): n is a, c, g, or t
gagcacagggaggaacttgtccantagtttggaaatgtgttcctcgtaaagactgaggcaagcaagtgctgtgaaanaacatcatcntagtcccttggtgtgtggggtttgtttttttttttttatattttgagaataaaacttcatataaaattgaaaaaaaaaaa

SEQ ID NO: 599382 - DNA, 462 bp, Homo sapiens
gtatggttgatacatgaccgtaaaaagacttgagcgacccttgctgtttctggaggagaaccttcacagagaaattactgagcattaatggagggtcttccatggtcccagggattttacactcacagactcggtgtgtttggttacagcaaggatgaggtgcctgctcagaatgggatctgtgctcagaatgggttctgccaggttggaggcagccaccacaaatgtaaagtgggcatccaggcacgagtgggtttgcatagtaagaaaaggcttttctgggacttaaagctactgctcagcgccactgacatcccttctataactctgggttctcctgaaggggtgagtgtttaatcagggccttctggtctcatctctcttgtggtaaagaggagtgaggggcttttcgcccagggctgggggctggattgtaaccgtggacagggttattctcataat

SEQ ID NO: 599383 - DNA, 267 bp, Homo sapiens
agtgagcgaagaaccgctgaggaggatcggcggccggtgagggggagcaagtctggtctctgtgattgaggaggtcggctctgggctccagtgcgggaatcacacacatacctcagaatgccgggtctaagttgtggattttatcaacacaaatttcctaggtggaggatgtggttatggtgaatgtcagatacctttgctgaaatgggggcttatgtcaacttctggaatacaacaacattgagggcatgattctcttggtgaata

SEQ ID NO: 599384 - DNA, 1410 bp, Homo sapiens
gtctccaaggtgaacagcctctaggcatgtaggaacaatgtagggagccgcaccttgtccatgtaccatcaataaagtaccctgtgctcaatcaaaaaaacaaacaaacaaaacaacaaacacaaacaccacccatttttcggcgccgccctagagcccctcctcagataagcgtctttccttaggccacctcttgatgctaggggccggagtgcccccccctgttgtctagtgtagaccgatggccacaaaagccgccggcttacccacaagaggaagaaacccgcggggccaactgaacacaaaagcggcccgggacaacttctagccccgacaccaacaaacaaacccctcgcggcgacgacaacaccaccaggcccgcgcttcggaaccacgacaaaacccccaaaacgagaaggaccacttcctcttagcggcgcttccattaacacaggggggggaccctatactaccaaaagagagggagtgatccacactagaggcctgctctctctttcacattatcagcagagatatcaactggccacgactacgcgcggaagcgcgcactcccaatcacctgacctcgctcccttccacccgccacaccctcccactacactcacacatcaccacactataccaccatacatacacctacagaacaacacaagtacccacaatacaaccacactaccttaacacataccgtatcaaacactcacctcttcaccacacccacattcacaacatcaaccaccatactctactcaataaaccgcacttcccccaactaaactctaaacctcaattataaaccaccatagataaaaactacatcaccataaactaaacaacacacaaaatatctatcaatatccaactatccgacgacttcaccctaaatctgagcaacacaaatacgccgtaccaaccataaacacaaccaaacatcaacaatcataccaacccaaatgaacgcaacacatcaacgacataacaaaaaacaaaacacaaatacagacctaccaacacaaccaactcaaatccaatcacaaaaacattcatatcaacaaatccacacaacatactaacacaatcaaactactattagaacactcaattcaaccaatctataccattacctgactgaacaggccacgccccccgagccccctagtggacccacacctatacataacaacatccgctcatcgagacctcgcccccgctaccagcgcagaagtcgagtcaagcagcacacactacaagtcagagtcacgccgacacgcaccgcctaccaagtgactacgcaatacgccggtaccacgtcatccgtccatctctcagtacagcacactcaccactcgttctaccgctaggctgcaccgcaggcgccatcaagtcccg

SEQ ID NO: 599385 - DNA, 275 bp, Homo sapiens
cacttcaaaaggttctcttatcctcctttatagtcagttcattctcactccctgaaaattcttttcggttcaattattttaacctttttaatgaagtgctcatatatgtagtatcaaaacagtgtgtcaccttattcataaacacagtaaatattggttgatcgaacactctgaataaatcgcagagactagcagaatggatttttaaaataacatgatctaactatatgctgtctattagagatgcaatttatattcgaagccacaaataggtt

SEQ ID NO: 599386 - DNA, 403 bp, Homo sapiens
aagagatgggcaccaagggcactgctattaaacgctaagtaggcatagtctgggaagcagcaagccccttatgctcgcagaggtgaaggtggttatcgccatggctaatgaagagaggattcagatcatggctacctgcctgtggcatactgacaccactgttatcgatgctcaattggagagcctagctaacccagggatcgagggacatgatgctgcaagtcatgtggagaggatgagtccactagtgaccgacgccaaacacatgtgacacagtaatggcgatttatgcacctctatggagaatatgcaagaaacgtatgaggacactgacgaatgctggtcggaacatgagccttctagaggactgctagtggtcacccactgatggcagacccctgcg

SEQ ID NO: 599387 - DNA, 677 bp, Homo sapiens
cgttgtgcgactgttagcacggagcacttcctgcggcatatcgacactctcggccaggcctgtggctcacacctgtgatcccggccctttaggaggccgaggcagcgggttgcctgagctcaggaggtcaagattccgtctgggccacacgatgaactccgtctctacttaggatccgagattatcccggcatggtggcgtacgcctgtagtcccaagctactcaggaggctgaggcaggagagttgcttgaaccccggaggaagaggttgccagtgagcccagatcatgccacatcactcccacctgggccaccagaccagaacccctctccaaccaaccaaccacacctaccaaaaaaaactcttgtctccttaggatatgttacctgctcccctgcacgactagagacaataaatgtgtattgaaccttttactgccaacttgaaaatgctagaaaacccagcctgagagagataaatacctggcgggaaacacacccggcactgtgcatatgcatataccttgtaagttagtaagttagaaagctagctttgttgtatctgaacacatgaatcttttttggtccgtgtaggaagcacagccagatcctataggaatgaatacctcaaatctgttgtctgagattctagagattaaacccctgtgcccttttta

SEQ ID NO: 599388 - DNA, 1086 bp, Homo sapiens
aaatataggtcaggtacgaggcctggtttgaatcggcaccgagggcgtatctcccgcttccgcgtcactgcgcgcttcgctctccgcccgccgaggccctgtgcgctcgccatgtccggccaccgccaccgcggtcgcctcggtgctgtggcaccatggatgatgtgggcgccgcatggacgcgcccgcagcgccgcggccgtgcgcgcctttctggagcgcggcacaccgaactggaacggcttcatgtacagcgacggcagtccgataccatcctgggcggcctggggctcgcgtctgggcggtgtgcgatggtgcaggccatgtgaaaattgccaccaaggccaacccttgggatggaacacatcactaaagcctgacagtgtccggtcccagctcgagacgtcgttgaggaggctgcagtgtccccaagtggacctcgttctacctacacagcaagctgaccacggaccccggtggaaaagacgctgaatgcgtgccagcggtgaccacggatgggcacggttcgtgcgacgcttggcctcttccaactatgctaggctgcgaatttggccgagatcgtgtaccctcctgccaaagaaacaagtggctgatctttgccccactttgttgtaccaccgggtattgtacaacgccaccaaacccgggcatggttggacacaccgcacgctcttccccttggcctcaggcacttttgactgagggttcttttggcctacgaaccctctggcttgggggcctgttgactggaaagtacaaggtatgaggagcagggggggaaaagaggctgtgggcggtctttgggacttggtagtctgagaccaacaggaatcggtctagaacggagcagccttaggcatgagtggtgagaaggcctgagcgtattttggcaggcgccagtgtggatgaggctcgggagattacaaggtaggtggggtgaagggaaggttcaggataagttaactggaagtgaaaggagcctagggggggagaaaaacggatagtacagcaatgtaaaagagtggaatatggagaagacgaagaaggagaggaataggaaagggg

SEQ ID NO: 599389 - DNA, 266 bp, Homo sapiens
  misc_feature (3)..(3): n is a, c, g, or t
ccngagggtccccccccggggggggggttccccccccccaaaagttttcccccggggggggggtttggggggggggggccccccccccccccctgttttccgcggaccccccccccccctttggggctttgcccctttttccccggggggccccccccctttgggggcccccggggtttttttccccccccaccccttcccccccccggggttttttttgggggggggggggggggggggtttttttttggggtttttttccccca

SEQ ID NO: 599390 - DNA, 141 bp, Homo sapiens
  misc_feature (28)..(28): n is a, c, g, or t
agatgatgatgatcagttttctgagaanggtgatgaaaccaaaacacctaccctgcaaccaactccaaaagttcacaatggaaaacgagtgacttctgtcaaaaaaccagcagtcaataaaaaacaaggtgaatgtttgaa

SEQ ID NO: 599391 - DNA, 864 bp, Homo sapiens
ctcacctggctctgcctgaccagtctcctgtcctgccgcacccacttcgttcttcagggtcatggaaccgttcacacgatcactggggctcgggctgttccatctctgaacgttctagccttagtctcatctcaggtcaagaaggtgcaccgccctgaggtcggactcttctgctgcatgtgtgcagacctgcctagtgttttctaacgtcaggccccccctccccggcccccaggtggctggggcttctgtttctctttagtctgcaagttattgaaaaactgagtctattattcttcatttctggtatatcagtcatatagtaggaggctcagaacgggttccttgtgttcatacatttaaccccccatttcttatggacctggacaggttggtgttccccaattccaagaaggggccaggaaatcctcctcggataccgctcttccgtgtggacgcccactggaactccaccgggcgttggcgcaacgcggttgtgaaccgcccaagggtttgccacacaattggaccttccggggtcacagaccaaatgcttaggggtccataactgggcgccgctggtaacggccggtgtcatattacaaactctccagggacacaatttttggtgggggccggacctagacggcgcgaaagcattgccctgcaagggcttgtcacgcgtaacggggactaaactctttgaaaccccggttgttgggatcaaattccacaagacttatgtcacaaacgggattgcccttgtaattgggtttttcaacccaggaattaggtaaactggcacgccggggcagctctcgtgtgccactggcacacagctgacccgggcgtcggccttcagta

SEQ ID NO: 599392 - DNA, 598 bp, Homo sapiens
cgcgatagctcatgcctgtaatcccaggactctgggaggctgaggcgggcagatcacgaggtcaggagttcgaccagtctggccaagaaattcgggactagtctggccaacatggtgaaatcccatctctactaaaaatacaaaaatcagctgggcacagtggtgcacgcctgtagtcctagctactcaggaggttgaggcaggagaattgcttgaacccggaagtcagaggttgcagtgagccgagatcgcaccactacactccagcctgggcgacagagcgagactccatctcaaaaaaaaaaaaaaaaaaaaattgtcagattttcagcaagttaatctatttattcattcaataaatatttggggccaagtgcagtggctcacgcctttaatcccagcactttgggaggctgagtcgggcagatcacgaggtcaagagataaagaccatcctggccaacaaggtgaaaccccgtctctactaaaaatacagaggcaggagaatcgtttgaatcccagaggtggaggttgcagtgagctgaaatcacgccactggacttcagcctgggcaacagagcaagattccgacacacacc

SEQ ID NO: 599393 - DNA, 148 bp, Homo sapiens
tgcttgtctgctctgcctccccagtagttgggactacagtgtgcctgccacgatgcccagctactttttggtgtatttttagtagggacagtgcttcgccacgttggccaggttggtcccgaacctctgacctcaggcgatccacccg

SEQ ID NO: 599394 - DNA, 288 bp, Homo sapiens
atctgtctatcagcatatcagacaaagcacttatcacaagatcccagaaaagcaagcaaggtcagacacaaatttttaggtcaggcgcagtggctcactccgtgtaatcccagcccttgggaggccacggcgggcaaatcacttagggtcaggagtgtgacgccagcctggccaacatggagaatcccatctctactaaaaatacaaaaaattacaggcatgagccactgtgccctcccttcacattttttcaatggtagaaaagcaacctgatgggacgaagactgg

SEQ ID NO: 599395 - DNA, 152 bp, Homo sapiens
gctgtcgcgcctatccggaccgtagaccacgacagaagagatgcccagcctgctcactagcactgtgcaagtggacagtgacaacctgatcccccaaataagacataaagaatacccttaagagatgccccactctcccttgggctctatgc

SEQ ID NO: 599396 - DNA, 251 bp, Homo sapiens
aaagaagaaaaaaaactacataatttctaccagggccatattagcagtgaaacattttaaactgcagaaattgtggttttggttcagaaacaagttgtatatttttcacccctgattatgggaaaaaaatcaggtttctgtcttttgtggggtttgctcttacttatgggagattccaacaagtttactggggacttgaagtcgggccccatttctggtttaagaaataatatttttaaatggttaaggtt

SEQ ID NO: 599397 - DNA, 384 bp, Homo sapiens
ggatcgacacgcagctggcatcgtcccgcgtacggcttgggtcatagccgatccacacagggctgttgccgaatggacgcggatcgtccggtcatagtcggtccacagcgacaaatcggagtaacagcgctccaggtcaggcagagagaaagcgctctgtgtgctgtcgataaatttgcacatgaacaactgttcgaacttgtctccgtcgaactccagctgcagttgctccaggtcgaaccgatcgcacccgccggcgatcgcatccaggatcgtgatgacctggcgccattggccatccgggcatcgggcaccggctgcaatctgcttcgcgctcggccacggatccttggcgcttttatgcttgccgtttcggaacttctc

SEQ ID NO: 599398 - DNA, 126 bp, Homo sapiens
tatgctatcccaataatactaataaaatatacaaattaactaataagatatagaacatcaacataaaacaacctaaaataaaaaagaccaaccctaattattttatttctggtatatcaaggacta

SEQ ID NO: 599399 - DNA, 126 bp, Homo sapiens
ctcatagaggatccccgcactagacgtaacacagtgacccagacgtaacacagtctgacctcttagtgtgaggaaatggggcttgagagtaccctgtatacttgagcgctgggccaagaccctcca

SEQ ID NO: 599400 - DNA, 128 bp, Homo sapiens
tgaggcagtctccccgaagtacactgtgactcctgctagccatgcaacagcctcctagctaccacacctatcctcccgcacatgcacagtggagaggccgggaactgggcactgtgctgcttcactga

SEQ ID NO: 599401 - DNA, 368 bp, Homo sapiens
tagacgggttctctgggtctaatcccatccgggccatggcttaaatactattggtggaaaataatcttggagacagatttcagctacctcccttccaggttcgatttagctgggtggtaatggtcaattggtggtaataggtcttaccggtgtgaaagaaagaaaaagaaagaaagaaagaaagagaagggaaattataaggtcaagtaaacagtttggaggtttggggtattttccgggaactacttcaggtgagaaattaaaaaaaatgggtgacaaagcggtacagatagagatattagaagacaaagagattaaagggaattaaaatggcttgattaaaacctaaaggtgctggaaggggtacc

SEQ ID NO: 599402 - DNA, 1159 bp, Homo sapiens
gaacacagtacagacagattgagcctattggggtgtatcgcggagtgtgagagggaagcgccgcgagtgcctgtatttctagacctgcccttcgcctggttcgtagggcgccattgttgatccccggtgcgcaccatgctcgtactggcgaaagatcagagaatattgagcgactgttgtcgtccctgttgactatcggtactgtgggatggtactgcctgttgacatgggcaatgatggctgagcaagaatgaagactctaccgcatgtggtgtgacccgtagactagctggctgcatggcatcaagcggcggacggctagcgcacgatgggcacgcgtatggacatacgcacatggaggggaacgatgcgtgcgagcggatgggatcagtggcgatccgagcacattgggagcggacctagtcgtaaacgtacactaggcagttcccgtggcagttcggtctccgaaggcaagcgcgtcggccgcagttggagcaggaattcaatcaggcacgaatcgaatgcaagggcaaaaggcgccaattgcaacagacacgttacccctagtggttccgcccattgcatcgtaccgtagagaggggggggcaagcgatgctgatttcgtggctgatagcccctggccagaaggagacccaggcttccacgcttacgccacatgcggccgtaggaatccatctgggtccctgttttggactgaccacaatgggcggggcttccattaccgtagacgcatgcaaacatggtggagtaattggaacccgtgggttcattggttgccagcggcatgggaaccacttcaacacggtgttctctatagccccctgggttcacagaagggatgcgctctccggattagacagaagatagagcgtattaaaggcgctagttacgctagtgttgccaacaagggtttaggactgaaattccggggaaagggcatggggggcgacaaaatatagagaagggaaacaagttttttgacggttcccgctggtacaagtataacgaatatttgtccttggtagcaagttgggagctatgccttccacgctgtagaataggggcgtggagcaaaggaaaagaagctcgggctttggaagtgtgcctttgtacttatgtggtgggaaaaaagggagaa

SEQ ID NO: 599403 - DNA, 579 bp, Homo sapiens
  misc_feature (11)..(11): n is a, c, g, or t
  misc_feature (72)..(72): n is a, c, g, or t
  misc_feature (156)..(156): n is a, c, g, or t
  misc_feature (163)..(164): n is a, c, g, or t
  misc_feature (166)..(166): n is a, c, g, or t
  misc_feature (168)..(169): n is a, c, g, or t
  misc_feature (201)..(201): n is a, c, g, or t
  misc_feature (285)..(285): n is a, c, g, or t
  misc_feature (294)..(294): n is a, c, g, or t
  misc_feature (304)..(305): n is a, c, g, or t
  misc_feature (311)..(311): n is a, c, g, or t
  misc_feature (313)..(313): n is a, c, g, or t
  misc_feature (337)..(337): n is a, c, g, or t
  misc_feature (347)..(347): n is a, c, g, or t
  misc_feature (356)..(356): n is a, c, g, or t
  misc_feature (358)..(358): n is a, c, g, or t
  misc_feature (365)..(365): n is a, c, g, or t
  misc_feature (381)..(381): n is a, c, g, or t
  misc_feature (389)..(389): n is a, c, g, or t
  misc_feature (392)..(392): n is a, c, g, or t
  misc_feature (397)..(397): n is a, c, g, or t
  misc_feature (460)..(460): n is a, c, g, or t
  misc_feature (495)..(495): n is a, c, g, or t
  misc_feature (549)..(549): n is a, c, g, or t
aggtgacactngtttcctaagatacaatttactctttacaaccagggtccacaggtccaggctgcagagcgncagcaggaagcagagcctcccacctgcttctgggggacctggtaataaaaatcagcccatgatgcgctatgcctctcagcacanaccgccnnancnnctagagctctggaaatagtcaacaggggagtnttttccatgggggaaattttaaataagatgcccatgggacaggcaatagaaagtttgccaagttaaatttggtacataattgtnttcactccntttccaaacnnagcttntntgcgttcagttggtcgctcctgcngccgcctcantttggcttntngtttttntgttggccaccacgtngctggttnttnccgtnttttttactaccctgactgtagtcgtagccggggccgtagccgtaatagccatagggcgggtngtcgtagccgccatagccaggcccgtagccctgcnggtagccgtagccctggttccagtagttgccgtagccctgattccaactctgantctgacctccacctccaccaccacctccgc

SEQ ID NO: 599404 - DNA, 701 bp, Homo sapiens
ctcaatggtgcccaggctgtagtgcagggcgtgatctcggtcactacaacctacagctcccagccgtctgccttggcctcccaaagtgccgagattgcagcctctgcccgggcgcacccgtctgggaagtgaggagtgtctctgctggcgcccatcgtctgggatgtgaggagcccctctgcctggctgcccagtctggaaagtgaggagcgtctccacccgggcgcatcccatctaggaagtgaggagcgcctcttcccagccgccatcacatctaggaagtgaggagcgtctctgcctggcgcccatcgtctgagatgtggggagcgcctctgccccggcggcccatctgggatgtgaggagcgcctctgcccggcagctgccccgtctgagaagtgaggagcccctccggccggcagctgccccgtctgagaagtgaggagcctctccgcccggtaggcaccccatctgggaaggttaagcagtactatttctgagaaggaaagtttgcggcctttggaaatagggtctcactttgtcacccaggctggagtgcagtggtgtgatcttggcttgctgcagcatccatctcctggattcaagtgatcctccttcatcagcgttcccaagtagctgggactacaaagatgcacccagctaatttttatagcgtttgggtagagactgggtatcagcatgt

SEQ ID NO: 599405 - DNA, 191 bp, Homo sapiens
  misc_feature (18)..(18): n is a, c, g, or t
  misc_feature (105)..(105): n is a, c, g, or t
tgagagaccgtgttgcantgtctgatacacacacatacgtacatctgcatacattgcatgcacacatctgtatctgtctctctatccatgcagatgtacagatgngttatacaaatactttctggaaatgagaaaagcattagtggagtaaagtcctagattctaggtctgcattgaaacacggtctctca

SEQ ID NO: 599406 - DNA, 272 bp, Homo sapiens
caggctagggacggcatcttcagaagcaacagccttagctgtccatgggccccttattgtcacagctggagctggagtggctgggcagggcatagaaagacaaatactgcataatctcacttacttgtgaaaattttgcaggtcaaactcatagaaacagaaaatagaatgatagttgccagagactggggaggtggcaaaatggggaaatgtcagtaaacaggtacgaatgtcgtattaggccagttaaataagtgttggggataacatca

SEQ ID NO: 599407 - DNA, 299 bp, Homo sapiens
  misc_feature (58)..(58): n is a, c, g, or t
  misc_feature (114)..(114): n is a, c, g, or t
  misc_feature (188)..(188): n is a, c, g, or t
  misc_feature (199)..(199): n is a, c, g, or t
  misc_feature (234)..(234): n is a, c, g, or t
ccgtcgaaaccttatacccaagacatgggctgctagacacagagctagatttagatcnattcacatcttgaaggttgctgaaattgaaaagactgctgatgtcaagagacaatncgtcaagcaattcttgaccaaggatttaaaattcccattacctcacagagtccaaaaatctaccaagactttcncttacaagagnccatcaaccttctactaagccaacaagatatttcnacgttttttagtataataaaattttgtataattcattttgtagattcaaggaaattttaaaatat

SEQ ID NO: 599408 - DNA, 509 bp, Homo sapiens
acaagattcatgaagagtactgagccagggtagaaatcacaggagcagacgagaatgtgggtgccagtgcacagagctccatgaccagcctgggaagttagaaggaaggggaggcagaaggctgcttagtctgctgccatgatgggccccatgaatgttgcctctcaagtttctgtgctacacaggggtgtgtggtagggcgagtgtccttgtaaattgatacctaattggccttggttgagaacatagccatgagtgcccctcgtggatggggcgccagtctgtcattgatctcattgtgtcagcaccttccccccaaggaggctgaccctgccctgccagctgagactgggagatggagatgggctctgatcccagggctatccaggaaagctctggctttggagcagaagcgggtcctaggcattagtgcccctcactcggtgcctgggtccctgtgtgtgtggaacgggtagggctgcaccctgtggaagaggtcagcgtagtga

SEQ ID NO: 599409 - DNA, 448 bp, Homo sapiens
tgctgtcatcgtcagcttctgagaagggcctcaggaaacttggcaaagacatgtgatcaagctaaatgcccatcagtggtggactggataaagaacatttggtacatatacaccatagaatactacacagccataaaaagagtatcatggccttcatggcaatatggatagaggtgtagaccattatcctaagcaaattaatgcaggaacagaaaaccaaatactgcatgtttactcttctaagtgtgagctaaacattgagtatgcatggacacaaagaagggaacaatagacacaaggggtagagtgtggaggatcaggatcaaaatactacttctcaggtactatgctcgttacctggattacttgataatctgtacaccaaacaccacaacacacaatttacccatgtaacaaatctgcacatgtgacccctgcgaacctatga

SEQ ID NO: 599410 - DNA, 864 bp, Homo sapiens
  misc_feature (864)..(864): n is a, c, g, or t
agcggagtgactctagatagcatgagcaaatccggggttagagggaaaaaagctcctgggccaggtgctgacggtcgccgccgtcggtggactcagaccgcctagacctgccaatctctgtcagccctgtccagtcagctgattcgtgtgccctgtcgttcccggatcagatcataagccacttgtctggcttgcacctgctacatacatgctaagttacgctgaaagacgcccttctacagcgtgttctttcagggaatgtcctgtggtcaactttgctgcgagacactagtcctggttactgtgtagaagctggtgcggcctatgtgtacctctatgcaagtaacgtaggatgacggaaatgactctcgaaggaatacattcgtggccttccacgctctagcgacgcttttagttattttcggcccgacttggcaccaacctacggaaagttaattccaggcgttcgttttcgttgagttgccaggaaccccaagattgtgggctgtagagttttttcttgataggatttacctaattataaatttgaccgccaacattcacttcgattccatttcttgtcgggtgatggcgaagagtgggtttaagcacccctttttgacagatagacttgtaattcgctaggaccgtgagggcccttttaaccaaattgtccagcaggacatttgcacgcaaacgggtgcaagtacgctattccctttccctgccgtgaaaatccgaatgtaagctttgtgacaatgagttcatttttttcccggaaatttattaacccccttttaccaggccaaggggaacaatggtaactgccacagggtggaattttccctgtggaaattctgccan

SEQ ID NO: 599411 - DNA, 316 bp, Homo sapiens
  misc_feature (16)..(16): n is a, c, g, or t
  misc_feature (48)..(48): n is a, c, g, or t
  misc_feature (103)..(103): n is a, c, g, or t
  misc_feature (292)..(292): n is a, c, g, or t
gctatgggcgaacccnggcagatcatcagttagaaagggaaggccagncctgagctgccagcatcctgcttagcctgcctcacaaatgccctatgtaggttcnttagccctgacagctctgaagtgtcactgggcaaagatgactgcacatgggcagctcccacctatccttagcctcagcccagcatcttaccccagagccaccactgccctggcccctgttcccagctgtacccccacctctactgttcctctcatcctggagtaagcagggagaagtgggctggggtangcctgctgtaggccagcccactgt

SEQ ID NO: 599412 - DNA, 718 bp, Homo sapiens
  misc_feature (13)..(13): n is a, c, g, or t
  misc_feature (74)..(74): n is a, c, g, or t
  misc_feature (92)..(92): n is a, c, g, or t
  misc_feature (115)..(115): n is a, c, g, or t
  misc_feature (118)..(118): n is a, c, g, or t
  misc_feature (134)..(134): n is a, c, g, or t
  misc_feature (149)..(149): n is a, c, g, or t
  misc_feature (180)..(180): n is a, c, g, or t
  misc_feature (182)..(182): n is a, c, g, or t
  misc_feature (188)..(188): n is a, c, g, or t
  misc_feature (199)..(202): n is a, c, g, or t
  misc_feature (231)..(231): n is a, c, g, or t
  misc_feature (236)..(239): n is a, c, g, or t
  misc_feature (255)..(255): n is a, c, g, or t
  misc_feature (285)..(292): n is a, c, g, or t
  misc_feature (324)..(324): n is a, c, g, or t
  misc_feature (326)..(327): n is a, c, g, or t
  misc_feature (332)..(333): n is a, c, g, or t
  misc_feature (335)..(336): n is a, c, g, or t
  misc_feature (340)..(340): n is a, c, g, or t
  misc_feature (359)..(359): n is a, c, g, or t
  misc_feature (366)..(366): n is a, c, g, or t
  misc_feature (368)..(369): n is a, c, g, or t
  misc_feature (374)..(374): n is a, c, g, or t
  misc_feature (386)..(386): n is a, c, g, or t
  misc_feature (475)..(475): n is a, c, g, or t
  misc_feature (565)..(565): n is a, c, g, or t
  misc_feature (597)..(597): n is a, c, g, or t
tggagacagtgtnaaattcgagggaggtgaagatgcttctgtggctgtggagtggtccggggatggcagtgggnccctgcagaggagtggcngtcttggcaagacccgggatgcngcngcagaagcagtgaagncttggggaggaagcnccaggggacggagccccggcccgccggcggngncgggangggagcagccnnnntgaactatttgaaccaacctagcgcagcnccccnnnnggccccccggggcttnagtgccagctccatggacccctcttcaagnnnnnnnnattcaaccccgccccctggtttgctggtcccntnntcccnncnncccncacagcatcccccattgcncctggcncnnccccncccctaggtggnacagtgaaggggagcagtttaaccagaagattgctgctgcccttagggtctcagccccctcctcaggaatccctcttaggaaggacccncaggacaccctctctgcaccctgtggtcctctagagtagctagctctgaggccccaaggtgggtacaaagcaggtatggccctcagagangcagcctgctgctggcttttcagtcagagggntgggggctggccagccaagctgccttgccctggccgctcttactccctccctctgctgtctcacttcaggtccatgtatttcacttttcttaaataaaagaatcaggtaacctttcaaaaa

SEQ ID NO: 599413 - DNA, 442 bp, Homo sapiens
  misc_feature (199)..(199): n is a, c, g, or t
  misc_feature (289)..(289): n is a, c, g, or t
  misc_feature (321)..(321): n is a, c, g, or t
gtcctgcctgggtcccccccccaccccccaacagccccctcaaccagcatttcccccaattgctcccctgggctcttttcccccaaccccctaagggtggggaccagttgaaagggggaagccagttttaaaccagaagattgctgctgcccttagggtctcagccccctcctcaggaatccctcttaggaaggacccncaggacaccctctctgcaccctgtggtcctctagagtagctagctctgaggccccaaggtgggtacaaagcaggtatggccctcagagangcagcctgctgctggcttttcagtcagagggntgggggctggccagccaagctgccttgccctggccgctcttactccctccctctgctgtctcacttcaggtccatgtatttcacttttcttaaataaaagaatcaggtaacctttcaaaaa

SEQ ID NO: 599414 - DNA, 204 bp, Homo sapiens
gccgcgctttcctgctctcccccgctcgtctgcccgcggagggctggccctggggtacccctccccacctgatggcaccgagcgtcctggccttagctgccccaccccgactcttcctcatggcagggcacctgtgtatatcaaactagccggaccacaggtgccctgactgatgtgcgcaccgggcgctgaaaccagagccgc

SEQ ID NO: 599415 - DNA, 1011 bp, Homo sapiens
attaaacagagtcctgaccttcatttctaggttccttccaagaatggtgtatgcacgtgccaggatggacaccaataacagacgtgcctataacagtgacttgattgccaaggaatgtaaattaccttacacttgcagtatctcccataaacaaatgtaatgggcatatgggactcgaatgtaggaatcaaatatccctccatacagtgtactcttattcttggcaagaatgctttaatgtctaaccaagaattttaattctattcatcttgcttcacagtgttgatcattgtgtcttggtattgcaaactttcaaattgtttcttaccatattgcctcttctctttgagctctgtgggatcacctttaacattcagagatgatagagtggttccccactgagaagccaaaacaaggccttaataaccccttaagttcaccatatgactcagacaggcgacacactacagtggagagactctctcacgagatcctgatcactgacaagccttacacttataactccagacatgtaccataaacctcggaatctatattcgttcaaaaaacatccctttgactttctaagtgtctgcttacgcacggcagctgtcagaatgtgtggttaccttcggttgagatctcccacttcttctggactctctgctcagattccccgtagtgtgagtaaccaaaaccatttacctaagacgtacttggtctacggaatcttggacaaacccccagcctggggtcaaccaccatctccccaagcggaacacggtcactccgagtcggtctaaaacatgcggcgtccgacaacggccccgcacgacacaacttcaatacacgccactctgcatccctcctcctcatcacgcgccagcccctctcccaaaccccacacctgtgccctgtcccctctcgcgcaaacaccatcaccagccaaccatacacactatctaaccccacttcttccttcgtctcacgaccatcaccacacctacctat

SEQ ID NO: 599416 - DNA, 815 bp, Homo sapiens
gcgctggcccgggccctggaggaagccatggagcagaaggcggagctggagcggctcaacaagcagttccgcactggagatggaggaccttatgagctccaaggcatgatgttgggcaatgagtgtccatgacgcttggagaagtccaagcggtgccctatgagcagcaggtggaggagagtgaagacgcagcgtggaaaagctggacggacgagtctgcaggccaccgagagatgccaaagctgcggttaggaggtcaaccgtgcaggccatgagaggcccagttcagagcggagacgctgcagggccagggaccgagcatgagccgagcgagaacgcaagaagacagctaggtccagactagtgtgcaggcgacgactgcgaggcacgagtctgcgaggcacgacggcaggacagcatgctgcttcggattgcgacagtggcctgcccgggagaggaaagcctggatcactggacgctgcaaggaccctaggaggcagcacagtcgaactcgtgcacaatcagagaatccaggggacgaacgccgatcaaatcaggctgcgtgaatgctgcatggcccaggatgaaggactgcattgcgcgagctgggatgacaacccggggcctctcgcagaggagatcctggctcgaggccgaaagagaacgagcaacgaacgctgaagcagtcatgtgaggccgagatgagtcaagttgcaggaggaactggcagccgcggaacgtgcctaggcgccaggccagcatgagcgcgatgagctggctgacgagatcgccaacagcagtggtaaaggagcctg

SEQ ID NO: 599417 - DNA, 200 bp, Homo sapiens
cgataacctaagacatcgctatacgacggcgtgaatgtattagatgattcgctgatctcgacggaaagcaatatgaaatgatctgctgcatgggctctgagccctaggattcatctttctttacagcgtagtgggccttgattgggattgtatttgccacctcatcacgagatctcggactacacgacacgtactacgtt

SEQ ID NO: 599418 - DNA, 304 bp, Homo sapiens
ggtcgtttctagcaggatcccctccactttttgcacctgttgtttggttgtcacttttcatctccatctttgcattttgagaactcttacacgtttctgcatggtccattttatatctagcttgaatgaccgtattactttctggttgccagcaatgtttttctttcttttcttgcttcatcctattttacatgtctgtgcccttatctgtgatataattttccaaatcatataattgccttgaagcagcagatttagcatatatatgctcttcagctggcaattcaatcaacatggcagtttc

SEQ ID NO: 599419 - DNA, 315 bp, Homo sapiens
tgcttcccttctgggctgcataacaaggttctgcaggctttgtcaaggtgtaggcaggcgcacttccttctggggctgtgagggacaatctattccatgcctctcctttagtttctggtggtttggtggcaatctctggtgttccttggcttgtagatgcatcactctgatctccgtcttcattttctcccggcgttgttaagtgcatgtgtctccttgtgtccaaatttcccctccttataaggacaacagtcacctaagatcaggatccaagatgacctcatcttaacaaatgagatctgcaacaaccctgtt

SEQ ID NO: 599420 - DNA, 307 bp, Homo sapiens
  misc_feature (1)..(1): n is a, c, g, or t
ngatgcacacaatttaatataataaaatatttagtcaatatgtacctcacattatgagcacacatgtccattataaggcaatattatttattataattatccaatactatgttttaaggagcaattttatcaaataacatcacatatgatttttgtttatttcacatttacttcaggatttattttttctgttgttgcagttctttactgatctctttagtgaaagaaaattgatagtacttatttcttgaatttcaattatttataattctctctgtgtcaaaatcctaggctactcccaattggc

SEQ ID NO: 599421 - DNA, 201 bp, Homo sapiens
tctgtctaaggtcactcgtatgaggcagtcctgaacttccttaggtcagcttgcaagatcacagtagcacggctaccagcagaccaacggaagctgtttgctccttcagaaccttacagcctggaatgatatcacaccaggtctatgcctctcagcgaatgagagctggcaaaggcaaactgagaaaccgtcgaattcgag

SEQ ID NO: 599422 - DNA, 135 bp, Homo sapiens
ttcaagccatatctttgagcacctgatatctttcatttcctgaaacctcaccactaaagtttttaaagcgccactgaacatagtaagagtcatagcttttaccgggtgaatgacaaatggcatgatcttggccca

SEQ ID NO: 599423 - DNA, 339 bp, Homo sapiens
  misc_feature (116)..(116): n is a, c, g, or t
  misc_feature (232)..(232): n is a, c, g, or t
  misc_feature (236)..(237): n is a, c, g, or t
tcccccgcggttatgtcttacggccaggctattggattcgaatgagtaggctgatggtttcgataataactagtatggggataaggggtgtacgtgtgccttgctggtccgcggtnatgtcttacggcccagagcaacctggggtgatccccgcgctctcatggacctcctgcagctcacaagggaggagggtgctgagggccggccatgggctctctctgtcactatgtcntacnnagaaatctaccaggaaaaggtgaggctcttttctgatcgaggaaggaagagacaaagggttaaatcagacttagttgtagaacccgtaagacataaccgcgg

SEQ ID NO: 599424 - DNA, 655 bp, Homo sapiens
gcaatagacaattatagaagtttaatcataacacactgaagataaaatagcactgattttttttttttctgagacagagctctcatggttacccaggctggagttgcaggggtgagatctcagttcacgtgcaacctcgagtctccgtggactcaagcaattctcggtgcctcagccttccccagtaacggggattacggggtgcacagcgctcgtgcctccgttgggttcaaggcgattctctgtgcctgcggcctcccgagttagctgggagttacaggcaccgtgccgtggttcatacaaccatgtggattgaaactgtgagagacatttaatagctataggtgaaatagagccagaacacaaagtggaccaaatgtgtcattgtgaattccagcgtttaactgagagataccttagaaattagggcaaatttcaacattatgaccagaaagagttagcactggtgaaatgtttcacgtggggacgagacagggacaggaaagcaaatggtgggactgggtcaggtttcaaatggggcgttccacgaaggtttcttggggtgtgcgggaaaaatatggaacaagaagtttctgggggcaagaatgggaatggatggggtgaaaggtttgggccccaataaaggtgttggaaa

SEQ ID NO: 599425 - DNA, 303 bp, Homo sapiens
cctcgccagtgtactagttgtggtatgtgtgcttgtaggcaatctgctccaataatggaaaattaatgctaacctaatataacagcatgaaggcaagctaggtattgcaaacaaagttaaaaagagaaagaccttggccgggtgcggtggctcacgcctgtaatcctagcactttgggaggccaaggcagacagatcacgaggtcaggagattgagaccattctggccaacatggtgaaaccccgtctgtactaaaaatacaaaagttagctgggcatggtggtgtgtgcctgtaatcccagc

SEQ ID NO: 599426 - DNA, 150 bp, Homo sapiens
  misc_feature (138)..(138): n is a, c, g, or t
cctggttttctcacagagaatgacaaaaatatgaataagaaattcagatagtgaaaagtgtaatgaagaaaatatgcaatgtcacagtgacagcgcagaagagctcattcagactggcaggttgggaaaagtttcacntgaagaagggac

SEQ ID NO: 599427 - DNA, 1917 bp, Homo sapiens
  misc_feature (50)..(50): n is a, c, g, or t
  misc_feature (58)..(58): n is a, c, g, or t
  misc_feature (114)..(114): n is a, c, g, or t
  misc_feature (993)..(993): n is a, c, g, or t
  misc_feature (1323)..(1323): n is a, c, g, or t
  misc_feature (1345)..(1345): n is a, c, g, or t
  misc_feature (1710)..(1715): n is a, c, g, or t
gttcccgggacccctgggaggaggccacccccgtgagggggggttagggnagatgggnagggcccccgggaaaagtgattagaagtcaggtatgggaaggctaaataggacagngtcgagtacatctctgcttggaaaaacatatcaacacccttttttttgaacattatatcttgttcataaaagaaaactttccacattgttttaacaaaccccacagctgagagtcaggcctgaatctttgatgtgtgcccagtcacagagttgaccctattggtttgtggtggggcagggcatcaaagacatcattgactaatcacattcccctgaatagctcatatttagaaaatattcttagattgtaaaaatgtactattaatttgtgatattcagtcttttaaatattttatacattaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggaactaatcaaatcagctaatcatgaagacatgattttcgttttagaaaacacttttgaaaacttgggataatctcatgccttaatgatcaaagcattatgagaaggacagtggtttttaacctggggcatacgttctaacacatttactctccactattcgtactctggtagccacgttaaccccatcagagattccttctcaagccatgtctcagagctgagaggcatcccagcaagttttgcagctcacagttttttccgtaaattacttattctataaaatggagtaggccataaacttcggagggccctagaccaatttttggattattttcgtcttctatcattccgntgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacatttgttaaaagttagtagtgaagtgtgtaacgcttaagcanactttcatatttcaaatctctntagcacgtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaannnnnnattctactcattatttttacttcaatttaagatataatgtttgaaattagtataattctaagctaatacgtatgcaatgtaggaagctgtaattactgacaaaattatgtgaagtggagaaaacctggggaagtggatggtttagatgaaactgagttaatttcatattggatttaacagtacattggtcataaactttata

SEQ ID NO: 599428 - DNA, 302 bp, Homo sapiens
  misc_feature (61)..(61): n is a, c, g, or t
ctggggcatgggtaacaggtactgctgggccgaaggggggcgtcgctggaagcataacttntggcaatttctacagaaacagttgaagtacctggctttctccgtagcggtgaacaccaaccttccgaggcgctaccacttccggccccaccgattttggcgaccggcgagttgctgcccacaaaacaacgaggccagccgtctggaccgttaagggttgacgcatcaccgcctacacagaaaaagcgtggtggttcctgtgcctcaagtcggcgttgaagcctcagaaatttgctattggg

SEQ ID NO: 599429 - DNA, 1725 bp, Homo sapiens
  misc_feature (50)..(50): n is a, c, g, or t
  misc_feature (58)..(58): n is a, c, g, or t
  misc_feature (114)..(114): n is a, c, g, or t
  misc_feature (801)..(801): n is a, c, g, or t
  misc_feature (1131)..(1131): n is a, c, g, or t
  misc_feature (1153)..(1153): n is a, c, g, or t
  misc_feature (1518)..(1523): n is a, c, g, or t
gttcccgggacccctgggaggaggccacccccgtgagggggggttagggnagatgggnagggcccccgggaaaagtgattagaagtcaggtatgggaaggctaaataggacagngtcgagtacatctctgcttggaaaaacatatcaacacccttttttttgaacattatatcttgttcataaaagaaaactttccacattgttttaacaaaccccacagctgagagtcaggcctgaatctttgatgtgtgcccagtcacagagttgaccctattggtttgtggtggggcagggcatcaaagacatcattgactaatcacattcccctgaatagctcatatttagaaaatattcttagattgtaaaaatgtactattaatttgtgatattcagtcttttaaatattttatacattaaacaaggcatagttacaagtataaaacataaatatcccaaagccattatgcatggcactcaagattaaaatgggaaataatacatctaataaatcaaatgttccaagacttcaaatgtcttttggaaacaggctatgtaaaacagcacactggtttcaaactttggtaaattttaagaagaactcttacaaaggcatttaattcttatacataattttcaggggaactaatcaaatcagctaatcatgaagacatgattttcgttttagaaaacacttttgaaaacttgggataatctcatgccttaatgatcaaagcattatgagaaggacagtggtttttcctagaccaatttttggattattttcgtcttctatcattccgntgatcttagatattctctgcattaaatattaaatatcacttctaggctgaaaaatccccctaaaaatatttctagctcagatttttcctccaaattctgcaatagaagatcacaatgtgaactctgcatctccatgttaaagtctaatggacattcacacttagcatgtctcaaagaaatctcatgtaaaccatggccatcctgttctaccttaactttctgagtctatggaatgataatttcacatctcataaacttgactgatgtaagtgtcaagaaaagattgacatttgttaaaagttagtagtgaagtgtgtaacgcttaagcanactttcatatttcaaatctctntagcacgtgtaactcttttttcaagatgtgaaataatcattaggtcagtcatttgtaaatagtacatctgctatggactttttccagttcttcaccatccatttttataaaactcttattgttaaaaaaaaagttactcagaatttcataaagccaaacacctgatttcaggaacacttgagatgtaagaaaattttatagggacctccaatcactaattttcctattttttctctcaaagaaatgctgaagggaggaattcaggttgaatgaaaggaaatagtaacttacagccatatagagttataaagacttcttgtaaatgtgaacatatggtaaaatataaaaacatgtatttttgaaannnnnnattctactcattatttttacttcaatttaagatataatgtttgaaattagtataattctaagctaatacgtatgcaatgtaggaagctgtaattactgacaaaattatgtgaagtggagaaaacctggggaagtggatggtttagatgaaactgagttaatttcatattggatttaacagtacattggtcataaactttata

SEQ ID NO: 599430 - DNA, 254 bp, Homo sapiens
  misc_feature (90)..(90): n is a, c, g, or t
  misc_feature (106)..(106): n is a, c, g, or t
  misc_feature (113)..(115): n is a, c, g, or t
  misc_feature (227)..(227): n is a, c, g, or t
tgcaaggactgacagagaaaagaagtgctttgaattctttctctgctgactagacatgatgtactaatgcgctcaagctgaagaatctanatgttcgtcttgactncagtacnnnaatataatgctattacttaattacttgtgaaaaacaacacattttaaagattacgtgcttcttggtacaggtatgtgaatgacagtttatcgtcatgctgtcagtgtgcatnctaaataaatatatattcggacgtgga

SEQ ID NO: 599431 - DNA, 753 bp, Homo sapiens
  misc_feature (22)..(22): n is a, c, g, or t
  misc_feature (198)..(198): n is a, c, g, or t
  misc_feature (221)..(221): n is a, c, g, or t
  misc_feature (435)..(435): n is a, c, g, or t
  misc_feature (445)..(445): n is a, c, g, or t
  misc_feature (453)..(453): n is a, c, g, or t
  misc_feature (489)..(489): n is a, c, g, or t
  misc_feature (562)..(562): n is a, c, g, or t
  misc_feature (571)..(571): n is a, c, g, or t
  misc_feature (591)..(591): n is a, c, g, or t
  misc_feature (604)..(605): n is a, c, g, or t
  misc_feature (615)..(615): n is a, c, g, or t
  misc_feature (623)..(623): n is a, c, g, or t
  misc_feature (625)..(625): n is a, c, g, or t
  misc_feature (629)..(629): n is a, c, g, or t
  misc_feature (636)..(636): n is a, c, g, or t
  misc_feature (644)..(644): n is a, c, g, or t
  misc_feature (651)..(651): n is a, c, g, or t
  misc_feature (653)..(653): n is a, c, g, or t
  misc_feature (685)..(685): n is a, c, g, or t
  misc_feature (718)..(718): n is a, c, g, or t
atcagcgtgcgcctgcgcacgngaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggnagccgtggagtcggctgaggganaagcgaggcaaggcaggcgggtcgtcaaagtcctacattttagctttcagtgctgaacttccttctcccttaaattattataaacttttgctgctgtttaataaacgtgaagatgtctcgcagtcctgatgcgaaggaagaccctgtggagtgccctctttgcatggagcccttggagatagatgatatcaactttttcccttgcacctgtggntaccagattngccgattntgttggcatcgaattcgcactgatgaaaatgggctntgtcctgcatgtagaaagccatatccagaagacccagcagtttataaagcactctcccaggaagagctgcganaggatcaangaatgagaaaaaagagaaanaaatgagagaaannagaaaatatnagaaaatngnaaanatttggntagtgtangtgtgananaaaaaagctcgtctttgttgtaggtttatatnagggggtaggagagggagaggttttaaaaaganaagaatattttgggaagtttggtaaaatatataaa

SEQ ID NO: 599432 - DNA, 340 bp, Homo sapiens
agagaggatccatgggtgctcatcccccggcagcaggaatggcctggtgtttgcaatatgtttgtcacggaggccaggtacccagtgctggctacacaaacaccctggacaatgtccatgggactaggggtcccacccagttgacactggtggtctttgaaggactctggggtcttcacagctcgcactgtggctttactgcataggccttagaggcaggctatgtgggctctaatcctagcttcaccactgaagtaaccgtgtcagcctggccaagccacaggaaggctctctgtccctaactttccccctcactggcctggggggatggagcacccat

SEQ ID NO: 599433 - DNA, 238 bp, Homo sapiens
  misc_feature (72)..(72): n is a, c, g, or t
cataagtgggagctgatcaatgagaacacatggacacagggaggggagcatcacacacctgggcctgtcggngggtgggggtcaaggggagggagagcattaggacaaatacctaatgcatgcgggccttaaaacctagatgacgggttgatcggtgcagcaaaccaccatggaccaggtttcctggggaaaccaacttgaacgttttgaacatgtatccaagaccttagggcaaatt

SEQ ID NO: 599434 - DNA, 900 bp, Homo sapiens
  misc_feature (111)..(111): n is a, c, g, or t
ttgctctgtgtggttctgttgtggtgttatacgttgtggttgtgtgtggtggctaggctcctgttgctcgcggaatcccgcggtgtcgggggtagtccccagtccgcgccngttctcggggtgttcccctcgccgccggcgggttgtggtattcgagcccgcccttttgggcgcggtttttttcgcgccaggctcatgctggctcgtggggtcgccgagtgctccttttggcctagtggagtccggcgcggggctagtcttttgttgtgggcacgccccttttatccgttgttgtccccttgccgggtctcccggcaccattgtccccgggtgttctcccccctctcccccgcgcggtgatgtttatgcccccgtctcccgggctaagtgacagggtgattcttcccgttgctcccccccgagttggttcttttctgctgctgacgccaactgggtaatattgggtagactaagctttgtgtctgcgcgactcacgactagttctcaacaaggacttttcatcgtcgaaattggctgctttgtagagcaacttggttggggggcgcttaacaaaagaggaagaaacagtttttacacgccccccgcccacgacagattagccccccgtgataaataagggttatatgctgtgcttgggcgccgtgaaatttattatatgtgtgagtccgaggatgcgccagcaattcaatgtcgcgctctgtctgcgagaggagtcgcctctttgtggtagaactcgggtttcgggggttgtttttcgcgacatcgcagtgtcgcaagcacaactatgttggggccaacagctgtggtgcactactcttgttgagccaacgaacccaaaaacccaaccctggggggttacaaaaaaccccgccccacaaa

SEQ ID NO: 599435 - DNA, 257 bp, Homo sapiens
  misc_feature (55)..(55): n is a, c, g, or t
  misc_feature (212)..(212): n is a, c, g, or t
  misc_feature (256)..(256): n is a, c, g, or t
cgggctgggcacatcagaacctgggggatacaggtgtcctctgtggggacagcantaaaacttggataggaggccggacgtggtggctcacgcctgtaatcccagcactttgggaggctgaggcaggcggatcacctgaggtcaggagtttgagcccagcctggccaacatgttgaaactcagtctctactaatacattaactaggcatggnggcgcatgcctgtcgtctcagctatttgggaggctgaggcaagnt

SEQ ID NO: 599436 - DNA, 510 bp, Homo sapiens
gactaccggggcttggtatagcatcctgttccgctcctgttcctcttgcccgtgtgtgctgatgagagacttttggtcagggtcgcagttgtctactttatgcctgtacttcttgcctcagtgctgttcctctgctctccaggctacaccatggtaccacttctcaggtcgactcttcctaggcatcctcccatctcgaggatactcaaagtgaaacgagatatctataaaacacgggaaagttggaaaatagattcattagccattcatgtacacagtgcagtataaactactctcatagatggtacttctaaatgaaaatacacaaatatttataagctttaatagtggtccctaaaacataggcaactatattttcctgtctttataaattcataatggagacaatataacaaaatatttagggtaagaactgtttctcatcagatctctatagtgcatactttaatggcatgcagtgctgatgttcacaataaacgaatatgttta

SEQ ID NO: 599437 - DNA, 381 bp, Homo sapiens
ttggggctcattcagggcaggaaagcaaagtgcgggggtacagtttggcagatgggtggaaacacttagccaaacttaagtggccggggtaggaccatcactcccaaagttggtcagcagagaagggccgctcgggtgtgagtctatccaaaccgggcatggctctgaaatggagtcctcatcccagggggaaggtctgctggggggctttacattccttgtgactagtgtgctgggatattaccttctgcttcccacttcctttttttttttttttgggagacagagtttggctcggtcacccgggttggagtgcaggggggtgattggggctcggggcaccctccagtccgggtacaaggcgatcctcgtggctaagcc

SEQ ID NO: 599438 - DNA, 244 bp, Homo sapiens
  misc_feature (231)..(231): n is a, c, g, or t
  misc_feature (237)..(237): n is a, c, g, or t
tgtcggccgctgcccctacccgccaaattaactttgaaaactctgatccagaaatgctcggggagactgatttgaataataataaaactcctgtctcccgaacagccggctctgcgtgaattactatttctccttacaattcccctgtcttcacaaatcggctctctctaggcagctggcaggaggggtccctgtgtaaacgtccagtggattcaccttgtgggtaccgangctcgnaattcgt

SEQ ID NO: 599439 - DNA, 390 bp, Homo sapiens
  misc_feature (145)..(145): n is a, c, g, or t
  misc_feature (153)..(153): n is a, c, g, or t
  misc_feature (210)..(210): n is a, c, g, or t
  misc_feature (283)..(283): n is a, c, g, or t
gtaacacaaagagtggggcgttgctgtaaagataccaaaatatgtgaaagtgactttagaactagataacaggcagaggctggaacagtctgtagagctcagagaaagatggaatatgtgggaaagtttgagacttcctaaaganttattgantggctttgaacaatgaaattcaggctgaaatggtctcagatggggatgaagaacttnttgggaactggaggaaaagtgactcttgctatgcaaagagactgaagcattttgcccctgccctagagatttntggaactttgaacttgagagaaatgacttaggagtatttggtggaagaaatttctaaggtggcaaagcattcaaggaggaaacatagcataaaagtttggaaaattt

SEQ ID NO: 599440 - DNA, 583 bp, Homo sapiens
ggcatcacctgcgcagggacctctggggctcagccctgagctagtgtcacctgcgcagggccctctggggtctcagccctgagctggcgtcacctgtgcagggtgcctctggggctcagccctgagctggcctcagctgggttccccatcctggtctctcgtggcctgcgtttcgtgcactgagcctcctattctgactgggcatcatcctgtccctaggcgcctctgctgtatggttcctgatatactgtgtgcatgacgtcccgctcggtgccgtgtgcacgcaagtgatccatccgcgtctgccgttcatgctgcccgactagaactgggatttcgtccacacactaaatgcatgctactgtaaacacgtgtaacgattacagttataatatctaactggctacagcttcgtatgttcactacgatgtctttcgtgtacgcattccgagtcgagcccgttcatgacgtaccttggaggagtgaaacccgaaaggtgctaggggatggcccgcatgtagaactttaatctcttcggcgcattctgatgcaggcagtccggaagtggtgcatgtggtgatgg

SEQ ID NO: 599441 - DNA, 813 bp, Homo sapiens
gtactacttcttgtgctgctactgctgttaaaagctattaaaaaatatatttaacatgggcctggcacggtggctcacgcctgtaatcccaagtagctgggattacaggcatgagccactgtgcccggcaagatctaactcacgcttacttttcattaaaatatttctggtcgcttttagctatgtcagaatccaataaacagcttacgcattcattttggtaaagcaaatttcacaggaaaatagaccaacaattataagagattcctggagacaacacaacggaaaaaccacactgtttaccaagcaaaatagcctgtgtacatgtcacggtaatgtaatgcccaagtgaactaaacagatttttcgtcaagcaaacctactgtttctacttgggggcaacaacccacgtccgttttacatcctgtacctctcacggcacagaacagaacaagcacaacaggttcttcttcttctttattaatggctactagaaaatgagcagtgcaagagtctacctgtactattctaatacagtaagaatatgggacacaaaaatggaggtaaccttcttaacatagatcgccttggcacactcggaacctgttcgattcactgataataacccaatagaacgggatcttcaccttaacaccacagcctatttttaattactctctaatttgcacagatgactcagtctcatctctgctttattccatacacggggggaacctgtactgcactccggagcaaatcttcacaagcgacccgggcgctctaaacctcgcctccctgggacacccacgcgct

SEQ ID NO: 599442 - DNA, 426 bp, Homo sapiens
ggggtgtggatcattttgagccgtctggccttgctcagtttattttaataaaagtatttctgggagggaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttttggcccccttggcccaatgaactttaaaattgaccaaattttttcaatgggcccaaatttaggcctaattggccaattccccctaatggggggccttttaaaaataaatggcccccgtttaaaaacctgaaaactgggaaaaccctggggttccccaaattaaaccccttggaaaaaaacccctttttcccaagggggttaaaacccaagccccgcccgattgccctttccttggcct

SEQ ID NO: 599443 - DNA, 483 bp, Homo sapiens
gtccgcgtgtgtgagatactcatattcattatacatcactgggttcctcctcgatggcccttaggtacatacagcaaagaaaatctgccatgtgctcagagtacagaagaagctattctcgtgtggtaatcttttaacaatcaggtttttaatactctccttgaacacaagactgctacatgatcaggtgctcaaataagggtatcataacgcatgacagagaatcattaaatggaatcactaatgaggaaaggcattgctgatatcaataccttaatcacttgacattgtgcatctttataagaagggtaaatcttagttacgaccactgagtaggaagactgttaagatggtataacggtgcagatatgcgagaaattctgtccaattacagaacttatctacattacttacaacatatgggccaggcgtggtggctcaagcctggccacgatttactccatcgggggctcctctagagtc

SEQ ID NO: 599444 - DNA, 121 bp, Homo sapiens
gtaattttctgtgtaggtagaaataaatgtagctttcttattttacacaaataggaacttacttttgctaatctactctttgatactgtttgaatagtatttatataatgtttgtgaatta

SEQ ID NO: 599445 - DNA, 767 bp, Homo sapiens
  misc_feature (358)..(358): n is a, c, g, or t
  misc_feature (700)..(700): n is a, c, g, or t
agcggatggggcacaaggtccctccagcgagggatccgctgacattacgcagcctccatgtaagtccacgtttaggttgggaggatctaccatgaagaaggtcaaggaagaaaaggtcagatggccagacgccagcgagatctccacctcccagcatgctagactccaattccacctctcagcagcctagccctgaatccacaccagagcaggctagtcctgaatccacagcacagcagcctagcccgtgaatccacatccagcaggcagttccatgccttgagaagccacctcccgggcaggcgcagcaattccaatgcccgttccaggcagcccgaatagtccggccgacttccantcttgtctggccatctttactctcgcatgaatgcttaacgtcgaaggcgagctccctcgaatccatggaagagcagggcctctgactcgcgccggcccgcattcctgctcctgtgccacttgcccctgcagctcctgcttgctggcgtcgtctggggctatgccatagaccgcatcttcgatgtccttctgcctcgggactggcagatggtgccagggagaggactccccaacctgctcaccttctacagaagatcttcaagaaaaccctccagtcatcgtaacgcgtgtcctccaatgccctcggaactgtggctgtggctctgggggctctaggagctgnctactacatcactggatccttgtgaacaagcccctaggcccacagtctggcagacctccaccagccc

SEQ ID NO: 599446 - DNA, 491 bp, Homo sapiens
gagctggaaccgatgtaagaagaaaaggtgtcctcatagggtctgaccaaaatggggactatccctttaatcccccactaaatcttcccatcagtaaagcagtagcactgtgctgatagttgagagattacagagaacacagagtcattgcccttaacccccaatgagctcacagtgcagtggaggagacagacactgaacacagaataatagggtacaatggataaagccataatagagggctgaatgagacactgtgagggctaaacacttatactgcacattacccatcttgatttgattgcagttgccacagtgggcccagtgcaccatgaagtgcctcgctcattgagatggctaaaatgacctgcttggccagggctcagccgtgcaggtagaagacaggttatacaactctttcttatgatggagactctttacccagttgacattagtgctgagactgaagcacatttttaaaattccaacaa

SEQ ID NO: 599447 - DNA, 230 bp, Homo sapiens
  misc_feature (42)..(42): n is a, c, g, or t
tagtgtaactgtaggttacaggcttagtgctatcgtgataangataatatgtacagcaaatccccatgacacaagtttactatgtaacaaacctgcacatgtacacctgaacctaataaagaaaagagaagaaaagaaagttctacttcctgtacctggttctattccaaatgtggtgaaaccttgccatggttcaattcttcttttttttttttttacttttcctttgg

SEQ ID NO: 599448 - DNA, 324 bp, Homo sapiens
atgttccctaatgcctgatgatgttaagcatctttttatgtgcatattggccatttgtgtatcttctttgtagaaacctctgttcaagtccattgtccattttctaattgggttgtctttttgttgtcgagttgtaatattccataattaaaaaaacctctcgagtagctgggaggctgaggcaggagaatggcgtgaacccgggaggcggagcctgcagtgagccaagatcgcgccactgcactccagcctgggcgacagagcgagactccgtctcaaaagcaaaaacaaaaacaaaaacaaaaactctcccggggtggcctg

SEQ ID NO: 599449 - DNA, 297 bp, Homo sapiens
gatgggcaagatcctccgtctctactaaaaatacaaaaatggccaggcatgggtggtgggcgcctgtaattcctgcctcagcctctcgagtagctgggactacaggcatgcaccaccacacccagctaatttttatatttttaatagagatggggtttcaccactgttggtcaggctggtcttgaactcctgaccccaggtgatccactcgcctcagcttcccaaagtgctgggattacagttgtggaccactgcactcagctcaacctttattttttaacgagatgggatcttggc

SEQ ID NO: 599450 - DNA, 777 bp, Homo sapiens
  misc_feature (77)..(77): n is a, c, g, or t
  misc_feature (83)..(84): n is a, c, g, or t
  misc_feature (234)..(234): n is a, c, g, or t
  misc_feature (256)..(256): n is a, c, g, or t
  misc_feature (260)..(260): n is a, c, g, or t
  misc_feature (268)..(268): n is a, c, g, or t
  misc_feature (311)..(312): n is a, c, g, or t
  misc_feature (338)..(338): n is a, c, g, or t
  misc_feature (358)..(358): n is a, c, g, or t
  misc_feature (376)..(376): n is a, c, g, or t
  misc_feature (396)..(396): n is a, c, g, or t
  misc_feature (401)..(401): n is a, c, g, or t
  misc_feature (409)..(409): n is a, c, g, or t
  misc_feature (427)..(428): n is a, c, g, or t
  misc_feature (451)..(451): n is a, c, g, or t
  misc_feature (457)..(457): n is a, c, g, or t
  misc_feature (464)..(464): n is a, c, g, or t
ccgggtggtctgggtggggggctcaaacgcaggtctctgggacgcaggcactgctccaggtatagtgcgggaacatngccttnnagctgggcaggctgagctcgggcccctctggctcgtggcgcggggcggctgcggagggccccgcgcctggtcccagtgcggcggcggagggctccgagcctggtcccagcgcagcgcagccggacgcgtctgccggccccctggcccggntggcacggagcagagccgcggnctgnggcacggntcgacgtcgagaggcggcccctgggtggggacagggcttggcnngcggcgctggcggggttggtggggcntggccaccgccgccttcggncatgtcagcgggcggagnatgttgcctaagacctcggnggacncgggccanttcggctggggaggccgnnaggaggaggaggatgagctggcncaccgnttgcagncagcttcatggccccgccttgtgaccgacctgggcgaagcttgcgaaagggaggccggggcgactttaacgacccaagattggaggctgctgatctcttggagcaccccaggtgccccagggttttgccatgtctctggccacagcgtagacgggtggcggccaactatttctgttggaccgtttggggagagcacacggacggaggtggccggctaaggctgtgtctttcaaaaatgggtgtgttacgaaaagggctggggtaggcattctgggggtccggggcatcttcgagggacggtggccctatttac

SEQ ID NO: 599451 - DNA, 443 bp, Homo sapiens
atttttcatgctttttttttgtttgtttgtttcttgctgtatttaagcatctccacagaagatatttagaagcaggtagagataaaatttaaactaatcaatactgttttttccctttgaactctttaatgcacaatttgatttctttagacagtttactcattgttattggaagtgactaatagtaactttgcttcaatttattttgatgtatcttatacacaagtataggaaggcttttgggtggtttttaagaaacatgggctgtagattcccataattgctttcctgaattattaagcgtgagctttcattacatctttgtaccggaacttttgcttttgctgtggaacagattcagggacatcgtctaatttttttttttttttttttagataactgctcaagaagttaccttgttttgatttagcagtaaaaaaaaa

SEQ ID NO: 599452 - DNA, 967 bp, Homo sapiens
  misc_feature (318)..(318): n is a, c, g, or t
  misc_feature (607)..(607): n is a, c, g, or t
gcagtaggcagggctggccgttctccgaggtatggcccaaggcgttccgctagaccgaccgttgccgggacctgcccagcgtcctcccgtgcctccttccgggacaagcctggcacaccactcgctgtgatgacgacgctggctgattggccctgggccggcccattcttcaccacgcctgacagaagctggaggggtgctggagacgccattagagctcgatgcggagcgagctggttgctctgggcgttctggcgtcgctgccgtaccctctagaaaagctcgaagggcaacgggtcccagtggtagtgcccactntatggtggggcctaccctaggatgtccacgtcggcggcattggcatccatggccatgcgacgtatttcggagaagcccggagtttcgcttgcaagattccacattccgaggtgaccgacacagtgtctcgctccatcctcatcttagcttccaggttcagcctaagcctgtactaacctgcttggtggacttggcaaaagacttggctctgtcgggaaaggagagacggggctccatcacgcctgttaccagaggatccccgagagccaagcagctctggacatcaccngccctggaactggggccacagccctgggcacgagatttgctctgactttattatatggcatgaaatctctggtttatctcgggataatcaggtcgccggtgtcgtcaaagttcgaactgctaaagtgtgtgataatatatttgacatgttacatttcaagaaaggttatgttggtactacacaggaggaaccacacagaaagggcagcacttggacacaatgtagcctggctctaactacaccaaagacgcgagacaaacaggaaaacctcaactcattcgaacagtcacaaacgacgaacgaaagccgaacgcaacaggtcagaggggagcaccgaagtccaaccaggccaccgtacac

SEQ ID NO: 599453 - DNA, 288 bp, Homo sapiens
tctagagcatccgcttcaacggaactttgctgaacttacccaaaagtcattcagcagcatacgtttaattttcatgtaattgcatggttttgaggattttcttagtcttgacttctatttatattgcactgtggtccaagagcatgtttggtatgattttggttcgtttgcatttgctaaggattgttttatatccaattatgtgattgctttcggagtatgttccatgtggagataagaagaatgtatattcagttgttttaaggtggaaagttccgttgaagccgt

SEQ ID NO: 599454 - DNA, 179 bp, Homo sapiens
ttggtgattagaggatctccgctggccaatggatgagcggaagtgagtcaaatcgagaagaagtatgacgaggagctggaggagcggtggtggagtggatcatagtgcagtgtggcctgatgtgggccgccagaccgtgggcgcttgggcttccaggtctggctgaagaatggcgtgtt

SEQ ID NO: 599455 - DNA, 101 bp, Homo sapiens
acttgctgatgtttgaaatgttatgcacagaattgctaatatattgtatcacattccttaggaggactttggtacttggttcatgcattgatggttttttt

SEQ ID NO: 599456 - DNA, 81 bp, Homo sapiens
atgctttacactctacaagtatggtttaaaggcacaaggtcatggcctttgtcatagcaagttgaatgtgcaattgacata

SEQ ID NO: 599457 - DNA, 195 bp, Homo sapiens
tgaacatcgtgtcagtgagagatgcactgaagacagaattcaaagcaaatgctgagaagacttctttactttcacaatttttacgttgctgccagaagtcttctcagcatttgcttttgaattctgtctccggggggtcccggagctcaattcggaattctgggccttggctgttccaaggcgccaaggcgtgtt

SEQ ID NO: 599458 - DNA, 489 bp, Homo sapiens
aagtcgtaacctgctgatggatcatgtgataaacaggaagtctaaatgggagctatcatagcatcaactcaatctgttttctttcattgatgacggtgtctcgctctgtcgatgcacggctgaggtgcattggcgcaatcagtggctcactgaagcctctctgtggctcacgtgatcctcccaccttagcctcccaaacacctgggactgccgtgcaggcccaatagtgcctgcctagattcggtaattagatcgtagagacagggtctcgcgattttgcccagtgctggtctcaaactcctggagtcaagcggccctcccgccttggattgccccagagtgctggcccgttacgctagtaagcgcactgcgcctggcttccattctttaggattcccattcagactgtgtgtggcaggtacatagagaacaacaatggacttgctaatttctcaggtaacctttgttgaccctcatattaggtctcct

SEQ ID NO: 599459 - DNA, 995 bp, Homo sapiens
ggtcatgacctgtgcatatgccccttctgggaagtatgtggcctgcgtctggcctggataacatagtgtccgtccatgtacaatctgagaatacttcgtgaggggaacgtgctgcgtgattcgtgagctgaacatggatacagctagggttaccctgttcgcgtgctgcccgagttccatggatgacaattagaagaatcgtcaacgctagcgtctggagacacccacggtggtgcccttgtgcgggtacaatctgaagaatcggcccacgaagatgcatcacgttataccgggagcgacactgggggatgtcctgagccgtttctctggcttctctgacgccaggacatgggcgtctctgggtgcttgtgatgccttccagcacaaaactactggggatgtggggatacaggcaattgtcgcccagtgaaggaatcttcatgtggctcaacagaagtctggacatacaaattgccgataagctggcttttccaaatggcaaatgcattttgcacacatgggcctcaagagggaactgcaacactagaaggccagaaagagcgtgtgcggtgcttgacccctgagagcctccatggaactgactccccagtgacaaaattcatcttagcggggatcaccctcttgataatcttttcgtccatgaagcggtgcgcccaccgtcggttggtgggtccgccgactggcatacatgcagaggtcatggcaattgacgtcgaagcagaccgggcagggtggccggggggggcatgacggaccgcgttagctggctcgtgttgactggcgcgaggactgtcggtgccggaacggaccgggataagtgcatcagaacggaactagcccaacagggggggccgtaaagggaaaacatcgctgtggggtacagtgaagaacgttccaaggacaggggacacaacccccgagacaaggggggggcgcgcaatggaagagccaccagaaacggggacaagggtgca

SEQ ID NO: 599460 - DNA, 226 bp, Homo sapiens
actgcggctgaccacctctgctcttcgagactcgcccgccggtaaccacgactactctctgccggatggaaagcagaagcaggacctgctgtaagaggacgactcgccgggaggagtctgtctccattttgacaatgataaggtgtcagtggagttctgctcggcgtgcgcccggaaggcgtcgtcaccttctaaaagtgtagggtcaagtaatctgctctttatc

SEQ ID NO: 599461 - DNA, 131 bp, Homo sapiens
agaggaccccgtgccgatcttgccatcttcagaactgtcccaattggcacacatcacaggaatcaacacacgtgaaacaccaacatcctttaaacttacgccgcttatgtattacacataaagttcctgtc

SEQ ID NO: 599462 - DNA, 349 bp, Homo sapiens
ttttttttccaaggaaaaagtggcaatttaataaggatccataaaacgttgtactttcgaaaacaactttcgaagcatggtcttcaacaggcacattccattagggaaacctttagagccacgaacttggtggttaaacccagaattacaggcctattaagttccaaattaaaggttaaaaaaaccaaaaaccaaccaaccaaaaaccccttaaaccccacaaaaccccaaaaccaaccaacctattcctggctttcatcccccatttttaaaccacagtttttcctcaaatcaatgctcggcgggaacaccggaaattggtccaagcgggcggcaaattaatagtagt

SEQ ID NO: 599463 - DNA, 420 bp, Homo sapiens
  misc_feature (6)..(6): n is a, c, g, or t
  misc_feature (91)..(91): n is a, c, g, or t
  misc_feature (131)..(131): n is a, c, g, or t
  misc_feature (269)..(269): n is a, c, g, or t
  misc_feature (310)..(310): n is a, c, g, or t
  misc_feature (381)..(381): n is a, c, g, or t
  misc_feature (386)..(386): n is a, c, g, or t
atccancccctaaaccacctgaaaaatcctgccccaatgcccttttccagggtgtgtatccttcagtaaataatatgagccttatatatantgaaagccttacctttgcacctaggtacctgcgataaganctttcccatgtgctggcccatgttcagtggttcatgtctgtaatatcagaactttgggaggccaaggcaggtggatcacccgaggtcaggagctcgagaccagcccggccaacatggtgaaaccccgtctccagtacnaaaacaaaaattagctgggtgtggtggcacacgcccgcagncccagccactcaggaggctgagacaggagaaacgcttgaacccgggaggcagaggttgtggtgagccgagntcatnccactacactccagtctgggtgacagagtgagac

SEQ ID NO: 599464 - DNA, 889 bp, Homo sapiens
  misc_feature (294)..(294): n is a, c, g, or t
  misc_feature (318)..(318): n is a, c, g, or t
  misc_feature (413)..(414): n is a, c, g, or t
  misc_feature (474)..(474): n is a, c, g, or t
ctggagaaggtggaaaacagtgtgatcatgtgtcctggagatccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccagtgtcttcaaggtatgccgggagaaagaggaattgcaggaactcctggccccaagggtgacagaggtggcataggaganaaaggtgctgaaggcagctggaantgatggtgcaagaggtcttccaggtcctttgggccctccaggtccggcagtcctactggagaaaagggtgaacctggtcctcgaggtttagttgnncctcctggctcccggggcaatcctggttctcgaggtgaaaatgggccaactggagctgtnggttttgccggaccccagggtcctagacggacagcctggagtaaacaggtgaacctggcagagccaggacagaagggagatgctggttctcctggaccacaaggatccagcaggatccctggccctcatggtcctaatgcgtgtcctggacttaaaggtggtcgaggaacccaagggtccgcctggtggctacagggatttcctgggttctgcgggccgacgttggacctcgagggccctgctggcagctccgggaccttgcgggaccgccttatgggaaccccggacaggagggacctccaggtcttcgttggggcccctggctctcatggcgtgttggagatgaggaccagtgtatccctggtgtgccggagactagagggccgtgataacatggcacctgtcagtagtccct

SEQ ID NO: 599465 - DNA, 467 bp, Homo sapiens
catatatctcaggtgataggtgaaaccacaagtttgccttgaaaagtgcgttgataccaatagccatagcgagcaagtacgagctgtgttccaaagctcttcctgttagcacttcatgtgtatacagttaaggatagccaaagacagccaggcaccatggctcatgcctgtaatccaaaactttggaaggctaaggtggcaggatcacttgagcccagtagttcaagccctgcctgggcaacatagcaacgccctgtgctcacaaaaaaatagaaattagaagctagccaggcatggtggtgcctgccagtagtcccagctatttgggagatgtgaagcaggaggatctagtgaggctaggtgttggaggctgcagttatctatgttcactgcactgcactccagcttaggtaacacaaaaagaccctgtgtccaaaaaaccgaacgcaacgcacagcactcgagac

SEQ ID NO: 599466 - DNA, 281 bp, Homo sapiens
catgcgtgggggtgatgtagggacggggtttctgagcgtgacatgtcctttctggttgttagtgatccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctcagatggaaatgcagaa

SEQ ID NO: 599467 - DNA, 293 bp, Homo sapiens
tcaagactgccctgagccgtatcgtcggccatctggacctgagcaccgaagaaatgcgttcggtaatgcgtgaaatcatgaccggccaatgtaccgatgcgcagattggtgccttcatgatggccatgcgcatgaaaagcgaaagcatcgacgagatcgtcggtgcggtatcggtaatgcgcgagctggcggaccgggtcgagcttaaaaccctggatggcgtagtggatgtagtgggcactggcggagacggggcgaacatcttcaacgtctccacggcttcctcctttgtg

SEQ ID NO: 599468 - DNA, 853 bp, Homo sapiens
  misc_feature (6)..(6): n is a, c, g, or t
  misc_feature (82)..(82): n is a, c, g, or t
  misc_feature (111)..(111): n is a, c, g, or t
  misc_feature (266)..(266): n is a, c, g, or t
  misc_feature (299)..(299): n is a, c, g, or t
  misc_feature (317)..(317): n is a, c, g, or t
  misc_feature (358)..(358): n is a, c, g, or t
  misc_feature (381)..(381): n is a, c, g, or t
  misc_feature (476)..(476): n is a, c, g, or t
  misc_feature (498)..(498): n is a, c, g, or t
  misc_feature (537)..(537): n is a, c, g, or t
  misc_feature (552)..(552): n is a, c, g, or t
  misc_feature (558)..(558): n is a, c, g, or t
  misc_feature (567)..(567): n is a, c, g, or t
  misc_feature (608)..(608): n is a, c, g, or t
aacggnttaggccaccaagagttaaacaacttttacgtttctgtttttccttttctttctcttcctattatgatgtcaactnttttactgtggggttaagattcatatganaatcaattctctgttaccatgttatctagttctcaattacaaagaaaatgtgttgtatgactttgttttattaattcccaaaccgtaactttcagattggttaaacagccatgaatgtgagggctatgttattgataattgtgttatctgaagcnaaataaaccttcacttaacagggacaatgttgntaactggcaggggtaaancataaatctgccagttactcatgtgtaacaagacaaaaggngggtacatatcttgttccctccngcctctactatcctgccctacttgggaggctccctactctcttctgacatacggtggaacttctccttccggcctccctaggggtgggggggtcngtggggtatggccccctagggngccctggcccgggggatagtgccggccctgccttgggcnctccgtctccatgcnctctcnacctcatcngtcagggcgtcttcatacgggtgtgggtgtggaccgggacnggtgttacggcggtgcggccaaaacacgcgggctctcatcttggtggtttcagcataggctcgtggaccccacaggaactcatagcatggaggatcactgttgcacacctgccggtaaaccacgtacttatcttgcaccaaatcttcagtaatgatcttccgagcatccccatagattgaatgcaggatcccatcatatatccccaacagacccaggaactcccagacctcctcttcagtggcac

SEQ ID NO: 599469 - DNA, 213 bp, Homo sapiens
ggaaatcctgtagttgtatttggttgaactgaaatatttgactcaaaatagttaagactcattgtcatttgtgatcttggcattattgtggacaagttgacatattagggctctttgctttctggtaagcttagcttttaagatgcatttgcccttgtcctgtctttaactagatatacatgcttatattggtggggggtttcacagactata

SEQ ID NO: 599470 - DNA, 184 bp, Homo sapiens
attgtagcgagatttgtctatcgtagtggcagcttagcatctggaagtcccgccacttatgatcgattgccctgcttattggggctattttcccagactacttcttgatggtctctttccccgtggacacgcttactctccccgttcctggtcagcctttggttctctaggttttctcgctctc

SEQ ID NO: 599471 - DNA, 658 bp, Homo sapiens
cagatcataggttcccagtaatgcaccagtatgcgtatattgttagctggcaacactttgtgtcctcattttccagtaacttggcgatcatatcgtgtgagagttcatttccagtactagtagtatccctgatcagcagcaataatatccgttgacattgcacaggtatatcatcagcagcacacatctggacagcttctcacagccctgaatgttagacatgcctgcgcgtttcttcataggctctgtcacggtgctcacttggtccacgtggaagtcctcttcctcggtgtccttgacttcaaagggtctctcccattagcctttaaacaatatgtaattcctcagagcaaaaactgtgtctctgtcaagccctttgtccaaatcctcacttttcccttgagtacctttctccacgtaatcgttgatctgtttcgtggcctcctcggtgtccccgaagttcacagtgaaggcttgtgagtggtacaactttttagcttcctccatcaatttatccccaatcttcaggccctctctgaggaacaggccaattccggtggtcagctgcagctgtctgtctgtctggttgagggtacggaggagttcgtggaagccttcatgtatctgagcctgcataatctcagtgagtatgaaactg

SEQ ID NO: 599472 - DNA, 478 bp, Homo sapiens
agcgggtcggtgccagggccctggccctcactgtccccttgcggtcccctgtgggcctgctggcgcggcggggggcgaggagcgggcgccctgcccttcttgtgcccgctggactccggggcagcccccatcctgtgcgcgcagggacgcgagcagcctgcgcccagaaacgttctgccagctggacggcccgataggcctaatttgccgcagacgggctcgccttgaacctactcattacccccacgatcgcgccttccactcatcggcccagaagacggaaggactgggaacccgaggaatggaaggcacctccggaagcctgggatttaacttcattgcgagtcccgacgggcaataaaccatgtaatgggcagcgaaacggggtgacataacccatggtttccacggaaattcccgcaacgttgggcgccacacaggcaaataacagaaacgctatgttttcgcaacactcggc

SEQ ID NO: 599473 - DNA, 138 bp, Homo sapiens
  misc_feature (29)..(29): n is a, c, g, or t
  misc_feature (51)..(51): n is a, c, g, or t
  misc_feature (92)..(92): n is a, c, g, or t
  misc_feature (113)..(113): n is a, c, g, or t
acccaggttgtatccaatttccagccagnttagttcctgtaacagaacaantgagtctgggatgaagtcctcaaagtacttcaaatggtaantgttttgtttttgtaatagcntaacaaataaacctaggttttctac

SEQ ID NO: 599474 - DNA, 162 bp, Homo sapiens
gcggccgcctaactactactactgctcgaattcaagcttctaacgatgtacggggacatgcgcctgtggtcccagctactcaggaggcggaggttgcagtgagccaagatcgtgccactgcactccagcctggatggcagagtgagaccttgtctcaaaaaa

SEQ ID NO: 599475 - DNA, 971 bp, Homo sapiens
  misc_feature (596)..(596): n is a, c, g, or t
  misc_feature (607)..(607): n is a, c, g, or t
  misc_feature (635)..(635): n is a, c, g, or t
  misc_feature (645)..(645): n is a, c, g, or t
  misc_feature (687)..(687): n is a, c, g, or t
  misc_feature (695)..(695): n is a, c, g, or t
  misc_feature (699)..(700): n is a, c, g, or t
  misc_feature (706)..(706): n is a, c, g, or t
  misc_feature (831)..(831): n is a, c, g, or t
  misc_feature (838)..(838): n is a, c, g, or t
  misc_feature (925)..(926): n is a, c, g, or t
tttgttcatgtctttcttttttggtttttcttgtttgtggcttgttgtttgattcagggttctcattccttttgctctttcttgttgtgtcctttcttgtatttgtcatcatttatgtaccttttgtcttcttcttctctcttcatcttatgttatccctattgtttttattgttcctggcttcttttaacttcagtttcctgtgattatgttgtgctaatatttgtttctgtgcttggtatccgtcatgtattgctggtagtaggtctgcttctgtctaggtctgctggctacatctttttggtacactctggtctgttcccatgtgctagggttgcagcagttatgtgttgttgtgtcttagggtgttaggcttttgagcttgtacgcctgctgttgtgtacagtatgatatattccttgctagtacccaagtctccaggtctgtccttatggggatctatgtttggggcggccggctagtcagggagcctgggtttagtaggccctcgcctaggtgatggcagtgtctaagggtgtgtcctggggctaccctagcggttatgtgcttagtatttggtcacctagccgtcatcntgggcttttcntactgtgtcttgttacaaggcctcagcnaatccacagnactctctctccttccttccacctgtcagcttctctgcttctnagataaanaccnnttgtgnaacaccaacacttaacttcagaaagacatgcattatgtggtgtaatcaaacccgatgctttcagatgacctacttacatcttcaatgtggataagataaagaacaaaacacatgcatctaactgnttgcccntccagttgacttttaaatgtaagaatggaattccaaacacttaacacattcagctatatgacagaaagtaaatctatggatatggtnntttgtgaatgatcttttaaataaaagaaaaccttacgtaatattt

SEQ ID NO: 599476 - DNA, 1448 bp, Homo sapiens
ggacgacgacgtggggaccgtccggcttcggagcgggacgtgttcgttgtgccacgcgacctaccacacacgacgacacttacaactactgggtgactgtatgagacacacggcaacgacacgacttttacttacttgaacgttgttcccatgtgccaccacctgttgaaacacgggacggcaacgcacaacgaacctgggccaaactctccagtgtgtctcttttgggcggaacgacatggtcaaggcccctgtgactacctcgttacacatgccgccacactaacgacaccaacacgtgcactacacctcctgtgggacgacggactaccacctgactgcgacgtactttggacgaactcccacatgacacgtaccactccccttggaagcaacacacactgactctttggctcgggcacttacacgacacggaccggacacgacacacgcggccagaccgcttacactacgccttaactctacacaacacacacgcctacctaaagtgacgtaactaccttgggggccacgtgtacttactttaattacccgacaccacccacgacacgtgtcctgcactggacccttcatttgtatggatggtaacccaaagtccctttgtacactcgcactccttcaataaccaccccagccatttcacggcattcagtggaccattgacctggaccagaaaacttacttagtggtacgggcgaccagatcctgtgatctttacaaatagcttacacgaacctggtgacttctgttgggttttcaagcacttggaacattatttgttttccacggctccatgtcgggacagatttctcaccacttcatggttcaaacttcccacaagttgtcacggttaacacatgggggtaattacaccgtgggtgtacgcccaccattattcaacaggacttaattggacatgaggcaacctatacgaacacgggtcacatgtggttcccaccttatatcaacacaacaaggaatgagatgacagtgggccacataccgttcaacagaacccgtataccggggggcagacatatggagccagacaacaacccgtcagaagaccattatactacactgcaacctgtgggcactactcgtgagcacaactactctatcgaccccaccatcaagcgggagtgcagaaacttgcgcccaccgacgagcgaggtacaagaaccacaccgccacaagacttccaaccggggggcattaagagcagagcacaagcccacacaagtagcacacctcaaacaggcgcgagcggcacgacaaccaaacataaaagcagaagccatagcgcaacaagagaagcgacgaatacatatagaacccaaaacgtaataacacctagagtatacacactgggggtatcaccaccacacaccaccgactcgatgggagacatccacacgtaccagcaa

SEQ ID NO: 599477 - DNA, 429 bp, Homo sapiens
  misc_feature (9)..(9): n is a, c, g, or t
  misc_feature (13)..(13): n is a, c, g, or t
  misc_feature (83)..(83): n is a, c, g, or t
  misc_feature (213)..(213): n is a, c, g, or t
  misc_feature (240)..(240): n is a, c, g, or t
  misc_feature (291)..(291): n is a, c, g, or t
  misc_feature (299)..(299): n is a, c, g, or t
  misc_feature (320)..(320): n is a, c, g, or t
  misc_feature (332)..(332): n is a, c, g, or t
  misc_feature (380)..(380): n is a, c, g, or t
  misc_feature (385)..(385): n is a, c, g, or t
  misc_feature (419)..(419): n is a, c, g, or t
gctgaagtnggangcagaatttaagagtcataaactagcatatatagcagaaaaaatatctaagcagcaaaatgtttgagatnccacatgactacttttggctatgtacagcaaaatgagagaaaaacgatttaaagacagaatttataattaaaagagaagcagaacagaaagatttggaaaactctcagcttgaccatgtaaaaaatacanaagcatgttggggagagaatactaagngtgtgaccaagagactgctaaagagactaatatgggtagatggaagccagnttctattncagaggcctttggaggcaagnctaggatcttgnaggggcaaggtttctagaggaggtacccctagggacttggagcctttngcttnccctgtgccaccttggggactctggtgcttgccnttctgggagc

SEQ ID NO: 599478 - DNA, 864 bp, Homo sapiens
ttttgtttttagtagagacggggtttcaccatgttggtcaggctggtcttgaactcctgacctcaagtgatccacccacctcggcctcccaaagtgctgggattataggtgtgagccactgcacctggccttttttttttttttggttttctggccagttccagatattatggtttttctcttaccccaatttacattacggggtttggtaccacactcactaagggcccaaactcattggaagatacaaaaccgtacattgcaggcgggttggctcggggtaagctcaagggcgtgattggctctcaccgtgctcatagatagtgtatggtgcagccgtgaaacgtggcctcctataaagggaaagcggggtctcagtctctctctgtgaaaaagtgtgacattgtacaacagttaatctcgaataatgtggtttggagagacggctacagtggtttaagggttgggcctataagccttcagttaactgtggctcattttggggtgacctttggtggtcaccacctgtgtacccttaaccgtgacgggaattaacccttacggcctttttgggtggggcgcaagaacagcaacacccgggtgtgttggctgactgttaatccctaagtggggtcctaaagggacaaggggttaatgcgcgacgaaagacaccacaaaacccccaggattgcattgcttttgggtgccataatttttgggcaaaacaaagcacaaacttttcattctcggtcccttttaaaacaaatttttggcaggacaattaacccctccccctgtggggggtcaaaacacgttggaagccaaatttcggcgcgcgtcagaattgcaatttcgccacaacat

SEQ ID NO: 599479 - DNA, 449 bp, Homo sapiens
  misc_feature (15)..(15): n is a, c, g, or t
  misc_feature (45)..(45): n is a, c, g, or t
  misc_feature (326)..(326): n is a, c, g, or t
  misc_feature (401)..(401): n is a, c, g, or t
  misc_feature (405)..(405): n is a, c, g, or t
cccaaccaaattggntcaaaccagttattgccaaggttccccaangggcatcctggtcatcccttcaccccgaatcttcacttccagtgaacttgccagggaggcagagctggtatagctccctttgtgtgagcacaaagagtcaccaaaatggaactttgctaactccagcagttcgttatggcaaacacctccggcggcagccagtacaattcttggtcccttgtagtgtgtggttatgtaatccactaggtccttacgatttatagatttgatattttcagttggtcccagaattgtccgtccaagtgcagtattttgatagntgtcgcatgaagataatcaaaaacaacttcttgcaagttggtttcaacttcctgcatctctctcaggattactcncccncacgctcaatctctgcttctcccagtgtgctgttctgaattatg

SEQ ID NO: 599480 - DNA, 149 bp, Homo sapiens
  misc_feature (99)..(99): n is a, c, g, or t
  misc_feature (130)..(130): n is a, c, g, or t
actcaacacgcatctcagtgtctcatgatggagtgggtgtctgtatgtatcttatgaggaagtgagaggccagtcacatctgaaatccgtgactacggnatctacagacacagttggaaatgataggacncttcctttagagcctatga

SEQ ID NO: 599481 - DNA, 292 bp, Homo sapiens
aaatatgcttgtatacttacgctgttaatgatgatagcagcgatgatgcctgtgaaaaagcctgctttagctcaagaaacgtaagggagacaaatgtagcaagcagaagagcgaacgacagactagggcaagatttggccagactggaagtctaacacttaaataagcattctcttggtcaagtaagaaactgcagttgtggtgggtattaccctacaattaccatttgtattacatattaaattaaactcagcattaaatatgcttggctgatttacgccggtgatgatga

SEQ ID NO: 599482 - DNA, 437 bp, Homo sapiens
agggacaagcattaagcacgcagccatgcaggtcacaacgcttagcctagccacacccccacgggaaacagagtggattagcctttccccataaacgaaaggttaactaagctctgctaaccccagggctggtcaatttcctgccaaccaccgcggtgacgctattaacccaaggcactaaaagccggtgtaaacagtgctgtaaatcaccccctccccaatcaagctcaaactcacctgaggtgtaaaaaactccactggacacaaaatcaactacgaccgcggctttaacatatctggacacgcagttgctaagaccccaactgggatgacatgccccgctatgcttagacctaaacctcaacagctaaatcaacgctaactgcttgtcagaacactacgagccacaccttataactgatacgacctggcggcgc

SEQ ID NO: 599483 - DNA, 227 bp, Homo sapiens
  misc_feature (18)..(18): n is a, c, g, or t
ggggggcccccccccccngttttttttccccctttagaaagccgggggggcgttcccccccccggttttttctttggccgggggggggggaactttttttccccggggaccccttttcccctttggccctttttgggggcccctttaaacccgttttttccaaaaaccgggggggggccgggccgggttttcccgggttttttttccccccggggccgggtttccca

SEQ ID NO: 599484 - DNA, 191 bp, Homo sapiens
  misc_feature (60)..(60): n is a, c, g, or t
  misc_feature (63)..(63): n is a, c, g, or t
  misc_feature (66)..(66): n is a, c, g, or t
aaccacctttctctgacttgcattgagcttttggtatcctcttttaatatttcattctgnagnagnctgtatttatgtgtttgggttattaagaagtggccagcactttgggaggccaaagtgggtgaattgctttacccaggattctaaagcagctggcaacatgtcgggaccccgtctctacaaaaaaa

SEQ ID NO: 599485 - DNA, 132 bp, Homo sapiens
ctgactacagcgcagcgcgaggcgccgttcgactacggcctgttgatctactcgaacggccacatatctgactcgccgcgcaaggtgcttctacgtgcaccgactggtcgcgcggcgacaccaccatgtccg

SEQ ID NO: 599486 - DNA, 140 bp, Homo sapiens
aagtattcggcctatccatacctgttctatagttaagactgtttttaccaccatgcattatgaacagattctgagcacatgttattattgagcaggaggatgggcaggaatttgttgttccatcccacttggatcctgca

SEQ ID NO: 599487 - DNA, 517 bp, Homo sapiens
cagcagtgatccgtctcgtgtcttgtagagtgatctctgacggagcctgtctgtgcatagtgcatctgcatttatctcacagtgtgctgcagagaccaacatcctctgacatgtgaccccattcagatattagacattggggttgcctgagcctgtacagagatgttcccacatacatctctacatgtattctcgcgaatcttactcttttgctgagactatagggaccatgtgactctatagtaatggggagatgatgtccactctcggaataccgtgagacacatcaggaagcttcttcacactattgcctacctagagagaagagtgactctacacacctcctacttcgggccctcaagaccatagtcacgtacgtgagagaactccggatatcgatttgctattatccccaaccatgttatccagactctctcttacatgactataacattttgctggctccgagaactctcgcacacacaccgcagtgtttctacgcctgtttctgacaggg

SEQ ID NO: 599488 - DNA, 389 bp, Homo sapiens
ggtctgccaacgccaaccgctccgctgtgcgcacactgtgctgcaggctctcggctgtagcgctgtgtggatctaggatacggatttaacaagtgtgagctctgggcctccctctggtggccgctgtggttggccaatgcccagggcaagccctctttccataccgtgtcggatgaactcggcaactatgtgaacaaacgggataccacgtggcagggcgggcacaacttctacaacggggacatgagctacttggagaggcgttgtggaaccttgctgggtgggcccaagccaccccagagtggtatgtgtaccgaggacccgaaactgtctggaagcttcgatgcacgggaacaggcacagtgcgccaccctcgagtccgcggccgg

SEQ ID NO: 599489 - DNA, 313 bp, Homo sapiens
tacttacagttactagaagacttctaataaaaataatctacttgcacatactatgtaaaagggtggaggttatgcttgtgatatttagttttcctcaataatgtctttcttgtactgttcaagaactaattaatgtttccacggcaaatttgttttcataatgccgtattgcgaaacaatttgcttggcttctaaagttttctgaataccctttcatagtttctctgcgttgcagtctgtaggtttccttgttatgactcagtgccatgaatcaataaacccaggtgatctatgtttcatgtgcgatcagtaa

SEQ ID NO: 599490 - DNA, 393 bp, Homo sapiens
tacttctgatccttacctttgttgcagctgctgtgctgccccttgatgatgatgacaagatcgttgggggctacatcgtgtgaggagaatctgtcccctaccaggtgtccttgcaatctggctaccaacctctctgcgggggatcccctcatcagacgaacaagggggtggtgttcagcaggtcactgcttaacaagctacccggcatcccacggctgacgaccaggtgtcagaagcacccaacaacagaaactcccctggaacggggacatcggcaacacagccactcaaagtgcgggccaaatacactccccgacaaccccaaaaaaacaacaaacccggcatacccgcgcaaaaatgacaaccctccggtgcgacaagccccccacccca

SEQ ID NO: 599491 - DNA, 235 bp, Homo sapiens
caaggctgttgtcatcctgccacttccctgaatgctcattgggtcatctctgtcatggacgcaagactgttgccaatatgatcaaggggaaaactcctgaggagattcgcaagaccttcaatatcaaaaatgactttccctctttttttgtaaagcaatgtctgcctagtttattgtccagttaactttagtgaccttttaaaagttggcattgtaaataaaacgggatgcggcc

SEQ ID NO: 599492 - DNA, 236 bp, Homo sapiens
aggatcccgctgtgatatgtgggatggaccccgttgcccaccctggtggacggctttatttctaggccaacagagaagaccgtgttcccatttttatgatttctggcgtctgtgattggcatgctgcttaacgtggcagagttgtgctaccggctgctgaaagtgtgttttcggagatcaaagagagcacagacgcaaaaaaaatcaccccaatcaggcccggaagggagccgaag

SEQ ID NO: 599493 - DNA, 884 bp, Homo sapiens
ggtttgctagacgccagcgccgaggaaaaaccgtgtactattagccactggttcaaccccaccgtgtctgcgacattgccgctcgacggcgagcccttgggacggtctcctttgagctgtttgcagacacaggtcccaatagacatgcagaaccattgttcgtgctcgtgagcactgtgcagagaacatggattgctggttatacacgggttcctgctttcacagaatctcattccagggtctcatgtgtcacggcatggtgacgttcacaggccataatggcactggtggcaagtccatctatggggagaaatttgaaggatgagaaactctcagtcgctaaagcatacgggtcctggcatcttgtccatgtgctgatgctggaatgccaactagcaaatggttcccagttttccatctgcactgcccagactgagtgtgtctggatggcaagcatgtggtgtgggcacagtgaacgcgatggcatgcaatattgtggacgaccatgtagcgcttgtggtccaggaatggcaagagcagcaacgtaccgatcaatcatttgctgagctgtggactacctcgagatcaagtttgactgctgtatcagtcttaaccaagcagaattaatgcctttccggtaggcttcaggagagcaagcgctccaaccccattttgtgcggagaatcctagaatgtttgttgctctgcgctgccgttcccatatgggtccacgctgccttgttccctccagggctagtggattgcgcgcgtacgtcatgattattgacataggctaaatattcacgcacacatggctaaaacgtttcggcggcccaagctctacacctgggggcgccgaaagcaccgccaaaacccaacgcgaca

SEQ ID NO: 599494 - DNA, 144 bp, Homo sapiens
ggcccacgtgcgaagtgaatgatctggaggtgctgggcctctgtgttggaaggagtcgagactcaacagccaggcatttcaaaggcaggggccaggaagactggcaaacagatggcaagggatgcccctctttttcataaaact

SEQ ID NO: 599495 - DNA, 387 bp, Homo sapiens
cccggactttaaaaacgcaagaaaaacccagggtttggcgccccatgaaaaaaaacccccaccccttgttgggtagcccctccccccccccggggaaagggtggttttccccttacaaaagaaatccccccggggtgaaaagcaccaaaaaacaaattttgccccaccaaaattagcccgggtgggtggccctggtgttacaccaaaagagggtggggtgtccccccctaggggggttaaaaacccccccaacccaagggggggggttagggttccacccccataaaacccttttttttattttaaaaatccggggggaaagggtgccctccccaaatggccccttttttttttttcaacgggttcccccaaaaaaccttgggcccc

SEQ ID NO: 599496 - DNA, 720 bp, Homo sapiens
  misc_feature (461)..(461): n is a, c, g, or t
tctaaatttattgtctttttttttttaaatcaaaggccccttacgggccctgctcccatgaattacccgtgaccgggaaaaagggaaaggaaccaccggcacaggaaggggtctccccaaaaattttccattttatacccagaactaaacagacaagcacagagtcactatcggcgggtaaaaatgttgcgcacgcttgggaaacgggtggagggaccctgtgtggggacaatggggagattgtttgtctaacaaaaattatcacaggctcccccacaaagtggggtcgcctgggggagacacttgggcctgcttcagcccaagaggattcaaaagatctcaaaaaccactctctgggaaaacggccaaaaacccggtcaagggagattgagaggggacgaccgagaaaaaaccttccacgggggtgtgggcgaggctcatgcttgggccaaactttgggngcatgcaagggattgtgcccctaccccccgtggtgggaaaatcccccccaaaggaccctctcccggttcgtgcgcaagagacaagggtggccaaccccgcgcaaaaccccccccaaagggcaacgagctgttgggagacactttgcccaggaaatgctctcccaatgtagaggggggtccaaaaaaggggcgcctaccaacaaagaggggcttttgaaccctaccaagggaaaaatatgcaccggcatgtagcccccga

SEQ ID NO: 599497 - DNA, 336 bp, Homo sapiens
  misc_feature (17)..(17): n is a, c, g, or t
  misc_feature (192)..(192): n is a, c, g, or t
  misc_feature (216)..(216): n is a, c, g, or t
  misc_feature (240)..(240): n is a, c, g, or t
  misc_feature (279)..(279): n is a, c, g, or t
caggagaatcgcttgancccaagagttccagagcagcctgggcaacatagtgagactccatcgctacgaaaaacaaaaaataaaaaaattagtttgctttggtggtacatgcctgtaatcccagctaaaggcctgaggtgagaggatgaagctgaggcaggaggattgcttgatccctggaagttgacgctncagtgagccgtgactgcaccactncaccgcagcctgggtgacagggtnagaccccacctcaaaaataaataaataaataaacaaatnacaatgttctcttcagtttaggggttgggtctttggcttgtactcatcagggtcact

SEQ ID NO: 599498 - DNA, 1010 bp, Homo sapiens
ttgggtgccctgccggatggggtgaaactaagtgttacgttcaccccaaggcctcggactggtgcgttccccccctatcatgaaggttctgttgtaaagacttcctggtggaatcttgcacctaggatgtcgctcttctccctcttctgacatccgcacccgctggttaagtcttgttaagggaaaaagaagcttgggaagtctgtgcgagaggaatgatcctccgtccagcctagggagtcacgtcgcacttctacacctggagacactcgagtcccttgcgatactctcccagggtgccaacggttaccgacttggtgaaacaacggtcaagactccttagcttacagacgcccacgctctagagtagactttagacctaggaaaccaattatgagatggaaagtggaccctctagttcaagctgtgtccagaggtcacagccatctcagtgcacacctgcctcacgtcctccttatcatgtaccgtggaaaccccctctgatggcctcaaggcagtgcctgcaggccgaggcccttctgggggtttcctatcattgtccttcacaccagagctccaagcccactgctcctccaagactgtgttgtcttttctgcgaccaagagtattaacactactaagtctttcaccttaacttatgactcaggatttattcacgtcctgccacactctaggctcacaggaataaaatcaagtgcgtagacacagctggctgactactaaggcacctagcctctgtagatggtgatggcagctgtggggtgccgcacgcagcgtagcctgggtcatggcagtgcctcatgctgtgctgcacattgagccctttctcagtcagtggagtatacaagttgggcatgctgtctactgacactggccttcatgtaagcagctgtgggctgcgggcagaacaggagctcagagatgcagcatgaggcagcttagaaaaacgtggccatttgctgctaacattccctgttgcttgacgagta

SEQ ID NO: 599499 - DNA, 125 bp, Homo sapiens
cagcactaagggcgcgcgccccattgccccgaaggaggttgcaccacacatcgctcttaagaacggtcttgccccgctcatgtctgaagatcttcctccaagatgtcgacggtgcgttgtgccga

SEQ ID NO: 599500 - DNA, 563 bp, Homo sapiens
tcctgggatgatcccttaccaattcccggttaaaacccccccagctggggtccaagttgtcacgccttgtggtccccagagtgctgagattacaggcgtgagcccaccacgcccggcccagagatccacatctatatttataacaccatttatggatgaaaattaaacaggtgtccgggtgcggttactcatgcctgtggtccgagcacttgtggaggccgaggcaggcggattacttgaggtcaggacttcggagccagcctggccaacatggtgaaatcccatctctgctgaaaatacagaattagccgggtgtggtgtcacgcacctgtagtcccagttacttgaacctgggaggcggaggttgcagtgagccgagattgcaacactgccactccagcctgggtgacagagcaagagaccctgtctcaaaaaaaaaaaaaaaaaaaaattaaatgggtagtgacgttaagagatatatatcagcttctagtaaaagttttttttttttaaacctgctagctacatttacattatgtaaaaataaagggaataatcactga

SEQ ID NO: 599501 - DNA, 227 bp, Homo sapiens
  misc_feature (171)..(171): n is a, c, g, or t
  misc_feature (173)..(173): n is a, c, g, or t
  misc_feature (201)..(201): n is a, c, g, or t
  misc_feature (205)..(205): n is a, c, g, or t
agcgcgcagtgtcgactccccggtctatgccaggcgcatctcagataccagcattgccaccggtgggtagaacactaagtgggctcttggagtccctgattccagaacttgactcttggatgacatttctggacctgctctgggccagagaggagaccacttcccttaagngnacacagaggtctcactatattgcccagnctgntctcgaactcctgggctcaaac

SEQ ID NO: 599502 - DNA, 261 bp, Homo sapiens
  misc_feature (43)..(43): n is a, c, g, or t
  misc_feature (48)..(48): n is a, c, g, or t
ccaggttgataatgctgtcctgggcacacactttgtaaatggnatgtnatggtacagtcgcctctcagtatccatggggcattggttccaggcctcccttaggatgccaaactccatggatactcaaaccccttctataaaatggtgtagtatttgcatatatcctagacacatcctcctgtatgctttaaatcatctctagattacttaaaatacctaatacaatgtaaatgctctgtaaatagttgttatactatattg

SEQ ID NO: 599503 - DNA, 108 bp, Homo sapiens
aaaatctatgtacaaggaacttaaaaatgaagagtcagattgactatcataatacaggaacaaattggcacaaaatgttaaacattgttcccaacactggtgtaccga

SEQ ID NO: 599504 - DNA, 156 bp, Homo sapiens
cgatgtcgtattactgcaacttctactcccagactcaagcaatcctcccacctcaggctccagagtagctgggaccgcaaacgtcaacaccacacccagctaattttttgcatttttggtacagacggggttttgccatgtggcccaggctggtgt

SEQ ID NO: 599505 - DNA, 504 bp, Homo sapiens
atggattgtatgacgattgcgctggagccggacgttcacgatctgttgaccaggcctgtgagtaacaggtgagttgtgactcatcgctgatcgttgaatgtgagttccaattcgcttcgagtctctccacaagatgtatccttgaggtctttccgtcgggtactacaccgaaactacacgtgtaaccactaacagtgtcgagcctcctggacgtgactcggtttacatgaacttgccgcggataatgcctggataacatcggggactacgcattgcccttgaaacacaggtactctgttctgcagaaataagcataattcaattaggtataccatttagttgacacttggacagaagacaacggagaccaaggggtttagggggaaaattcagggagggcaggaacgcggcaatgtgcaatgataaaaaaatgttttggggtatagccaacatgcttgaggaatacaaaggtgagaaaggggataaagcgaatattaacgtgaa

SEQ ID NO: 599506 - DNA, 1219 bp, Homo sapiens
  misc_feature (70)..(70): n is a, c, g, or t
  misc_feature (199)..(199): n is a, c, g, or t
  misc_feature (204)..(204): n is a, c, g, or t
  misc_feature (206)..(207): n is a, c, g, or t
  misc_feature (211)..(211): n is a, c, g, or t
  misc_feature (222)..(222): n is a, c, g, or t
  misc_feature (226)..(227): n is a, c, g, or t
  misc_feature (241)..(241): n is a, c, g, or t
  misc_feature (244)..(244): n is a, c, g, or t
  misc_feature (248)..(248): n is a, c, g, or t
  misc_feature (270)..(270): n is a, c, g, or t
  misc_feature (293)..(293): n is a, c, g, or t
  misc_feature (298)..(298): n is a, c, g, or t
  misc_feature (303)..(303): n is a, c, g, or t
  misc_feature (310)..(310): n is a, c, g, or t
  misc_feature (336)..(336): n is a, c, g, or t
  misc_feature (1066)..(1066): n is a, c, g, or t
  misc_feature (1095)..(1096): n is a, c, g, or t
  misc_feature (1122)..(1122): n is a, c, g, or t
tacagtatctactgtgtacaagtatttgtgttagatgctgtgtgtgtgtgtgtacacttaattatcaggnaaatcctgtgaagtaagaatgatctcaggctgggcacggtctgttcactcattatgactattaagtctttgaacttttttttactttttttgagatggagtcttgctctgtcccccaggctggagtgantggcngnnctcngctcactgcanctcnncctcccaggttcangcnattntcctgcctcagccatcccgagntagctgggattacaggcacgcancaccntgccnggctaantttttgtatttttagtagagatgggntttcaccatgttggccaggatggtctcgatctcctgaccttgtgatccacccgccttggcctcccaaagtgaaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcatgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcgcgcctataatcccagcaccttggaaggccaatgagagtggatcagttgaggccaggagtttgagaccagcctggccaacatggtgaaatgccgtctctactaagaatacaaaaatgagccgggcacggtggcncgcacctgtgatcccaggtactccgaagnntgaggcaggataattgtttgaactcnggaggtggaggttgcagtgagccaaaatcatgccactgcactccagcctgggtgacaaagtgagtctctgtcccaaaaaaaaaatgaatcgtattaa

SEQ ID NO: 599507 - DNA, 711 bp, Homo sapiens
  misc_feature (70)..(70): n is a, c, g, or t
  misc_feature (199)..(199): n is a, c, g, or t
  misc_feature (204)..(204): n is a, c, g, or t
  misc_feature (206)..(207): n is a, c, g, or t
  misc_feature (211)..(211): n is a, c, g, or t
  misc_feature (222)..(222): n is a, c, g, or t
  misc_feature (226)..(227): n is a, c, g, or t
  misc_feature (241)..(241): n is a, c, g, or t
  misc_feature (244)..(244): n is a, c, g, or t
  misc_feature (248)..(248): n is a, c, g, or t
  misc_feature (270)..(270): n is a, c, g, or t
  misc_feature (293)..(293): n is a, c, g, or t
  misc_feature (298)..(298): n is a, c, g, or t
  misc_feature (303)..(303): n is a, c, g, or t
  misc_feature (310)..(310): n is a, c, g, or t
  misc_feature (336)..(336): n is a, c, g, or t
tacagtatctactgtgtacaagtatttgtgttagatgctgtgtgtgtgtgtgtacacttaattatcaggnaaatcctgtgaagtaagaatgatctcaggctgggcacggtctgttcactcattatgactattaagtctttgaacttttttttactttttttgagatggagtcttgctctgtcccccaggctggagtgantggcngnnctcngctcactgcanctcnncctcccaggttcangcnattntcctgcctcagccatcccgagntagctgggattacaggcacgcancaccntgccnggctaantttttgtatttttagtagagatgggntttcaccatgttggccaggatggtctcgatctcctgaccttgtgatccacccgccttggcctcccaaagtgaaaacttttctttaaaatagagatgggatcttgctgtattgcccaggctggtctcagactccttgccttaagcagtcctcccacctcagcctcctaaagtgctgggattacaagcgtgaagcattacatccaagtgaaacttcttgagatggttacataatgtctaaatctgctggtgtagaagttaataaagtgtagaactgaataaatattaaatattagatcaagtttctcatgtttatcttaacgtataacgatttatcttaaagcactgattttcactttgggctgggtaccgagctcg

SEQ ID NO: 599508 - DNA, 920 bp, Homo sapiens
  misc_feature (16)..(16): n is a, c, g, or t
  misc_feature (20)..(21): n is a, c, g, or t
  misc_feature (31)..(31): n is a, c, g, or t
  misc_feature (41)..(41): n is a, c, g, or t
  misc_feature (43)..(43): n is a, c, g, or t
  misc_feature (47)..(48): n is a, c, g, or t
  misc_feature (59)..(59): n is a, c, g, or t
  misc_feature (63)..(63): n is a, c, g, or t
  misc_feature (67)..(68): n is a, c, g, or t
  misc_feature (71)..(72): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (91)..(91): n is a, c, g, or t
  misc_feature (94)..(94): n is a, c, g, or t
  misc_feature (114)..(114): n is a, c, g, or t
  misc_feature (124)..(124): n is a, c, g, or t
  misc_feature (143)..(143): n is a, c, g, or t
  misc_feature (767)..(767): n is a, c, g, or t
  misc_feature (796)..(797): n is a, c, g, or t
  misc_feature (823)..(823): n is a, c, g, or t
ccccccctggtatttntggnncccgatcccnggacctctcntngggnnttgaatggggncccnttcnngtnnatatcangntnctgcactnccncccgggccacagagccaaancccgtttccnaaaaaaaactgccctcccncctgggtgaccgagtgagtctttgtttccaaaaaaaaaaaaaagaaaaaagaaaaaaagtcagttgctgggattacaagcgtgaagcattacatccaagtgaaacttcttgagatggttacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcatgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcgcgcctataatcccagcaccttggaaggccaatgagagtggatcagttgaggccaggagtttgagaccagcctggccaacatggtgaaatgccgtctctactaagaatacaaaaatgagccgggcacggtggcncgcacctgtgatcccaggtactccgaagnntgaggcaggataattgtttgaactcnggaggtggaggttgcagtgagccaaaatcatgccactgcactccagcctgggtgacaaagtgagtctctgtcccaaaaaaaaaatgaatcgtattaa

SEQ ID NO: 599509 - DNA, 1120 bp, Homo sapiens
  misc_feature (70)..(70): n is a, c, g, or t
  misc_feature (199)..(199): n is a, c, g, or t
  misc_feature (204)..(204): n is a, c, g, or t
  misc_feature (206)..(207): n is a, c, g, or t
  misc_feature (211)..(211): n is a, c, g, or t
  misc_feature (222)..(222): n is a, c, g, or t
  misc_feature (226)..(227): n is a, c, g, or t
  misc_feature (241)..(241): n is a, c, g, or t
  misc_feature (244)..(244): n is a, c, g, or t
  misc_feature (248)..(248): n is a, c, g, or t
  misc_feature (270)..(270): n is a, c, g, or t
  misc_feature (293)..(293): n is a, c, g, or t
  misc_feature (298)..(298): n is a, c, g, or t
  misc_feature (303)..(303): n is a, c, g, or t
  misc_feature (310)..(310): n is a, c, g, or t
  misc_feature (336)..(336): n is a, c, g, or t
  misc_feature (967)..(967): n is a, c, g, or t
  misc_feature (996)..(997): n is a, c, g, or t
  misc_feature (1023)..(1023): n is a, c, g, or t
tacagtatctactgtgtacaagtatttgtgttagatgctgtgtgtgtgtgtgtacacttaattatcaggnaaatcctgtgaagtaagaatgatctcaggctgggcacggtctgttcactcattatgactattaagtctttgaacttttttttactttttttgagatggagtcttgctctgtcccccaggctggagtgantggcngnnctcngctcactgcanctcnncctcccaggttcangcnattntcctgcctcagccatcccgagntagctgggattacaggcacgcancaccntgccnggctaantttttgtatttttagtagagatgggntttcaccatgttggccaggatggtctcgatctcctgaccttgtgatccacccgccttggcctcccaaagtgtgctgggattacaagcgtgaagcattacatccaagtgaaacttcttgagatggttacataatgtctaaatctgctggtgtagaagttaataaagtgtagaactgaataaatattaaatattagatcaagtttctcatgtttatcttaacgtataacgatttatcttaaagcactgattttcacaaaataacatcagtgtgaaattggaaaagaagccaaatattttatttcatgtatctgggaaatgaggtgctttagtcaactgaatctgcccaaaactaaaaagcattaattaaaaagtacttaactcagaaattataaaaataggagacatcaataaaatacattctacacagaatacgccaaccatacactactcttttttgataataaaaaatgtatttactgagccagttgtggtggctcgcgcctataatcccagcaccttggaaggccaatgagagtggatcagttgaggccaggagtttgagaccagcctggccaacatggtgaaatgccgtctctactaagaatacaaaaatgagccgggcacggtggcncgcacctgtgatcccaggtactccgaagnntgaggcaggataattgtttgaactcnggaggtggaggttgcagtgagccaaaatcatgccactgcactccagcctgggtgacaaagtgagtctctgtcccaaaaaaaaaatgaatcgtattaa

SEQ ID NO: 599510 - DNA, 318 bp, Homo sapiens
  misc_feature (47)..(47): n is a, c, g, or t
  misc_feature (82)..(82): n is a, c, g, or t
  misc_feature (210)..(210): n is a, c, g, or t
  misc_feature (219)..(220): n is a, c, g, or t
  misc_feature (227)..(227): n is a, c, g, or t
  misc_feature (231)..(231): n is a, c, g, or t
gtaaaagttagtggactgccaaagcctgggggttccaggttgcgggngctcaaggcccttctttaaagctgtggccactttntgggcacgatgggggctcccccactgccccatctgcccctcgggttgggggagtatcccaggcctctctgtgggacctgggcccctgacgggccttctcagcccgttttgaggacagacagttccccngaggtaggnnacatttncccncccccccagtggtctgcttggatttcctacagcccccgtgggcatggaccacctttattttatacaaaattaaaaacaagtttttac

SEQ ID NO: 599511 - DNA, 131 bp, Homo sapiens
cttgtgagaagctggcagctatgtgctcacctggatctactataccaggtgtggaggcccccagcagagcagggctgagaggcctggtgagcccctcccgctcaagacagaactgaggtgtggacacttta

SEQ ID NO: 599512 - DNA, 368 bp, Homo sapiens
tgccctggcgcaatatatatagtgtccgcaaggggagagatgatgagggagattataaccaagcatcatatagcaaggactaaccccatataccttctgcattcatgaatgaactagaattaactttgcaaggatagccaaagctaataccccctaatccagacgagctacctaagatcagcttagagagcacatcccgtctatgttgcacaatagctgggaagattctataggtagaggcgacgaaacctaccgagcctggtcatagctggttgctctctaggatatcttagttcaactttaaatttgcccacagaaccctctaaatccccttgtaaatttaactgttagtccaaagaggaacagct

SEQ ID NO: 599513 - DNA, 473 bp, Homo sapiens
  misc_feature (400)..(400): n is a, c, g, or t
gagctcggaccgacgctctctctgttggggcaagtaaacttcgtgccttatttctcgtctgtaacacgggcaattacagtagtacatacttcgttatagtgaggattaaatcggttaagtaccagtaaaacgtctagcagaagtgccaaacacacagcaagcattcacgtgttagctgttgtgtcattatgaccattcggattaacgcactccagttgtcgtgcgagttgcgcttggtaattagttctcaatcaccttgttcttcataccttcttccctggccgttaagctctgtgccatcttttagatgagaggcttgtcctgtctccctcagtgcccctaggcctgtgccctcacatttcacttccacagcatggagggaccacaacagggtcagaancaactacaggatcaagttcaactgcacacaactccctccaccatcctgtctctgtggagcccgtcacccccgt

SEQ ID NO: 599514 - DNA, 355 bp, Homo sapiens
tcccctcggggtctcatattgcatgtggcacttaggtccaggtctccagagggtgaaagctggagtcatgtcaatgtccgagcgagacagcacagccaacctagctagcaacattagtatttagtctgaacaatatatacttataagaattcagacaaagatacacaatctgaaacagcttcatggggtgacactctaacagtagtagcaatgtaaatagaatgaagattacttctctgctatctagatctgaactccttggcttctttcacttagtccaaggccccagctctaggacaagcccagttaaataaaagtgggctcaggagtctaagcagctatcacctaaaatatg

SEQ ID NO: 599515 - DNA, 199 bp, Homo sapiens
cagcttggacggagacattaagctctgttactgttcagagaagaatcgggctgtgctaagggcataattagcattgtgctcagaggagcaacacccattaggagtgagcagacaggcctgagctgagaaaaggacctggggggtagcgatgaatagcgaagtgccgatgaataacgaggtggcgatcactagcgagggt

SEQ ID NO: 599516 - DNA, 382 bp, Homo sapiens
  misc_feature (58)..(58): n is a, c, g, or t
  misc_feature (75)..(76): n is a, c, g, or t
  misc_feature (88)..(88): n is a, c, g, or t
cggccgcccagcttctcggccgccccatctcccttcgctcggtccgggtgcaggctgnaggcaggctcagcccannggatgctgcggncagtgcgcagcccgagaagagcgagcacgtaatgctcgtcgacactgcccttgcggtgatcctctgatgcagtcccagatccgttgatgtgcttcatcacccttggggtcctaggccgttgtgtccttagtttgagtgaacagggtcaaaacacggtcaggcaaacacgctcgataggactgcctcgtcaccaggccatgcatgcccacagtctttatgaacggggtggccggggttgtccactccagtctggatgcactggtccagcgtgtagccgtcgggtgtcaccttgta

SEQ ID NO: 599517 - DNA, 310 bp, Homo sapiens
gcgtcgacgtccatattttcccactgaaatgttttataagtcacagcatggctgagtatggcggctcacgcctgtaatcccagcgctttggaaggctgaggtgggcagatcacctgaggtcaggagtttgagaccagcctggccaacatggtgaaaccctgtctctactaaaaatacaaaagttagctgggtgtggtggcgggcaccagtaaccccagctacttgggtggctaaaataggagaatcacttaaacccgggaggtggaggctacagtgagccaagattgcgccactgcactccaggtcgacg

SEQ ID NO: 599518 - DNA, 173 bp, Homo sapiens
cagtatgaaatcccatcaccatcttccaggagcgagatccctccaaaatcacgtggggcgatgctaggcgctgagtacgtcgtagcagtccactgtgcgtctatcaccaccatggagaaggctaggggcatcattgggccaggaggggagccgaaacagggtctatcatacta

SEQ ID NO: 599519 - DNA, 539 bp, Homo sapiens
ggtcttctggccggcaccactgggggctacacccctcacagtgctccaagatgtcttcccacagctcctctgatggctcccttggccacttctctcattctggcttaacccacaatcccctagggaatgagcacggcatttcccattgttagccatttccaccacaggttctgacaagccagatctgactttgttctccttttgtttggcagctcttttgtgacagggacggcttgttgcgggcacttctcacccctgagaatctgggacctcaacaggtaagagattcatgagcccatgctggcttccagtccaggaggtgagggaaagcttgctgagccagcctctgcctcagttggctgagtggtccaggagaaggctgggaagtggtctagtaggaggcctctgctgtggtgccttctcacatggaatcattcagggttagctggaggagactgctgaagtaatttataataggtaaatagtttcatgtagaatttatgataacaacaacaatttggatttatgatactctttct

SEQ ID NO: 599520 - DNA, 1240 bp, Homo sapiens
gtggggtacaagggggcatatagtgagtggctccaagcacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcaggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 599521 - DNA, 1220 bp, Homo sapiens
tgaggatccctatggaccaggcagacggcaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcaggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 599522 - DNA, 1566 bp, Homo sapiens
gtggggtacaagggggcatatagtgagtggctccaagcacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcaggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacaaaaaaaaaaaaaaaaaaaaaaaaaaaaaaaaaaaaaaaaaaaaaaaaaaaaaaaaaaaaaaaaaaaaaaaaaaaaataaacaaaagcaagacacaaagaatgacgaggagaagaacaagaagagctgaaaaaaaaggtgagtgacgataataataatacacatgaatagaatacgtcgcacactattgacagtaaggaaagagaccgcgacgaaaacaatagaaatatagggtacaatataaagcgagtactggaggtaaaccatgacacagagataaatctcttataagaaagataagtatacttaggtcaaataaaatgtaact

SEQ ID NO: 599523 - DNA, 97 bp, Homo sapiens
ggatttgctggtgcagtacaactaggcttaatagggacatgagttttcagattcacaaccaattaagttaaaattagggaaatggagaggagaaaaa

SEQ ID NO: 599524 - DNA, 991 bp, Homo sapiens
cgttggtcggtggtcctgcactgtttctgtgtacttacgggtcctgacgctctcaagttcgtctttcaagaatgctgttgtgccagaagctggacggtagcagagtcggcgagctcgtggattgcaggagctcgattacgtctcggctcgcctcttcattacatcactgcaagattgctacatgaatccagagcctgtaacggcgtgatgctaccacatgccactcgaagagttgctcgcgtaatgagagcgaagtcggcatgcgcacaaatctgagtaaatgctctggactcgtacgcacgacccgtaggggccccgtaacctttgactaggtggctagcccgcgaatggcacgtagagccttacgttcatatctctttgaaaaggggccacgcgtgcgtggttatgacagctccgaagactcgtacgttgctcgggtaatgcgcctgatttcctcgaatctcttgatatgtggactagtgggttatgtgctctccaggacaaggggggcatgtaaaaggcgcatgctggcccctatccactacgcttgacatagagtgtcatgttccccttcttgttgtgaatgacctcttgcaggtagactaaagttccgtggagatttgaagggtcaatggagagaggcactccctctacgtgggcaagaccagggctctgaaagcccgcatctgaacaccttttggtaaactgcaattctgaggtaaatcatgtcccggtgtactcctgagtataatcctgtggatgcctggggagaagttgcttgtatgacgacgacggcttgctcaagtgtgtgactacatcgaattgtgcctccagaacagctaggtgggtacctagatagactcccggttgccgcttatcctagaccagaagttcggtagatgcctttgtaagcattatggctgtcagggagctggtatatctgccctgtgacccgacacattgcttcttgccaatagggaacaacgggggc

SEQ ID NO: 599525 - DNA, 1182 bp, Homo sapiens
agcgggagggtggggggagcaggctggagccccacaggctgggggctgtgatcacggaggcgtgctagccccgggctgggggccagctagaccaggaacaccagggacagctcgctaagctgctttctcagcgatttttctccccagacacaaagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcaggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 599526 - DNA, 910 bp, Homo sapiens
gctgcatttgggagagggtgaggtagccaaggacgtgcctagaaagggttggaagaagcctacaatggcacacgtccctcttcccctgggcctggggatcctgggttagggcacacccatgtcccacttggaaagctcttaccacttcctgtgccctcccttccaggccttcccgctgacgtcgactcccctcagcagccctgtgtactgcctgcgtctcaccaccaagcatctctatgctgccctgtcttacaacctccacgtcctggattttcaaaacccatgaccgtcaggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 599527 - DNA, 1350 bp, Homo sapiens
gtggggtacaagggggcatatagtgagtggctccaagcacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcaggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcacagatctggttcctcactggctgagtagtcctagcaggctccaggagaagggaacagcagacccaagctcagggttgtatggtgctgctgaaaccgacaagaccagcctcat

SEQ ID NO: 599528 - DNA, 184 bp, Homo sapiens
  misc_feature (3)..(3): n is a, c, g, or t
  misc_feature (61)..(61): n is a, c, g, or t
ggnccttttctaggtgacacaagtaaggtaatagctagaatggaaaaaagaggggcccccnaaaatgtaaccttaaaatttggtgcttgtgccgctattgatagtaagcagcatggaataggatgcggttctctaaattggaaaaaaaaagtgacacagtaaaaaaaaaataagtgtatctgtc

SEQ ID NO: 599529 - DNA, 1132 bp, Homo sapiens
gtggggtacaagggggcatatagtgagtggctccaagcacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcctgcgtctcaccaccaagcatctctatgctgccctgtcttacaacctccacgtcctggattttcaaaacccatgaccgtcaggccacccctgcctctgggccagggaaaccagctactcagggacttctcttgcctggagggtgcagtgatagctcctcctcactgccccactgtgctcctgggcctgtgaccccagtgctcaggcaccttgcactagaggcttctgactcctgggactttggagcttaccagagatgcagtccctcccaggaacctgttggagaggcaggacctgctgctttagagtgcggctgaacccgggccttgcgtccctgtttggccagagcaaggatctggcctggagaggcccatcctataccccttattagagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 599530 - DNA, 111 bp, Homo sapiens
agactgcttagactcctcgagttgctagtccagttctttgaggacagtgaggatagtcagataggcggaggaagaagaggaagacagtgaggaatgcagcgaggaagagga

SEQ ID NO: 599531 - DNA, 133 bp, Homo sapiens
ctcatgtgattcctctcagtcagcctcccgtgtagctggggctccagtgacacacccccactggtctggctaattttgggtatttttgggtagagtcagtgtttcaccacatggcacagtctgggtctcaaat

SEQ ID NO: 599532 - DNA, 420 bp, Homo sapiens
ccgcggcataaggcacagtcaatgcattatttgtgggcgacagcttcagtcactgcatagcgaccatcgatatttgatcggtatcagaatgcataccagcaggctcgttggacaatcactgcactgttgttgttgcatgaatcgtggtcagcgtcataggtggtaaagggcctcccactgtggaggctcagggcatcccatagcaggcaagggatggaaagcactttggtgcccagcaccatgcatggcacatgggtagatataatgccatggcagtctcatagcaattaagagttgtcttcaatcaggcccaacgagcaacgccaaggggacaggttgtctgcgcagggttattcggctggttgaaccagcgacaggacttgagctcgggcctgtcaggctcctaagctcccagcttat

SEQ ID NO: 599533 - DNA, 915 bp, Homo sapiens
gtggggtacaagggggcatatagtgagtggctccaagcacaggacggccaaggtgtggcctttggcctcaggccggctggggcagtgcttacacaccatccagactgaagaccgagtctggtccattgctatcagcccattactcagctcttttgtgacagggacggcttgttgcgggcacttctcacccctgagaatctgggacctcaacagtgggcagctgatgacacacttgggcagtgactttcccccaggggctggggtgctggatgtcatgtatgagtcccctttcacactgctgtcctgtggctatgacacctatgttcgctactgggacctccgcaccagcgtccggaaatgtgtcatggagtgggaggagccccacgacagcaccctgtactgcctgcagacagatggcaaccacctgctggccacaggttcctcctactacggtgttgtacggctgtgggaccggcgtcaaagggcctgcctgcacgccttcccgctgacgtcgactcccctcagcagccctgtgtactgcttgcgtccctgtttggccagagcaaggatctggcctggagaggcccatcctataccccttattagagccatgacagcctacagagtgaggtgaggtgctcccaccttcccagatggttcctttctgccccttcctggaaggaaaggtgaggctgccaatagcctcctggcaccagccagacctcacccttgaccaacctctcggggctgggggttcattcctggggcactgtggcctggttttgctttgaaaccaagaaagagcaaagggaacccagcagttctgagtgagttctgagccagccctacctcaggctggctgttgagacatgctacaattttcatttttgtaaaaataaagcttgattgttcaca

SEQ ID NO: 599534 - DNA, 179 bp, Homo sapiens
cttcagaggcaaattcatagcgttttacctttggcagtcctgaaggaagagatgtcacagataaccgctgggtggttctccgggcccgaaggagcgtgtttcccggggttatctcctcggtctcggcctctacaacatcaagtggtatagtcgcttcaagaaagggggaaaaaggaatc

SEQ ID NO: 599535 - DNA, 137 bp, Homo sapiens
ctccccttaaatgaccgagcgcaaaagaaaactgattcagcttccaagtgtgactcttgatgctgtactgcagggagacctgagaacgtggcaggtccataggagaggtggggcagagagatcctagtaaagaggat

SEQ ID NO: 599536 - DNA, 112 bp, Homo sapiens
gagtcggcccgtgtgtctccccagtcatctttcttgttccagagaggtgggctggatgtctccatctctgtctcaactttatgtgcactgagccacaacttctaaggttaag

SEQ ID NO: 599537 - DNA, 120 bp, Homo sapiens
tcttctcctgacatcagcccccatcccattgtctcctagccaagacagagtgccataggccaggccgggcagagaaccaacctcccttccagcctgggtgacagagcgagactccatctc

SEQ ID NO: 599538 - DNA, 139 bp, Homo sapiens
gggggcttttttaaaccaaaaaaaaaagggcaggggccccaaccccttttggggttctttttttgggggggacccggttttgggtccaaaaaaaaggcctattttcccataaatttttgggattttgccgggattttga

SEQ ID NO: 599539 - DNA, 384 bp, Homo sapiens
  misc_feature (79)..(79): n is a, c, g, or t
  misc_feature (109)..(109): n is a, c, g, or t
aaaaaaaaaaaaggcgggaggtggaaatccaatggccagggtggtgttggaccaggtaacccttcagaacccttctaantggtgtcctagggccctgggtattttgtgntatgagcattccccgcccacactgaccgggcctcaattttttcttcccttccgtggcccccagaagaaaaaggacgtggaatgggacgtggaaccatctttcaaaagcgaagataattttttaagttgaacagaactttgcccttttttctttcaggttatttgagttcattggagggggggcttgggcaaaaatgctaggtatcttttcccctctttttctttagatcaggggaaatgtttaagctaaataaatttggggggttttttgttcca

SEQ ID NO: 599540 - DNA, 1062 bp, Homo sapiens
gtcgtggtcaatccctgaacgcaccgccgtgatgcccagaggaagacagggtcgacctggaagtcctagacctacttccttaacgattcagtccaacatagttggatgagttatccgaacattgtttcattgtgtggagcagacaaatgtgtggctccaagtcatgatgcagcagagtccgtcatggtcccttcgcgggaaggctgtggtgctgatgggcaagaacatccatgatgcgcaaggccatccgtagggcaccttggtaataacaacccatgtctctggagtaaactgctgcctctatactccgggaggaagtgtgggcgtttagtgttcacgcaaggagtgatcctcatctgagcatcagggtacatgttgctggaccaataagagtgccaagcgttgctgcccgtgctgtgtgtcctattgtccccatgatgaagtcactgtgccatgactccagtaacactggtcatcggggcccgaagaaagacctctctttttcctagtgctttaggtatcaccactaaaatctccaggggacacctattgaaatcctgggttgttcgctatgttgccagtgtctgtctgcagattggctacccaactgttgcatcagtaccccattcttatcatcgacggggtacaaacgaggtcctgggcttgtctgtggagacggataacacttcccattgcttgaacacggtcaaggcttctttggtgatcatctggctttgtgtgtgtgctctgttggttgtgccacacagttggtcctgttgtggtggaaccccagtaaggtgaagccagggaaatcgaggacattgccaggttcggatagagtccttagatattacaaaaagacaattagacgtgttttgagaacaggaaaaaagggacttttttgaaaaaaaaaaggggcgactaagatatccaagggacaaaaggacaaatattatagggcacatgaagtaataaagaggagaaaacaagaaaaatgatgtaagacaatagtatagacaaaagaaaactgtttatgttaatatataaagaaagaagagttat

SEQ ID NO: 599541 - DNA, 253 bp, Homo sapiens
ccccctttgggggcccggggtttttttttttgaaattttcgaaaagggggggccgggggggttttttaaaaagggggccccccgggggcccccggccaaaactttgggggccccccccccccggggggggggggaaagggggggggcccccccccccccccccccccccctttttgggccctttggggtttaaaaaaaaaaggtttttttccccgggccccccggtttttttttaaaaacccccggtttttga

SEQ ID NO: 599542 - DNA, 127 bp, Homo sapiens
tccaaacagctgcagtgctacagcatcagtcatgaatttcccagtcacgaaatcttcccagtaggcagaacttagggcagcacacccagttacgcactttgctgtgaaggagaaatggccagatgtg

SEQ ID NO: 599543 - DNA, 100 bp, Homo sapiens
cctactgatacaatcgagctctgtaccccaggtagacctaacctgactagaaaagctactaaaacaatttcacagcaccaaatctccacctccatcatca

SEQ ID NO: 599544 - DNA, 410 bp, Homo sapiens
gtgaacatgcaattcttcatcagttatgagtatcatgggtgtcttctcaagattgtgagactcatcttctcacttcaagtgtagcttacatataagcctttagttttaacagaattgacttaaccatcttgtcctttatgattactactttatgtctcaagagattctttcctgccctaaggcttttttcatccaaacactgacaatttttgcttttcgtattaaagcccttaacatatttggaacttatcaccaggtaaggtgagagaaagtaaaatttctttttttcccacatgaatagccattgttctgggattacttagggagtggtccttcctgtccccactgacttgccatgtcaccaggtcattttgcaaaggtcaacatatgcacgggtgagtttctaggcc

SEQ ID NO: 599545 - DNA, 308 bp, Homo sapiens
gtttaagacagtcattgtaaaaggggggctgaatttcccaacccacccccaaactaaacactaagtttaattttcagctcctcggtgggacatataagtgcatctctggtgggacataggcaaaataactgggcaaacttagttctggtgatttctggatggttgggaagtctatggctgggaagaaattccatcaggcatattcaggcttataataagcgggggatttttggttggttttggcaaatgctggcccctacttttcaacaattttctatgttagtggtgaagaaccagtgtggagagag

SEQ ID NO: 599546 - DNA, 214 bp, Homo sapiens
gaggtgcctccctggaccggggaagtcaacccagcccagagagatggaggtgcctcgggcggggcccttgggactcctctgatcgatctgcctcctaaaaggcaagctgagggcgcttctaactgcccctcggagccttcgaagatcagcttgttcggggaacgatagacaagattaggccaagcgacttgctataacagttccatctaaggat

SEQ ID NO: 599547 - DNA, 552 bp, Homo sapiens
  misc_feature (12)..(12): n is a, c, g, or t
aagttttgtagnagcaagggaaagaatttctcccgctttggggaaaaaagggaaagaggcccaatatttttaaggctgggggagccccccatttttatatggggtcccgcaaaccccaggggggtggaaggctttccagacaaccccccctggggggcttttttgttttttaaaaaaaaaaaaaccattggggggggggtctccaaaacacgggcaaaaaagggtgggggggggggcaggggccccaattttcccccaaaaacccaaaggggaaaaaaaaaatttccccaaaaccccccccccccccttttaacagggggggaaaaaagggttccaaaacgttttttttcaatgggccctttaagtttaagggaaaaaaggggggtaataaaaccaaggcttgggaaaccccccaaaaaaaaagaaaaaattttttgggcccccttgggttttttttttgggggggggcggttttaagaaataggtttttaaaaaagggcctttttaagggaaaaaccttgcccaaaaatttgtcccaaaattttgaacccc

SEQ ID NO: 599548 - DNA, 631 bp, Homo sapiens
  misc_feature (405)..(405): n is a, c, g, or t
  misc_feature (444)..(444): n is a, c, g, or t
  misc_feature (472)..(472): n is a, c, g, or t
  misc_feature (549)..(549): n is a, c, g, or t
  misc_feature (595)..(595): n is a, c, g, or t
  misc_feature (612)..(612): n is a, c, g, or t
tttttttgtggtgagaacacttgaaatctactctcagcaattttaaagtatataatatgttgttactaactgtagtcacatcactatgatgtgcaatcgatctcttgaacttactcctatctacctgacattttgcatgctttacatctccccagtctcccaacccccagcttctgagaaccaccattctactttctgcttctatgagtccaattttgtttgctttagaggtggtacctcactctgtcacccaggctagagtgcagtggcacaatcatggctccctgcaatctctaactcctggggctcaagtgatcctcccgcctcagtctcccaagtagctgagaccatagggcgtccgccaccacggcccccagctaaagttttaaattttttgtagagatnaaggtcttattcatgttgcccagggtgggcctcaacctncaaagtggtggggattgcagttgtgagncactgcactaaggctgagtcgaattttttgggattcacaattaagtgaggtcatgcagtatttgtctttgtatggtngggttatttcaatttaggtaatattttccggggttatctgtggttntttaaatgacaaggttnatttgtgttgttagggttt

SEQ ID NO: 599549 - DNA, 840 bp, Homo sapiens
gcgctggtgttgcgtgcgctggcgacagtcggggttgcgagctggccctggggcctggggcgtgccagtgacctgctgcagggactgagaccctgtgtgtgttggctgtcctgtgcccgtcgcacgtggagtgtgccgtccatgtggcatcctgctgtggtgagactgaagaatgtttgcccagactgtgccatgcattttgccaacttgcgcaggtgcaatcctgccgcatgtgcccagtgagatcactgtaggactgcgccagtgatgcaggactggagtgcccaccggtgccttgtcatgcgttgcatggcccctgatcccagtgtactgagcatagcccatgtgctctgcaggccgtttccttccggacgatgtggatggccgatggtcgatcctgaggagcttgaacaatgacattggcatgagccagcgcagttttgagtggcgttctgagtgtgcaagctggcacccgaggcaggcaggcagatgtgtgtcattgtacttgtatacccttgggactacccagccagcccagagcgcagggtactgcgatgtgaccatgcatctccgtggaactccacttggctctgtgtgtggccttgtgccgtacgtgccggctggaccatgggtgactggaggcacgcttaaggtccgttcgtgtgtgcgctggaagcctggacctggcgagaccgtgcgtccccaggaaccgtcggccgtggtggagggtccccaatgctggtcctgtggtcttggcctttccatcgccaagcagggccatcccaggttcgcaggaggggctgtaccattggtgacggttgtagggagtagagaccttga

SEQ ID NO: 599550 - DNA, 418 bp, Homo sapiens
  misc_feature (30)..(30): n is a, c, g, or t
  misc_feature (42)..(42): n is a, c, g, or t
  misc_feature (64)..(64): n is a, c, g, or t
aaaacttcacctcactctccagggcaggantggtgggggaancctgaggcagccacagggaaangagaggccctccagaagcccactggggcttggcaaaagccacagcccttagggagtcaagcttggtggctagggcctgggaggtggctcctgcctgttatcccagcacttcaggaggttgaggctggcagattgcttgggcccaggagttcaagactagcttgagcaacatggcaagactctgtctctacagaaaaaatacaaaaattagtcaggaatggtggcacacctgtagtcccagctactccagaggttgaggtgggaggatcgcttgagcctgggaggttgaggctgcagtgagccgagatcgcaccacttcactcctgccttggtgacagagtgagaccctgtctca

SEQ ID NO: 599551 - DNA, 1093 bp, Homo sapiens
  misc_feature (268)..(268): n is a, c, g, or t
aatagtatatcgtgtgtctgatagttctttgtacgaaggtttgtctgatgtcatcctatggtaggtagtaccaatgtgaaaatgataaccgtgtgtcgtcctttttacacatacctccactcttgttggccggagtttttatcactatttttccacaaaccggggttctcccacaagggggtaggttccttggcgttcccgcgctttaaacaatgggcgcccggtgccacatggggaatgctgtaaattctcctgaccccagcttatnaagacgcctgtgaagagagttgtaaagctttctgtctactaccccttgtctccaggccttgtccgccagttcttggtgtgaaaactccagctgatggttaccacccggacatcaggttaattgggcaaaccctgaagtcacatgtgtgtaactgacctctggcctggcctgcacagagagagccctataagtcacaggtctgtggtggccccgaaattgggggggcctgctagttcacggaggatgtctgtgcaacacactcgtggtgtgatggaattctcgcccacgaaaggcttcctcgaggttcccacggttggcacctttctccctgcaaggcccttgtaagaagaattctgctggtccttgcacggcacaaagctaacagccacgaaatgtccctttgagaaactcctatgctcaatctgtcacccgaggcttcaatccgaaatgtgccaccggagagcttgctctccacacttcctccgtgcacagtggccctgccacacacgccctccctcggcaacacactttgagaccccttgtaaggagattggaaattagcacggagactcgggtaatttaaagcacaccacgttctggggtcgcctgggcccctgctgagccccctcctccagaggcagccagcccagcccggggaacaaagacggaacttcctctcccttcggagactcacagcctttgcaagagagtcaaagctccacacttgaaagctcactcagtaatatcccttcaaagtgttttatattgttttgactgcccttttttgtagaaataaaaatctcgcccttagaatttatcgtccca

SEQ ID NO: 599552 - DNA, 628 bp, Homo sapiens
agctcccacttacaagtgagaacatgtggtattatgttcctgtgttagtctgcttaggatgatggcctccagctccatccatgttgctccaaaggacatggtctagttcttttttatggttgtgtggtattccatggtgtatatgtaccacgttttctttatccagtctaccactgatgggcatttaggttgatgccatgactttgcgattgtgaatagtgctgtgatgaacatatgtgtacatgtgtctttatggtagaatgatttatattactttgggtatatactcagtaagggggtcctgggtcaaatgatacttctgtttttcacttctttgagaaattgccatactgctttccacaatggctaaactaatttacattcccaccagcagtatataagtgttcccttttctctgcagcctcaccagcatctattattcattatttgactatatgttaatttctctgttttttttccgagcacagagtctctctctgttgcccaggctggcgtgatcgtgatcttgatctcactgcaacgtcttgcctcccggggttcaaccccgactttatttgcggtctcagcctctcgagtagtctgccctcccgggggtgtgcccccacgg

SEQ ID NO: 599553 - DNA, 934 bp, Homo sapiens
  misc_feature (4)..(4): n is a, c, g, or t
  misc_feature (30)..(30): n is a, c, g, or t
  misc_feature (35)..(35): n is a, c, g, or t
  misc_feature (145)..(145): n is a, c, g, or t
  misc_feature (165)..(165): n is a, c, g, or t
  misc_feature (170)..(171): n is a, c, g, or t
  misc_feature (173)..(175): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (212)..(212): n is a, c, g, or t
  misc_feature (214)..(214): n is a, c, g, or t
  misc_feature (216)..(217): n is a, c, g, or t
  misc_feature (228)..(228): n is a, c, g, or t
  misc_feature (250)..(250): n is a, c, g, or t
  misc_feature (258)..(258): n is a, c, g, or t
  misc_feature (269)..(269): n is a, c, g, or t
  misc_feature (281)..(283): n is a, c, g, or t
  misc_feature (290)..(291): n is a, c, g, or t
  misc_feature (293)..(293): n is a, c, g, or t
  misc_feature (297)..(298): n is a, c, g, or t
  misc_feature (305)..(306): n is a, c, g, or t
  misc_feature (410)..(410): n is a, c, g, or t
  misc_feature (420)..(420): n is a, c, g, or t
  misc_feature (423)..(423): n is a, c, g, or t
  misc_feature (434)..(434): n is a, c, g, or t
  misc_feature (454)..(454): n is a, c, g, or t
  misc_feature (470)..(470): n is a, c, g, or t
aacngagctacacaatgcattgcgtctatnatgtnaaaacgtgcattagtacacaaatacaaaaaccatgaaacaagccaccattcttcaacaatttgagccaagataaaatgcctaagtaacaacatggatgacttgcaaaggntgggctctttactttaagcnccatnnannnanacaaaagcncaaatngatgagtgtgttcagttatntncnntgaattgatcntttggcactaggaatctgagcnttttgtcntatagcattancatgtattattnnngtgcgtnntntcanngaatagnnccaccagcattcaaaagcagctttgtcaactaggcaataaaacactctacagcatatccctctgttgtccatcattgagaacactggcagcgattttgagatgnaaaagaaaanganagaagagaagnggagctattacccccttttnttttttctctgtttanaatcaaacagaaaacaaacatcaattgttatacactaacatcttcaaagcacatcgtttgtacaagagatagactaagaacaaaaatgtgtttacggagatccaaacataagtgagtgagagtgcctctcacacagctttccgatggtactcaggaggagccacttcataatcgctggcactgaacaaagttgcagaattctttgccaggtactttaggaaatcgtgaagataattgagtaataaagcaaggctcttctcatccagaggtgtataagccaacattgctccaattcgtacaaataatctcaggagatgtggcgctccatacacctgggacatgggtgcatcgggatgatctgcaagaatttcagcatactgtggtctctcaaatttatagagtagctgggtaccaacattacgttgaagtattcttttatccctgccacaacttcattaaccgca

SEQ ID NO: 599554 - DNA, 1419 bp, Homo sapiens
  misc_feature (691)..(691): n is a, c, g, or t
  misc_feature (1046)..(1046): n is a, c, g, or t
  misc_feature (1092)..(1092): n is a, c, g, or t
  misc_feature (1131)..(1131): n is a, c, g, or t
  misc_feature (1230)..(1230): n is a, c, g, or t
gtgctcatcccattgacgttgttctttctcgccgcgggttttttatcttgtcgttcaatgatggccccccgcttgatctctctttgaggttaagctctttctttgtccggggggacaacatgttgggggggttctacaaaattgtccgaccagaaatgggttgtgctcttccaccagagaagtgtttttgctcttctttggcaccaagcactctttggtcgcgggtgtacccacccccccagatttggtgcccccctccccccacttgggggtaggcccgactgtggggggttcttccaacagtgtgctttacacgggtgtggtaattttatttcccgcttggtggacccccacttccccaggtcccccaaaatatttatggcccccccccgggctcttaattgcccccccccctttatattttgggaaatttgctccaacacccaccagggcgttacaaccaacattttgccacaaagaccacaacagtgttttgcgcttgaagagccttggatatagggatacaaatggagatttttggatgtctcgccccccgcttgttttgggggtattaaatcaagcccctgtgagaatagatatggcgccccccctaagaaaattttctcttggagaaatctctctggggtggagattgctctcgcccccaccttgtgtttggaaatatatgggntttcccccttgggcccaaagcccccaaccatgggtgtgtgttttgagagagggctttctctcacgagccttatattcccaccccctcttgggggttccccgcttgtgtgcgtgtgttctgcgggagaaagtatgagggaaccacacacacacgcgttttgcccgcgcgtgtggggtgtgtgaccactcccaaaagcccacgcttgggaacccccaagaaaaaggccttgtcttggagagcctggtgccacaaaaggctccccccaccaagtctctgtcgccctcagaaataagcctgtctacagagaaggcgctataatatgaaaatatatatatatctctccctataatatccnctttcgccaccccgccacccctctcttagaatccacagctggtgtnggagaagagaccggtgtctccacagagacctcgttttgnttgtccacacattgggccacatcttataagtgttatagtatagtataaaagagactgggttataatagagatgataccacacatgcactcgtgtaaacncctctcacgaaaggaaaaggaggaaatgttttgtggagccacctcttggttttctctttttgcgctgtggcacgcttttataagttaattatgtttttaaaaatcacgtaactttttataatggaaaccaaacttgagcccaaaatttgtcccagaattttgagaccccctttaaaaagttaaatgaga

SEQ ID NO: 599555 - DNA, 660 bp, Homo sapiens
  misc_feature (6)..(6): n is a, c, g, or t
  misc_feature (197)..(197): n is a, c, g, or t
  misc_feature (252)..(252): n is a, c, g, or t
  misc_feature (278)..(278): n is a, c, g, or t
  misc_feature (326)..(326): n is a, c, g, or t
  misc_feature (343)..(343): n is a, c, g, or t
  misc_feature (358)..(358): n is a, c, g, or t
  misc_feature (366)..(366): n is a, c, g, or t
  misc_feature (372)..(373): n is a, c, g, or t
  misc_feature (378)..(378): n is a, c, g, or t
  misc_feature (387)..(389): n is a, c, g, or t
  misc_feature (407)..(407): n is a, c, g, or t
  misc_feature (415)..(415): n is a, c, g, or t
  misc_feature (421)..(425): n is a, c, g, or t
  misc_feature (441)..(442): n is a, c, g, or t
  misc_feature (444)..(444): n is a, c, g, or t
  misc_feature (448)..(449): n is a, c, g, or t
  misc_feature (458)..(458): n is a, c, g, or t
  misc_feature (473)..(473): n is a, c, g, or t
  misc_feature (478)..(478): n is a, c, g, or t
  misc_feature (485)..(485): n is a, c, g, or t
  misc_feature (500)..(500): n is a, c, g, or t
  misc_feature (526)..(527): n is a, c, g, or t
  misc_feature (549)..(549): n is a, c, g, or t
  misc_feature (574)..(574): n is a, c, g, or t
  misc_feature (653)..(653): n is a, c, g, or t
gaagcnggggaatcaagttcactattttctgaaacacacaaaaaagggatgggaacaatgacttacaactaagattgctcataaaagaccatcagaaagatccctaaacaaaagctaaatagttacagttaatggtaactggcaaggcatttaatgcatttgctggtattaagtttcttatggaatgaatgaatgancccagcagcattttatgacacagctgccagaacatcccatagaaaaacaattttntaggaacgtgatggcaacaatcagcngccaatattctcaagagttcctaattaccaaaagcatatacaattttngtctagaaaaataagtnaattttataaaattnagtttttngatcgnnaagcnccccctttnnnaggtacagagatactganaaatagtncctagnnnnntcactaaatggtttanngngagnnagggatgcnatgttgagttacggngtgcngcgcgtnccctcagctgctggngaggggctggtggatgggcggctggnngcagcgcacatgctccactggngtgccctccccgtcgcctgaacttnaggtacttattcaggatggtgatgatctcatcattgagaatctggaacttgagaattctctacaccatcttcataaaangcacatt

SEQ ID NO: 599556 - DNA, 349 bp, Homo sapiens
gatccatacacgatccccccagttcctgcttcttgaaaatcaccaccagttggtcttcaggttgtaagatgtgtgtttcagcgcctgtgcatattactgatcagcacttagtacctgtggaggaagatgcatcagctctgaagatgacgaggcaggaggctgtgacactcttaagctatatttgtcaaagcgcgtctgcccccttcaggctggtatcatggttccccagatcatcgtcgaacttgcttgcttgttaaagatgattactattattatcagtaggatcatgattacgatgatcgagtggagtcatacactgttgactcgatatgtacgctgaagtatcaag

SEQ ID NO: 599557 - DNA, 112 bp, Homo sapiens
ggccgttctccccgttgtttcttgcgcagcattctccattttgtatgaagccgctctaactcggtctaagatagtacatcttcttctggcgggcttcccggtcattctttag

SEQ ID NO: 599558 - DNA, 218 bp, Homo sapiens
gtgaaactacccctaaagccaaatgggaaaggaaagactcatatcaccattgtcgtcattgacacgtagattcgggcacgtccacactactggccatctgatctataaatgccggtgcatcgacaaagacccattgaaaatttgagaggaggcttcctgagatggaaagggctcttcagtatgcctcggtcttgataactgaaagctgagcgtgaccg

SEQ ID NO: 599559 - DNA, 862 bp, Homo sapiens
  misc_feature (277)..(277): n is a, c, g, or t
  misc_feature (365)..(365): n is a, c, g, or t
  misc_feature (386)..(386): n is a, c, g, or t
  misc_feature (391)..(391): n is a, c, g, or t
  misc_feature (395)..(395): n is a, c, g, or t
  misc_feature (447)..(447): n is a, c, g, or t
  misc_feature (451)..(452): n is a, c, g, or t
  misc_feature (472)..(472): n is a, c, g, or t
  misc_feature (478)..(478): n is a, c, g, or t
  misc_feature (486)..(486): n is a, c, g, or t
  misc_feature (506)..(506): n is a, c, g, or t
  misc_feature (524)..(524): n is a, c, g, or t
  misc_feature (546)..(546): n is a, c, g, or t
  misc_feature (568)..(568): n is a, c, g, or t
  misc_feature (570)..(570): n is a, c, g, or t
  misc_feature (586)..(587): n is a, c, g, or t
  misc_feature (663)..(663): n is a, c, g, or t
  misc_feature (772)..(772): n is a, c, g, or t
  misc_feature (801)..(801): n is a, c, g, or t
  misc_feature (824)..(824): n is a, c, g, or t
cgctcccggagctgggcggagcggggcgcagcccacgtggttcgggcgggaggcgccgggacgtggccagttgcccgcctgccccggagagccaggcgctaaccagccgctctggccccgcgccctgcttgcccccattatccagccttgccccggcgccctgacctgacgccctggcctgacgccctgcttcgtcgcctcctttctctcccaggtgctggaccagggactgagcgtccccggagagggtccggtgtgacccgacaagaagcagaantggggaagaaactggatctttccaagctcactgatgaagaggcccagcatgtctggaagttgttcaacgagattttgacctccgaagnaaagaagaggaacggctagangcgtngaangggcaagattaagaaggaaagctccaagagggagctgctttccgacactgcncatnntgaacgagacccactgcgcncgctgnctgcagcnctaccagctgcttgtgaatngcaaaggcagtgcctggnatgtggcctcttcacctgcaanaagctgtggccgcgtccacccngnaggagcagggctggtnntgtgaccctgccatatggtcaatgtgagtcgtcatgagtgtatatgagctgtgaaggcgctcagagtcgagtgcangtctcagtctcacggcgctgaggtgagtggctgatgatattgagaagatgaaagacaaagatgagatgagctgtcaagcagcagcaccttgacaaaaacctcttctcanattgattgagaatcaatatcattactcantatctgacttctcatctgagcangaagcaatctaatatttaaagactaagtagctgagagt

SEQ ID NO: 599560 - DNA, 735 bp, Homo sapiens
  misc_feature (277)..(277): n is a, c, g, or t
  misc_feature (365)..(365): n is a, c, g, or t
  misc_feature (386)..(386): n is a, c, g, or t
  misc_feature (391)..(391): n is a, c, g, or t
  misc_feature (395)..(395): n is a, c, g, or t
  misc_feature (447)..(447): n is a, c, g, or t
  misc_feature (451)..(452): n is a, c, g, or t
  misc_feature (472)..(472): n is a, c, g, or t
  misc_feature (478)..(478): n is a, c, g, or t
  misc_feature (486)..(486): n is a, c, g, or t
  misc_feature (506)..(506): n is a, c, g, or t
  misc_feature (524)..(524): n is a, c, g, or t
  misc_feature (546)..(546): n is a, c, g, or t
  misc_feature (568)..(568): n is a, c, g, or t
  misc_feature (570)..(570): n is a, c, g, or t
  misc_feature (586)..(587): n is a, c, g, or t
cgctcccggagctgggcggagcggggcgcagcccacgtggttcgggcgggaggcgccgggacgtggccagttgcccgcctgccccggagagccaggcgctaaccagccgctctggccccgcgccctgcttgcccccattatccagccttgccccggcgccctgacctgacgccctggcctgacgccctgcttcgtcgcctcctttctctcccaggtgctggaccagggactgagcgtccccggagagggtccggtgtgacccgacaagaagcagaantggggaagaaactggatctttccaagctcactgatgaagaggcccagcatgtctggaagttgttcaacgagattttgacctccgaagnaaagaagaggaacggctagangcgtngaangggcaagattaagaaggaaagctccaagagggagctgctttccgacactgcncatnntgaacgagacccactgcgcncgctgnctgcagcnctaccagctgcttgtgaatngcaaaggcagtgcctggnatgtggcctcttcacctgcaanaagctgtggccgcgtccacccngnaggagcagggctggtnntgtgaccctgccattctgtgccagagctcgtgacagaatcggctcactggcacgtggtactatgcagcatgtgaacagccctgcttcaacgaggttcggaagttgccaaggttcatccggtccctccactgggctggctgcacggtgg

SEQ ID NO: 599561 - DNA, 482 bp, Homo sapiens
gaatatcttcttggatcagccgggatgctcagaatgtcccaggtgtatgaggtaccgagatctactgagattatattgtaagaataggagcaaggtatggactatacgcccctagatgagaaaagcctatgctgatagtcgggctattggcatgatgtcctaaaagtgagtctggcaaagaattgctgcatctctcttatactgccagggattactaagtggcttctgcatgagtaccaccggaaaggcctgtgagcgtctacagactagtgtcaccatcttcgtccagtatctgtaaacactgttagttcggagtcggccgctggtaaaatcgatgttctttaaaatcgttaatgtataacagggcttatgtttcagttggttttccgttctgttttaaacagaaaataaaaggagtgtaagctccttttctcatttcaaagttgctaccagtgtatgcagtaattagaacaaagaagaaa

SEQ ID NO: 599562 - DNA, 1117 bp, Homo sapiens
agagctgagtcttagagtagggaaggatcagaggaggcaatcaatgcaggcaactggtcagtgtcatgctcctgtaaggcaacccagcagcaggcagccagtgccagcacagttcccagcaacagtaaagcccccgaaagactcaatcgattaaacgagggcaaggcaaataggcagtcagtgtcaaaagtgctcctcaggcaaagcagcatgtgcatgctgttgtcacggggacctgtgctgggaggcactgagtgaagattcatttcagcatgttagtgtaaggctgtgactttctcagctccttcctcctgtgtaaatttcactgtcattcccttcttacatttggattccccccatccccttttaggtacggtttatacctgcatattcctcgtcgacgtcctcttgatactactatatcttgcccaagagagctccctcatcaaggaccaacagtataggcatccatctatgcccttgtacaaaactaaagaaaacgtcatttggtatgtccatttacttacctggggtatagaaagtggtcttggaaagagtccatttgatttagatagcatgctccatcaatctagccttgtgaaaccaattcacaaactaatctgtataaaagcataactgattgtgtccatttagtattgaggtgatataaccaagtctagaagttagaaactgtgggtcatttccacatacattacgactacaaactgatgtcctttgggaacacagcaaactttattgagaagggctgggagggtccatctacaatactggttatgcaaggagtgaaaggtaggcacaacgtgactttaggactgaaaactctagaaagtaccctcaggcatgggtgtacttgggcaacaaggcagagggaagccaacgataagacagcggaacataaagccactggacacagtacacagagcaacgcatagcagaacagaggaccacaaaccattaaaaaggcacgcgcagaagcaaagacacaacacggcaaacaacctgggcacaacaagatgagtaagaccaaggaccacacccaagacaagacacacgacagaggacaaaacagagaggaaagacaacgacagcagcaaac

SEQ ID NO: 599563 - DNA, 116 bp, Homo sapiens
ttatcgagctcggtaccgattggtctgcatgtgaggttacagtaagtagcttgtcatgttaaaggttgcaaagagctgcttgttcttcatctcttgttaggtgttggaggagcaca

SEQ ID NO: 599564 - DNA, 429 bp, Homo sapiens
  misc_feature (171)..(171): n is a, c, g, or t
  misc_feature (191)..(191): n is a, c, g, or t
  misc_feature (193)..(193): n is a, c, g, or t
  misc_feature (210)..(210): n is a, c, g, or t
  misc_feature (239)..(239): n is a, c, g, or t
  misc_feature (247)..(247): n is a, c, g, or t
  misc_feature (270)..(270): n is a, c, g, or t
  misc_feature (360)..(361): n is a, c, g, or t
  misc_feature (420)..(420): n is a, c, g, or t
tcattcttccaaaagcagaatccgaagctggttttcattgagaccaaaaaagtccatggcttttcaggacctgcaatgttgacaggtgtgtggatatcatgggaaagggtacaggtagaccagcagtcccggttgggcacttgcccagcatgtccggcggcagaagtgcanctggtcgcaggcctggcacntnccgcgctggtagctgtngcagaggcgcacagaggacacggccaccnaccctccnagcggaggtgccgccaccgcccnaccctgtcgccccgcctcgcctccgcgtccccgaggccctcctgcgtctccacctcctgcagcaggaaacgctcgggcccggccgctganncacgtcccggagcctggcctccgacagctccacgtggccgcgcaggtccttcaggaacnatcggtcgc

SEQ ID NO: 599565 - DNA, 221 bp, Homo sapiens
agttagtagtgcaggagatgaggacagggaggagtgcaggagatgaggacagggaggagtgtagcatgatgaggacagagaggtgtgcaggagatgagtacagcgaggtgtgctggagatgaggacagagagcagtgttggagattagtagagagagtattgctgcacacgaggacagggagttgtactcgtgatcatgacaataagttgtgcctgtgatt

SEQ ID NO: 599566 - DNA, 191 bp, Homo sapiens
tcagcgctttatacttcctcagctttatacttcctcaacgctttatacttcatggccaggtggtgcctattagagaaaattttcttgaggaatggacacttgagccaagcgggcaaggaagtataaagcgtggaggaagtataaagcgtggagaggaagtataaagcgttgaggaagtataaagcgttgag

SEQ ID NO: 599567 - DNA, 629 bp, Homo sapiens
gaaacattcaatgatttctggtgtattatttataatatacctcttcctccaaatatttaagttaaattacaataaaaaacatgtttataataatgctgttgaaatagaaataaaaatccaaagccctgaaatgaggaaattagcacattcagctcaaagacacaatgcttattgtgatgactccttaatcagaacaacctgacaaggtgatggaggaagtatgatgggtttaaattttaacaggattaatttctaaaatagatttttatcacctgagacctttaacagaggacagtatgtggcacaatatgcaaggtcgtcatagatttatagcaaatgcaaaatacattgggtttcattggaaggttgatgccacacatacaaaagctggcaattaatttatgattgatcacggttctggtagcaaaattcaaccatagtcttcttttataatacaatttataagcataataacaaactacctcttataaagtacctttatgtccaggcactccacaaggatgatttacatatataatctcttaaggtctcccatcctctatgaaggagaaaatatcattttaccatgtccaagatgaggaaattgggaggtcaaatgaataaagaag

SEQ ID NO: 599568 - DNA, 650 bp, Homo sapiens
  misc_feature (354)..(354): n is a, c, g, or t
  misc_feature (445)..(445): n is a, c, g, or t
atcagggaaggagacagccaaagagctggctcagagaggagctcgagatatatttagcttgccgggatgtggaacagacgggggaatgtgcgtggccaacagagatccagacgcacgacaggggaaccatgtcaggtgttgtgtgcggaaactggacctgtctgatactaagctctattcgagcttttgcgtacgggcttcgttagcttgaggataaagcgagcgctccacgtattctgatcaagcaaatgcaggaagtgatgagtgtgtcctgtactcgaagatctgcagatggctttgagagtgcacataggatgtcagaccagcttgggtcacttcgctctctaatcccantcgtgctgctatgcagataacttaatacggatatcaggtccctcgagtcagagggatacggtaaaatggtcgtctttcccatcgacatcantcgacctgggggaacggaatccagcttgccagtaaaccgtgcgagggccgtagatagattcttagataggtgcgagggccattggctctacgtgtcagcatgccataggctagctcgatactagtcgcttcttgtcagcgccaggggaacgtggagacaccaggagaacctatataacggtcgtcctcgagacgggttgagagaa

SEQ ID NO: 599569 - DNA, 228 bp, Homo sapiens
  misc_feature (3)..(3): n is a, c, g, or t
acnatataacgtcacaagaccgtaattctcacctccctttgtcttatgaattcgacacagataccgcccattccgctacaaccgaactcatacacctcctatgaaaaaacttcctaacacgtcaccctagcattacttatattaaaagtctccatagccattacaatctccagaattccccctcaaacctcagaaatattgtcttgggtaggtgtcatgaacaggacg

SEQ ID NO: 599570 - DNA, 125 bp, Homo sapiens
agtgattacaccgtatctgtgaagagcgttaggcccttcttgtgccagtttgtaaatctgctccttcaggtcgtcagatgtcaacttacccccaagtggggacgctgcgtcgatagggtaaagcc

SEQ ID NO: 599571 - DNA, 738 bp, Homo sapiens
catatattgtccaaatcacatcactcaccttgaggtggatacatggtgtttttatcgttgaacaatacatttcacaaccatcaataagaatcaggttagtctagcagagacaatctggcaagataggagaggatatacacagaggacatatatagagagatagagagacagagacagacagatacacaggcgattgttttaagtggtattgtttttcctataggctgtccttgtcactctttctcggttacggtttggtcggaattagctgccggggcctccaccggcttgggctcttctgcagaggctgcggggccctgggccttgggtgtgaaactaggcgcttccgtggctgcgggggtctccttggaagagggggcagcctccgagctgccgggttttgagtctgaagatggggccccgtcacttttggtctcctgggcggcaggagctgcgggcgcctcagtctttttggttccccttcctccttgctgggctcctccccgcggcagggccgcgctctcggccgggccgcggcggcctcagcagctttggggcctcgccgcccgcagcgggccgggggccgcctgctcctgctcgggcgcttcgggggctcagccttggcctctgccgcgccctccgtcttctcggtccgcttcggggcctcctccttgcagccgccgcgtccttctcgccctccttctcctcggccttccctcggcgtcctggtcgggcttc

SEQ ID NO: 599572 - DNA, 158 bp, Homo sapiens
ctcgcacccgtgttcatccctcttcgtcctgccctccctcttcagagaagaataccttccatggcaatcctctgaagatgcgaatccacagatacaatgtgtccctctgttgtgaacatgtatctggttccatacttgtggcctggattgtgttcatc

SEQ ID NO: 599573 - DNA, 888 bp, Homo sapiens
cccagaggaccaaggaaacctctatattgggtacacgatgcaggtaggcagcttcatcctgcaccccaaaaacatcaccattgtgacaggtgccccacgggacagaatatgggcgcggtgttcttgctgagcccaggaggcaggcggaagaactgcggaggaggcaggtgctgaggggctcgcaggtgggcgcctatttgggcagcgccaattgccctggcagacctgaatcaatgatgcgtgcagtgacctcctgttggcgccccctactattcgagaggcaaagaggaagtagggggtgccatctatgtcttcatgaaccaggcggaaacctccttccttgtcacccccttcagtccttcttcatggccccagtgctctgcctttggttaatctgtggccagcatttggggtgaccatcaaccagcgatgattacacaggcgatatgtgctgggcgaagctccgtttgaagggctttggccacggtgtaccattcttatcagagtagctctaaagggcgcctctatagataagccccacccaggtactccagtggacgagaagctggaaactgccttgggtgggccaacttcgggaaaattcccctcagagggccagaatgcattggtggaatgacacaaaattttaaccccagaaccttctaggtgggaaagccctgtcaaaccaattgtgctgctgctggtgaccccagacgccagtacacaagggcacaactcgttctcaaactttgttcgtgccaacttcccatttggctccaaggttggcgacactgttaagacgtgtgcccacctttgtaaattcggcggacacaatagatcgcgatattgaaccgcctttcccgagaaggccctagacaggggggagct

SEQ ID NO: 599574 - DNA, 878 bp, Homo sapiens
  misc_feature (565)..(565): n is a, c, g, or t
  misc_feature (632)..(632): n is a, c, g, or t
  misc_feature (708)..(708): n is a, c, g, or t
agcgggagcgggtgggctgtggacggaggttgtggagagagcagggcggcattggtggctgcggctgaggcttgagccagagatttaaaaatggacaatgatgattttttttccatggactttaaagatggagtctgtctctgttgtccaggctggagtgcagtggcatgatctcggctcactgcaacctccgcctcctgtgttcaagcgattcttctgcctcagcctcccaagtagctgggactacagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggtnggatgctggaaattttctaatcgctgatgaatgttttcaagctgctgtggccagtctggagcaattntacgtcaaattaattcaaggagctcccctgaggctgacttgaccatggagaagattactgttgagagtgaccactncagagtgctttcttaccaagcagagtcagcagttgtcaaggggattttcaaaagagcatctatgtgtgtactgcactgtacagatattgtcgatgagggtcccccagatgaacttccaagtccttcatcaactctccggtacaccctttggagttagaaaccccgaagaa

SEQ ID NO: 599575 - DNA, 212 bp, Homo sapiens
agtagcctcggactgacagtgactctgggcgttattttaatttccaagatgtgactcttttaagaggctactttaaggctgtgaactgtctcactgtcttttcactctttctttttagttcttcaatactgggcatccaatgcgctctagacatgtgatgacgacctcagtttcctacctcttccaacaaatctggctagctattgaaccaa

SEQ ID NO: 599576 - DNA, 756 bp, Homo sapiens
  misc_feature (443)..(443): n is a, c, g, or t
  misc_feature (510)..(510): n is a, c, g, or t
  misc_feature (586)..(586): n is a, c, g, or t
agcgggagcgggtgggctgtggacggaggttgtggagagagcagggcggcattggtggctgcggctgaggcttgagccagagatttaaaaatggacaatgatgattttttttccatggactttaaagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggtnggatgctggaaattttctaatcgctgatgaatgttttcaagctgctgtggccagtctggagcaattntacgtcaaattaattcaaggagctcccctgaggctgacttgaccatggagaagattactgttgagagtgaccactncagagtgctttcttaccaagcagagtcagcagttgtcaaggggattttcaaaagagcatctatgtgtgtactgcactgtacagatattgtcgatgagggtcccccagatgaacttccaagtccttcatcaactctccggtacaccctttggagttagaaaccccgaagaa

SEQ ID NO: 599577 - DNA, 102 bp, Homo sapiens
  misc_feature (3)..(3): n is a, c, g, or t
ggnacatatatctatatatatatatatatatatatatatatatatatatatatttaaacaaatgaagtcataataaaatttaaaaatgctggggaaaaaaaa

SEQ ID NO: 599578 - DNA, 138 bp, Homo sapiens
aaaggggtcaccgacatgggacgaataaccagtcacatgctgcctgacacacttcttcctactccgatggataccaagggttaaagtctagtagtcctatgctacttggagaggctaagtgcagcgagggagagatcc

SEQ ID NO: 599579 - DNA, 934 bp, Homo sapiens
gaaagactcagctatctactaggaagaaagaaaaggccaattcagtctaagtttgatgtgaccggacgtggacccatctttgacatccaggtactggcagcacctagtcgtgggaggtctgacagtagcagagagggtctcgtacatcacacgacatgaatagtctacagaacagggctactcgcaggataagatataagggaagtgaaacccaatctcctggtggaatgatatcgtgatagaatgtaacgtcgacagcatgaagagacagcacgtcaggttgcgaacttacacttgggcttgtgttcccggatcttagcatcgggagaaggggtacatcgaacacagccctagtaggaacttaaccctatacatactcatcgtgaagggtaccacttgtcggaacacaatccggactactagaatttgcgatgaggtaccattgggcgttaaagataggaagaaagcgtgaagtccatttgttcccttcaaagcaactacgaaggttagtcgcgtctctagaaagggacctaggcttcggtgggcatcgaaaagaaaggtggtttttccataatttaggtactagagaccttttccttaaccagagaaattaccacctccctttcgcggtggttataacacctatccaaaggaatgattgggacaggatggccttagacggtaaattgtcggtaaacacttctaaacaccacgcgttcataactcgtatcttaaaaacctatggagggggacaaagagaagtatgatgcgccatctgatggaaaacggacagacagggtgtgaacactttggacttggacggcgaaaggccaccaaacaattcctccggcgtggggacccattaaagagagacacttaaaggtcactccgacttgaagacatagagggcgcccccgagtaacacaggtagaag

SEQ ID NO: 599580 - DNA, 586 bp, Homo sapiens
tctactgtcaggaagaatggggtcctaggtatcttgatctgattatttgagtgttgtgctgacagtttacatcgtctctatgatactacgggttctattgatccttcctccttgggagtaaagcacataattgtcctactgttcttccaaagaaatacttaagtgagataccttgaggaggtggtaaggctaagaaagtggattcctgagtaagatgtcctggattccaatcctcgtattatttgtgaaattgagggtgagtcacttaatctctccaagactaaattttcctatctatgaaatgaatttaattgatgtgcctactccataggattattataagaagtaaatgatgccgggtacagtggctcacacctgtaatcccaggtggctgggattacaggcatgcgccaccacgcccagctaaattatgtagttaaaagtagaggcggggtatctaccatgtaggacaggctggtctcgaactcccgacctcaggatataagaagatccttcctgggatttactcaaagtggtgggatacagatgtgagcaatgacccagcccttattctttatacatctca

SEQ ID NO: 599581 - DNA, 692 bp, Homo sapiens
ccgcggaagccccgccgcgccatgtcttcgcctcccgaagggaaactagagactaaagctggacaccctgcccgccgtgaaatgctggtggaatgcgaattgtgcagaaacacccacatacaggagacaccaaatgaatgagaaatgacaatggatgaccagtgaatgggaaatgccccagtccacctaaacccactgtgttcatctctgtgtgtgtcatctgccctggtggtgacaaatgatttccccccgtgctggctgcgcagtgtggctcaccatgaagccgcatgcctccatggacaatgcatccttccccaagaacccatgcacatccatgcatgccactgcaatgtgatgcctggatgtccaccatgcctgccccatggccccggctctgctgcacattggtatattcctctgacatgatgagaaccatgcatgtttcgcccaaatcctactctgctgggaaatctaagtgcaaaaccaagtgctctgtccttttgccttacatttccatatttaaaactagaaacagctccagcccaaaccttgtttatggggagtctggttggatgtcatctgaggatcattgttgctcctagagtgtgccattagcagactttgccaagatccgagaaaacattttagctttagttctatttcagcaggtcacctcaccgtccttgtccatg

SEQ ID NO: 599582 - DNA, 390 bp, Homo sapiens
tctaaccagcttgaagggggagggagaaggagggagagaagagagaaagaagctgcgtaagacaagcgagtgtcagtcagcgcagagagtcgaggagcctcggagtgcagcgcatgagggctcgttcagctgctcaagtacgaacatcacacgtcccaggaaccccaagcggagaaaggagggcatttaaccctttgtagaaggctcggggccctccttctggagcatggtaagggcacagtgtgcagcgctactgtactggcccaggcagagttcatgtatcttcgtcccctggaacccaacggctccttaaccaggcggggaagtgccgattgaccagtttgggggttgccaaggaaagcctgccccaaaagggccagaaaggtggaa

SEQ ID NO: 599583 - DNA, 103 bp, Homo sapiens
ccatctatgcctggggtgttcatgtctccccctcttgttgtgtggtcgcctgcgtctctttgtcggtctctaagcccttgtctcgtgcctctgggcggccgag

SEQ ID NO: 599584 - DNA, 814 bp, Homo sapiens
  misc_feature (270)..(270): n is a, c, g, or t
  misc_feature (279)..(280): n is a, c, g, or t
  misc_feature (384)..(384): n is a, c, g, or t
  misc_feature (392)..(392): n is a, c, g, or t
  misc_feature (467)..(467): n is a, c, g, or t
ggtgatttgttctgtatcaaaacgacaatatcatgcaagtgtggtcaaatggcagtagaacatttataatgatgatgaccctgaaggaagcgtggatccataaggacaagggtcctaatatgtcttcacttgttgtgattttaagactccccttatttctcttctcaaccctgagagtgatctctaacacatggcttcttgagtacacgcatctttattcagctatccctctatataataggtaccaccgataatgctattagcccaaancgtggtgtnntctaaatattaataggggggcttgattcaacaaagccacagacttaacgttgaaattttcttcaggaattttctagtaacccaggtctaaagtagctacagaanggggaatnttatgtgtgatattttcttcttatgctatatccccaagtttttcagactcatttaagtaaaggctagagtgagtnaggaatagagccaaatgagtaggtgtctgagccatgacagtataaaatactgaaagatgtccacttttatttccaggaaaattaggggggcagattccaaggtccgaattagaattcctaattcgaaatttcttgaaaacctggattttccaggttgcacattttttacatacggtagaccagtttcctctgggttctcttcagttaagtcaaaacaacatgttcctctttccccatatattcatatatttgggctcgtaaagtgtatttctgtgagctgttttcatgtggtttatttcctgtctgtgaaatggtgtctaaaagggggggggataaccttttactta

SEQ ID NO: 599585 - DNA, 230 bp, Homo sapiens
  misc_feature (83)..(84): n is a, c, g, or t
  misc_feature (144)..(144): n is a, c, g, or t
  misc_feature (197)..(197): n is a, c, g, or t
ctagagactctgagctggtgagtgatcttgtctctcatagagatggacaggatgatctactggtcttttcagttagtcctganngggctggattaagcatccatgggtatctgatgagaagggacagtctctgattctgatggnggaggagtttgggtggggccctgggctgtcttgctcctccatggccgctattngagagagttctagagaaaacccaggctccaggg

SEQ ID NO: 599586 - DNA, 827 bp, Homo sapiens
gagctgtaggctcgtagggccgtagacgctgcagacccgcgaccggaccagctcggagggggtgaataatagctctttccacgtctgcattacaaaatggtctccaacaaaactacattgcgaagaaatgggcaagagaacagacagaatggaaagagtacgacagttagaagtaggcagtcgcctgtacgcatattggtcgtggaccagggtactagatcgacgtgtagatgaatgggacaagtgggcaatatttcctgaagtgcaagggaatttacaagatgctgacaataacttttgggaagccgtgaacaaggtcgagcatggtccaggaagtcgatggcatgcgttagctatatacctctcaagaacagctggcagtagaaacatccatggtactgcaggaaaatcttgaatctgacacgttgaatctgattgactaggaacaatcaaacgagggaaaaagaagcatgcgtgcatgaccaagaccaagtaggacttggccacaggtcttgggaatcctgaccgcgatattaattgtgtgccacagacggcagcgtggagaattgcccggtctcggcaatcgacagcgggtgcacagcatgcccgcattgacggcagaactaggtggctgccgcgaagccgcgcatactatgctcgtgttgctccgactttgtccatcggctgcttatggacgccgggactacgtggcgccttctttgcgcccggaaggtgatccctccgcctcggtcgccttggtggccatgtctcctccacgtccttttcccttgggcccccttggctcccgagggcccactgcccccggg

SEQ ID NO: 599587 - DNA, 118 bp, Homo sapiens
gggcctttctgacagcacagtggtccacgcctgtaatcccagcattttgggagactgaggctggtgaacattgtcaccctaaagaagtgataaatgttgaaagtgattgttccccgct

SEQ ID NO: 599588 - DNA, 310 bp, Homo sapiens
atcttgaatcacgaagactgagtcaagcaggccaagctgttcagtggggaagagaaatgatgaatgattagatagattcatcaccaaggtcctctgtagacagcctcagagtgtgttcactcttcaaatggaaataatacattacatagaactcccacataaaaggacatacaatatgtaacaaagaaaaataatgaatagtaagtgaaatcataataatgagatctactttattggtgctgtgtatattactgcgtaagtccaaactcaatatccaggactgtcactggaatataatttctcatgttta

SEQ ID NO: 599589 - DNA, 457 bp, Homo sapiens
  misc_feature (31)..(31): n is a, c, g, or t
  misc_feature (34)..(34): n is a, c, g, or t
  misc_feature (40)..(40): n is a, c, g, or t
  misc_feature (90)..(90): n is a, c, g, or t
  misc_feature (259)..(259): n is a, c, g, or t
attgcagctcagctgaggagaaggtgacagnccntggccnacggtacagccttgattccactatgacccacaccactgcctgtatgtagncccctttaatatagtcagtctctagatcagttagaatagaaaacagcaagattgggaacacagttaaacaaaccacgtcagcgctggtaagttaattaggaacaatgcccactgataaaaatctgtaatattgttctccgcaacaagttggataagtgatatttgtttntaaaaatcactgcaaaatatttccagtgctgtacaacacaaatttgaaagaggattagtgagttaagccctggaccagggtcacagtctttgaaaagtgaatcatccataaaccacccttagttatatccatggttcaaatggtgatcagctcaggccaagatggtaaattgcacaaaaacccacccaagtaaattag

SEQ ID NO: 599590 - DNA, 392 bp, Homo sapiens
  misc_feature (307)..(307): n is a, c, g, or t
atagtttcccgccaccccacgggggtggaagatctccccacaccaccccctttggggcgtttttcgttttttaatatacacacaccctctccggggggggttatcaaacccggggaccaaaagggtgttggggtgggcagggtcccccattttcccccaaaagcccaaaagggtaaaagaaatttttccccaaacccccccccccccctttttaacagggggggaaaggggggttcaaaaaggtttgtttcaaaggccccctttattttaaagggaaaaaagggggtaattaaacccaggctttggnaccccccccaaaggaaaggaaaaattttttgggccccccttggttttttttttgggggggggccggtttaaggtattagttttta

SEQ ID NO: 599591 - DNA, 909 bp, Homo sapiens
ggctgcctgggcggggacactcagagcccggggggcgggaggaaggcggcatgccccatgactggtgatcctcccgggcgctgcgccctggggcttcaggcgtctcaggggggcatagacttcaaccagctctttggtcatcaccatggattacaccaggaagcaaggcggcagctgtggcaacctgtgtcctggagatgtcatccttggtcgtattgactggtgtttgggacagaggtccatgacttcatgtctgatgcgcagagagaggatgtaaatgcatgcaagtctcatcctagcttgtgtctcataaattgactacggggagaaactcacttatggtctccacaagtagctgaagatgggaaagcccatccgtttcaaatatcaacttaggaatcagaacgcacgaggaattcaaagccatttggtaccgcgcacaactagaagggcccagccttgttgttagcagctgcataggatcattgatggacaaaagacaggtagtgagcgcgttcctataactcgccaattgggctctaattcgaacgtagcaatatacataggatgctgcttcacggtagcagcgtgccggggtctcagttcctagcgtcacctcaaaacgagcccagagcctcggtgtgccccgagtcggaggtgtaccgggatgcgtccacgaagatgcggaatgatgccagcacatgctcgccagtcgggctccttcagagtgctccagggaatggtggacgatgggtctgatggaccgtccggctggaacgcggagtgtggagagctccggtgacggaaagtccatggcggatcaggcggggcacagaggatgccgcgtctgtgaccaaatgtgggagtggcataagttggtgctgggtgaaagggcgggataaggtaccg

SEQ ID NO: 599592 - DNA, 236 bp, Homo sapiens
tccagtacccgagcatgcatgaatggctgcaggtcgacgtgtattcagctacatgcgctgcatgcctccctggactaagtatccggcgagacgtgagcaaccgtgctgagctccaaatatcgttaagctggagcctggtcgacgtgtattcaccactgcggtgcatgcctccctgtactagttccgtcgacacgtgagcaccgtgctgacctccaaatatcgttaagctggagcct

SEQ ID NO: 599593 - DNA, 198 bp, Homo sapiens
gaacccagtaaatatttattgggggagggattaaaggcattgagtccttttcttttttcactcacactcagtgggctagtccatacttttagtcttgaaaccttctgaatattgggatctcatattattatcctgcagacataggtttccacacagctttccccatagccacttcaaattcaacctgcccagcactga

SEQ ID NO: 599594 - DNA, 170 bp, Homo sapiens
tatgttctcgactcgttatacccttcccagtttttgtttttatactttaaaccccgctccttcagggcctgtggccctttctggaagcatgcttccttctttataaatatagcttttggcgcgaaactatagtttttttattagcgagatcccaacaatataatggaagg

SEQ ID NO: 599595 - DNA, 526 bp, Homo sapiens
agtgaccccagattttatttgtcggcgccacctcccgtgtctctttactgaggagacgctgatccagattcggaaacaaatccttttctcatttgaggaggggggtaatagtgaccatgcaggcactcttttaaacaggccacacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaaactcccacccctgatacatgagccagtgattattcttgtacagggagaagatcatttagatttgttttgcattccttagaatggagggcaacattccacag

SEQ ID NO: 599596 - DNA, 269 bp, Homo sapiens
ctctagtggacatccagaccaaaacaaaatacatatttagaacacttgcaagagtatgagattctccagccagtagtccttcttctatcaccttccattttagggcctgcatacttgactctccacttgtttttacttaaaaagtgggctcaacaagcaacataatccagtcttgtggtcaccatggcctaggcagcacagtaagcaagcagttgcaaggttcattagcacaggttcaccagcaacacatgccagtgccagcagtctgc

SEQ ID NO: 599597 - DNA, 252 bp, Homo sapiens
agggagatcacacctgtgctgacacagaagatcataaattctagttctgagtgcagacccatatcaaaggccgggtgcatggttttaaatggaagtaactacttggagtctactcgagactttcatgagttacatctcattattagccttctgtaatgtaataaaacaatcctcaacataactggagtcccctagttgtcaatgtatgccttctctcatggcacagggtagtgtaacacgtcttggccgaaa

SEQ ID NO: 599598 - DNA, 107 bp, Homo sapiens
tatgcaatcgacggtttctctgccgggaagtaccattacagttacagccttggtaacataaccagtggcttcacttcttgtcattgcaaaagcaaaacagattctta

SEQ ID NO: 599599 - DNA, 373 bp, Homo sapiens
  misc_feature (27)..(27): n is a, c, g, or t
  misc_feature (80)..(80): n is a, c, g, or t
  misc_feature (123)..(123): n is a, c, g, or t
  misc_feature (146)..(146): n is a, c, g, or t
  misc_feature (162)..(162): n is a, c, g, or t
aggaatcccatgttaggtttaagtgtncttggaatgttgtgacccctcctgaacattacagcccttgaggcatcccctgntctttgatgtgctgtatataagaaaagagactggcgtggtgtnacgcctgtagtcccaccactttnggaggccgaggcgggnagatcacctgaggtcaggagaccagcctgaccaacatggagaaaccctgtctctactaaaaatgcaaaattagccgggcatcgtggcgcatgcctgtagtcccagctgctcgggaggctgaggcgggagggtcgcttgaacccgggaggcagaggttgcggtaggctgagatcacggcattgcattccagcctgggctcggaactccatct

SEQ ID NO: 599600 - DNA, 666 bp, Homo sapiens
agtggatcgcctgagatcgggagttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaagggtaacatttaaaatttaaaaaaattaatattacccagtatttggttaactaaattaaatgggccttgggtaacaaacagcaaacacacgaaacaccaacaggaaaaacaaacacaatcatgtgtggtgggaggcgcgcaggccgacccccgagaaaaacaggttgtcctgaagacacatgtcgtgtggggggccgcgtgccccaagagggtagaagatgaccacggtggtacacacacggttcacccaaagaaaaaccggcggggacgagcacataggggggtggggaatcccacccacaaagtaaagagagcgacggggggaccacggcgtggttttggacaacaacccgcagagggagtctcgagggaacaaggaggggctactcaagacgggtcacgacgagcggacaactaaaaagcagcct

SEQ ID NO: 599601 - DNA, 1158 bp, Homo sapiens
gccggtgccccattatccccccaaagagggaaagtttgttcgcttgatgggcatttttcctaaacgtctgaacttgtatggatgtgttcgttaacttccgggaaatctgggccttgaaagattggcttacttcctgtgaattttaagggtgccggaggttacaaccccccacccaggtcccacgaaactccatgtgattgttttaacccccccccgggaccaccccaggagatagtttcttttggtgtgtaagagagggggcccgcccggtattttctcggggaaactggacctttcgttgtaagtttccaagaaagaaggtttttggcccttttcccacgagggcgccacctgtgttaagagcctttatatgtcttgaaaaaaaggtggggccacccatatgaaaggttctttgtggtcgcacacatttgccccacgggccacagaagtctttctttgccggttatccaaactctcctatggaaggcgccttgcctcgtttcggcgagagggcccctttcctatttgtgttgttgcctcctccggtttcttacatcacatgtgagagaattgtgggggccacaaagggccctgtacgagaggttttgttgtgtgtttctttgtggagaaacacttcccgcaggagacacaccgagagggggctatataattccactgagaaggtttgtttgtgagatgggcctcgatgtgagattcccccacagccgcgagagagaccctcgttgtatagactatactatacgcttgagacacacttggctgttggcgcccaccgctggtgtggctccacagaacacggggtgttgctcggggcactcacaaggtgtaaagagtcactgcttggccctcgggagccccacactcggtgaaagaattggcgcctcaaagagagccccctcgcctcgagccacacgtggaggcactttgttgagaaccccaagaatgagatatctgcccacccaccccccactctcacgaaacacgaaagggtgggaaagccacgaagccgccctgccacatgccccacgccacgtccccaccacgcactaaaccgggtctccctggcacaactgtaattcctggagtttggatgttgctcttcttaagacccttttataaaattttgtaccaagacca

SEQ ID NO: 599602 - DNA, 1073 bp, Homo sapiens
gggctgccccggggaccctgccggccgctccccccgtcgccccgtgagcggcagcctgtcttgtggaccctgatgccctggtgtctgtctgacctgtgcccgcgccatcccctgctgtctgctgcctgcagtctcgccctccaagctccctgaggactgacgagcctccggcccgtgctccccctcctcgccggcagtgtgagaccacaaggcagagaccgatgtcgaccaccagacagaaaagaaaacagaaaaaaaaaaaacaaaacaaaaaaaaaaaaacaaaaaaaaaaaaaaaaaaaacagagagaaaaaacacacacacatggccaggacacgacacagaagcaaaacaaggaaacagacacacaaggaagacacaaaaccaaaaaaagacaacaaaagaagacaaaaaagagaaagaagaccaaaaaataacaaaatgcaaaagaaaaataaagaaagagaaaatgaaaaaaaaaaaaaagaatagaaaaataagaaaaataaaaaagaaagaagaaagaagatgagaagaaaaatatgaaagaagggaaagaaaaaaataatgataaagaaagaaaagaaaaaagaagagaaagaaaaagataagagaagagaaaagaagaaaagaaaaaattagaagatagagaaaagagaaaaagaaaaaaaaacaaataagcgaaataataaataaaagaacacacaaaaagaaatacaaaaaaaaaaagaataaaacacataacgaaaaaaaatcaaacaagacaaaccaaaaaacaataacagaaatatgaaagttaatgaatagtagaaagaaaaagaagagaaacaagtaggaaggagaggaagaagaacgagacataataaaaaaagagaagagaagcaaaagaggagaaaagacaaaagagaaaagagaacgaataaagcaaaagagaaagagaagagaaagagagagagaggaagcaagaggaacaagcagagaaacgactgataagagacacaagcaaagaagacagaaaagagagagcgacgagaagcagcatgacacttgcgcagtgtcttcaaatcaaaga

SEQ ID NO: 599603 - DNA, 707 bp, Homo sapiens
caggtagggaaccccgttaaagacccactggccctcacagtactcccggttcaagatcaatcgtgatgagacctcaagaaaagatggggacaatctatcatgccttaagaatagtagagagacacacatgatggggaaatgaggaggaaacagaagtttcatggacttcgcttccctggtcaccatttggatggccgctgaagccaatttggaatagtcccagctatttctgtccaggacctgaaacttactaccagatgaggaaaaggaaagcctggtattatccctctggcaccagaatgtttaattccagtagtctagtgcctttgccagaatccaatgcctactattttataatcgccatatatttaaagaaaagccaagacctgagccgaggagaggatgaattcaagtttccttacctgcgtatctactaaccaacatgagacctccctgttaccggtggtccagttggcccaaatgtactaacgggcaccatgaaagaaagacaccagccaaattacccagtgtctccagaaaatgcaccaaaacccatattttgaccagtttatttaatcccgtgtggtagaaaaggcaccattcccatgtatcatttagaattgaatgtcattaacctggctttgttctttggaagaaaccacttctttaaagagcttctttggctctagaaaaatttccaaccatta

SEQ ID NO: 599604 - DNA, 294 bp, Homo sapiens
acaactgtacctgactaccggctccactatagcatatgcgcagcagaatagagagagagggaagtaagagtcagaagcttatgtcgtttctgcggggaaacgccatatcgagggcaccgattattaggggaactagtcagttgccaaagcctccgcattaagcatgggtcattactatgcaagcaacattcattacaaatgccatgggcgtgtgcacgcatacacgttgtcagcatgtggtcgattaccactgtaagcattgcgttggcgtgggagggcatcctctcagcagtc

SEQ ID NO: 599605 - DNA, 378 bp, Homo sapiens
  misc_feature (13)..(13): n is a, c, g, or t
  misc_feature (50)..(50): n is a, c, g, or t
  misc_feature (78)..(78): n is a, c, g, or t
  misc_feature (90)..(90): n is a, c, g, or t
  misc_feature (231)..(231): n is a, c, g, or t
gcaaaaaaattantccctaaaattgaaaaaacttgaaaatgtgtatgttncccttacctaatttttaaaaaaatgtantcccttcccccnggcaggcaaagggtcgtcacgccctgtaatccccagcaccttcaggaggcctgaggtgggcggatcaccctgaggtcaggagtttgagacccagcctgatgaaaccctgtctctactaaaaatacaagaattagccgggcntggtggcgcatgcctgtagtatcagctactcaagaggctgaggtgagattatcgcttgaacccaggaaacggaggttgtagtgagcggagatcgcgccactgcactccagcctgagtgacagagtgagaatccatcttttaaaaaaa

SEQ ID NO: 599606 - DNA, 250 bp, Homo sapiens
gttcgatctagaggatcccagcggcgccctttttttatcaatgtattattcctgaaaaatggtgactgggggaactgggagactgagagggatgagaggattcctgtacattatatactcttttttttttttttttttggaaacagagtcgggctctgtcacccaggcgggagtgcaggggcgtgatctgtggccctatgccccccagggttcaagcaattctccggtctcaacctccggagtagctggg

SEQ ID NO: 599607 - DNA, 436 bp, Homo sapiens
gtgtgaacgctccagtcacgacgtgagaacgcacatgccacgacgctgactagccgtctcacactacgatgttcccaagcgatcctactgcctcagcctaccgaggggctagtactacaggcaggcgtcaccataatttttgtatttttagtagagacatggtttcgccatgttggctgggctggactcgaactcctgacctcaagtgacctgtcctggcctcccaaagtgttgggattacaggcgaaagccaacgctcctgtccaggtaacaactttagaatgaaggaaatatgcaaaagaacatcacatcaaggatcaattaattaccatctattaattactatatgtgggtaattatgactatttcccaagcattctacgttgactgcttgagaagatgtttgcctgcatggggagagtggagaaggccagga

SEQ ID NO: 599608 - DNA, 834 bp, Homo sapiens
gtttgtatctacatttttcccctcctggggttgcggggacagggacagaactacaggagtcatgggaaagaaaattctggcttcactactgctcactgctcactttctgatcactctgatacttttttttttttttttttttggcaaccgtgattacctttgaaaaagctttctagtggtgttcctcctccttttggtggcctgtggcagcgtgtcataggagtgactcacgtgattactatttacataagttagccacatgtgcaaattaaaagtggttgggtaaagtgtggaaaaaaaaaaaaaaaaaaaaaaaaaaaaaaaaaaaaaacaaaaaaaaaaaaaaacaacaaaaaaaaaaaaaaaacaaacaaaaaacaaaaacaagaagaggagcggcgcggcgcccccagaaactatctaccctccccgcgggcggcggcaaccacaacatcactcccgcgcagcacacacgaactttttagataggagaaaagaagggggcgcgcccacaataaagggggaggcggatctataattacaaagaacaacgggcggggggcggaggtaaaaaacaaaacacagtgagaggagagaaacaaacgaggcggaacggaagtagatactagagaagaaagaacaccatattttgtgggggggggggggagaacaaataggagatggaaaaacatctctaagaagagaataatttataagcgcttactgaggagaagatattaatacataatgaagggggtagttaaggtgggtaggcaaaaagagggaaagttagacggtggtgagaaaaaaaatttatgcgaaaccgtagaattt

SEQ ID NO: 599609 - DNA, 869 bp, Homo sapiens
gtctctgtagaccaaacgaatagatgcgctttacgtgtaggttattgaacatgtccatatcgggtctgtacgaggttcgtgtgtatgaaaagtgggtgagaattactctactaagtaatatagtccgggagtacatgctgtgccgattttggaggattacatggtgggattctgatgacagttatgggatcattataatatgaggcacatagtaactatagtgattcatcttaagctctgcagtggaatgtattttcaatttttgccacaagggggagaagttatttttatagtaatatgtacatttttttattttaaaaatagaattcacacaactttacagcatccatgaacattttgctatcccaattatgtgtgtgtgtgcatgtgtgtaaacaagattctgaaagtcttgcatgagaaaaatttcaaaggaaattaataacaaaacaaaacagttttgaagaacatgtgcacagtggacacaggaattgaacaaagtttaccatgattaacattatgtcttcttagttatatatcacatggaattcctttatcaactctaattaagaatctactggattagtgttctacaattctgctttttacaagaaaaattttttgacacaatcagacttaacagaagggtgtaacatactgtacaacataaacttttccctttcgggatgcacgaccacacacacgaacaaaacttttgggggctcggggcctcggaggagtttttgacacattctttggggccggcgccgtggtatggacatggccctggccccggagcccgggccgagtgggggtccaccaaaaagccgggcacgggttgaaccggggcgggccggctaagggccggc

SEQ ID NO: 599610 - DNA, 839 bp, Homo sapiens
gaggcttcgggcggccgggtattctccggtctcccaacgccgtaggagaagcttgtaacaggcagctggtagctggccctgccaccagcgctgtctagggacgtgcgctgagagtccatccgattctccctcagctctctgagctgaggccccgaaccagagatagggggcggtccggaagcctgtgccccggaatggcgaggaccggacggcggggctccctggggctgacgggcgtggagccggcgtccctgggggcatgctggaggcccccgctcggcctcctgctgcaggctgctgacatgcgggtgctgagcggggctgctgggcggcctgggggtgcatccggtacgctggggcgaggtcgcggtctgggagcctcttcagctggggtcgcttggcgtcgaggccccttgtgcgcggtgaggatgccggttcgtgcctagggagccctgactggccggtcttgggcagctgataacccacgtgcttgctgcgattgccccggaatatgcgcacagacgggaaaacctttggattggtccgcttagcatagatttgcgacgacgtaccagtggccacttcgctagccaggaaagaaggtggggagttccattctacagtgtagcattaggaggaattggcgcccaagataggagaagctttaaacgcgccggtatacacccggcaatgccctgggagctccagatggcctatggcgggcagaattaggcatggacgcaagggggcttttggcgtgagcactggtagaccactcagaatttgaaaggggaggcatttcttccagcgtggttgtcgacaaagaatggccggaagac

SEQ ID NO: 599611 - DNA, 196 bp, Homo sapiens
ccgcgtcacgtcttacggctggctaatggttgcacaccaatttttacctgagtacaacaaaagaacgtactccctcttttgcaaagagcaatgcagaacgaacaccacgaaaaccaagaaaagaaaaaaaagtcttaagaggaattatctatctatagttctatttccccgcaagacataaccgcgggggtaccga

SEQ ID NO: 599612 - DNA, 962 bp, Homo sapiens
ttaatttttttatttccctgtacacccccggccggctccagcggaaacattaattactgcaatatgaagaaactagacagtcagacctccaggactaggatgaagtgagccgagaggagatcgtatcataagaatgcttctgtcgttagccgggtgctgtgctgtgtgtgtctagctccagctacttgacaggctgaggcaggaggattgcttgagtccataaagtggcagttgcatttgagtggagatcgcgccactgtttttcagccttgtttggttgagcgagaccctgtctcaaaaaataaacaaaaactatatgcttgtcgtcgtccaacaatctttatgagaggggtttttagtgctttctttctcatcttgtctgtttatattgtgctgactaatcgcagggtatattgacttaattatatctttcttttgttatttgtctcgccccttatacctctaacactctttgatcgtctggtttgtatggtttcttctcccctctcttgtccgtctctctccgtctttcctcgctctacttatcttctcgattactattctattttgtttgcatcgactttattcctcgtcatatcacactattctattccttctcttttttgatttttctatttgttttctctgcctgttcgttcttctttaccttcatcttccatcactttgcaatatgactgttagcgctctcgctctattgtccccccctcctgctccctcagctgtttttctgcatcatgtggattctgctccttttggcggttattcatcttttacgactcattataatgactttatatatttacttagtatcattttatataattgttgttatatctgtacgtttgtagcagtgtttacgttagtagacgcgacgtgtcgactatttgtcggtcgttatacaacctattgtgtttttcctccctgacatgtcagcttcgtcg

SEQ ID NO: 599613 - DNA, 280 bp, Homo sapiens
gacaggcgatgtgaggatttgttgatgtactattacaattggtcaggctctcaatatgaaatttgatgatataagatggattggacctaccaggagggatagtcagagttcagtgtcagaaaatgtgtcaaattctggaataaattctgcagaaatagatagctcccaaattataaccaggcccccttcccttcagtctcttcacctcctcctggcatcaaaaacaaaggaggttccagatggccgagaatctggacaggatctcgtacctcctgatatc

SEQ ID NO: 599614 - DNA, 573 bp, Homo sapiens
  misc_feature (573)..(573): n is a, c, g, or t
tatccggcactctagtcatagtataatgatgactgtaggatcactgatagagtacaaagtctgctgtttgtcttcaatacagaaatcttaactaatatgatttggtctttctctgtgtgctgattggccatggtgatattggctataaggaatattaagcaagatactccttagcatgttttctctcccagggttgtggtggtggaagacaggtttcatggaagttcacagtgattatgtcttttaaaacaactcctaaggattagagacagagagtgccttaatgaacagtattaagatggactgacaagtactggtttaatgctaatctggctcatcattttgggacaggggcagatggtttgcagttgattaaatcacccactcaattcttccccattgagcagccatccaaatgacagagaaataaaggctaggataaggaaatacgggtgaccattgctcttgtattccattaggtaattagcctcagagtggtgtgttcatatatcacactacctgccttggtgaatactgggttttgatatgttcaccataatacaggctgaaaan

SEQ ID NO: 599615 - DNA, 166 bp, Homo sapiens
tgatatcggccgctccaatcgcgcgaggtcttgcgatcccccgctttcatccatagatcgtatgcggtattagcgtaactttcgctacgttatcccccacgactgggcacgttccgatactttactcacccgttcgccactcgccaccaggattgctcccgtgctg

SEQ ID NO: 599616 - DNA, 117 bp, Homo sapiens
gcaagacgctacttcccctatcatagaagagcttatcacctttcatgatcacggcctcataatcaatttccctatctgcttcccaggcccgtatgcgcctttcctaacactcacaac

SEQ ID NO: 599617 - DNA, 278 bp, Homo sapiens
gccttcgacatcagggattctgcagtccaacgtggagcacctacggagaaattgaagacacccatcagaagggctttgtgctcaagaatagaggctgatgtaaaaactacacccagtcttactttacacgctgattacgaagggacaagggcgttttagctacgaagcgtgctggacacataacagcggtggaccctactagaaactctcgaccgtaaccggaccgacttatgcgtgtcagctaccggaccgctagaacctgtaccgccctagggttt

SEQ ID NO: 599618 - DNA, 832 bp, Homo sapiens
  misc_feature (28)..(28): n is a, c, g, or t
  misc_feature (249)..(249): n is a, c, g, or t
tttatttataccactaacaatatcctcncccgaggtccaggatggtgcacaagtgaggcgtctcgcccgcccggagcggggaaccgtagtacggctatatttgtcgtcttcttaccgcgaccctgggcgtgagttcggcgcacacacgccccgccacagccaggggcgacaaagagccaaacagacagagaaggcggagaaatagacgcgcgacgcggcgcgctcgcccccccccgctgcccttgttcntacaacaccgcgactgtccggcggatttccgcagccagggaggggaattaatttaattttttttttgtcatccaatttttctcaaattctcatccaccttgcggtttatgttcgttggggcggtgttggtatgttgcgcgccgcccctgtacgtgcggcgggagcgtgatgtgtttctggtctcgcgcgggcaatataggagcgatgagggcgttctgtgagccgctccccgtggcttgtaatttccggatgtcgagtggagagtaatcgggtgtgagtggagtgataccgaggcttgccgtggctgtaagaagggcgtgttagctgagacccagggacgtgccggagagtgatcgcaggggtaaccgtctagattgtcctgcatttcgacttactatcctggatttagttagctactgtagtgatgcttccccacccaccgctttcagcgttcggaacacgatgagggagaggctcggacgtggtctggcggccggtcccaggctcaggggtcgtatacgcgacctcgtgtgccgtcgagttcgacgctttctgacaagagagcctatagtgatgtaccgca

SEQ ID NO: 599619 - DNA, 373 bp, Homo sapiens
cgtagactggttgctatctctactggttcttacttctcaaaaaaaaaatttttttttttgagatggagtctcactttgtcgcccaggctggagtgcagtggcgtgatcttggttcactgcaacctccactcactgggtttaagtgattctcctgccttagcctcccgagtagctgggactacaggtgcccgccaccatgcccagctaatttttgtatttttagtgaagacagggtttcaccatgttggccaggttggtctcaaactcctgacctcaagtgatccacccgcctcagcctcccgaagtgctgggattacaggcatgagcaccctgccaggcccagcgtctattgattcctatttctaggtcgacg

SEQ ID NO: 599620 - DNA, 110 bp, Homo sapiens
gtagcgccaagccctacatcacaatcaacaacttacaccccagagagaataaggatgtcttaacctatcagctgtaaacctaagagtgagaactacacctacatattggt

SEQ ID NO: 599621 - DNA, 1736 bp, Homo sapiens
  misc_feature (1241)..(1241): n is a, c, g, or t
ggagactccctaagggtgcgttatgctacgtgattgagctcgctcctgctggtggggggtgctacctactctcagagtctatcatgtctactgctaccgcgatgggttgtcgcttgttggtgtcgtctttctttcgctgcctccgccctctctgtggtattaagatgggagggcacgcaacgactgtgttttgctgctctgctgttggtatgcccctcgctctggtggtgtgcccttcgcgagccacactcgtgtgggtgggaggcacatcctcttaaggggggcgtcctctgacgttctcgctgcctgctggatggtgtgtgtgtaggggcggccgtcctcctctatgctctctggcgctctgcgtgtggtttcctgccctaccgagtccgcctgttggggtggtgcctccctctcctttctgggggtggggtcttgtcctcagcgattggtattatgagctaggtggtggtttcgtgtctggttggggtggcgccgcctcctcggccgggttggtgtgtcgtcaacgagcgaggatgtgtgggtggcgtggttagaaagaggagcgtggtctctgtgttgtggtctggttcttctgggtgttgccgcccccctccgtcggttggagtaagatgctgtctcttacgtcatgggtgttgttgttttgttgattgtggttgccccaccgccgtggtgtcctcctcggggggtgttgtaacatttgtgaagagtctttgtatccaccaccacaacaatggaggatcaatacgttgaataagagcccttctgtgcctttttataagatattatggggtgcccctctcctgtcgtattaataggcggggagtagatgctttgtaatgaagaggatgtagtgatgaggggggaccccaacatcaggagagaagaataagatgctgacatcatcatgaggtggttgatctcccgcactagaggtgttgttatggagaggcgttgttgttgttgtttctgtgcgcctcacgacacatataaggctctccgggggttgatgagaagagttgcgaaatgtcttgtgagaaatgttatgttcttcttgggggcagcccccgctcttccctgctgagaaattgggagacactcccctcacagcatggtgtctctctccccttgcgttgtgttgtggaaaaagagtgtgtgcccccctgcgagattttttttccccctcctgatacacacgcccacacctcttctcttctccncgctcttctgtcacacggctcactcgcgctgtgagtgtggccacagcatagagaagaatatatagagacacttgtgtgagagcccacatgtgtgtgctcacacttgggagagagaggagaaacacatgtgttcacatgctctggcgcttgtctcgcgagaaataggggttctcaccccttagacggcgctctgcgtagaggaccaccttgatattctctgttgagtcagtagatggtggctatggaatatatcacgtaatttaaaagcgacccacaaaataatggttaaaatatactctgagaatgaggcgtgtggtaattaaaaccacactaaataattacttgaggagtagtcgtggcggttcccgcggctgaaagtgagattcactgtccttattttagtcctgctttagtcccttgtcaatcttgtggtaattaagcttttcttttttaatacccaaaaaagtgtatataaaatataaacccgtgaaaaag

SEQ ID NO: 599622 - DNA, 224 bp, Homo sapiens
ccccccccccccccccccttttatttatagttgggcgcgctttcctagggggccggggggggtggggggttaacccccccccccccccccctttttcacctgtgttttggggggggggggggggggccccccccttgggttttttcccccccccctggggggggggggttccgcggggggtttgtttttttcccccccgttttttaaaaaaaaggggtttttta

SEQ ID NO: 599623 - DNA, 424 bp, Homo sapiens
  misc_feature (65)..(65): n is a, c, g, or t
  misc_feature (67)..(67): n is a, c, g, or t
  misc_feature (86)..(86): n is a, c, g, or t
  misc_feature (97)..(98): n is a, c, g, or t
  misc_feature (236)..(236): n is a, c, g, or t
  misc_feature (261)..(261): n is a, c, g, or t
  misc_feature (266)..(266): n is a, c, g, or t
  misc_feature (278)..(278): n is a, c, g, or t
  misc_feature (282)..(282): n is a, c, g, or t
  misc_feature (382)..(382): n is a, c, g, or t
  misc_feature (408)..(408): n is a, c, g, or t
  misc_feature (415)..(415): n is a, c, g, or t
  misc_feature (424)..(424): n is a, c, g, or t
atttaaatgagacattccaatatttttgaaatccctaacaatgcttccttgcttttaggattganangaaaggatttcatatcctnccaacattcanngattaaatgtttttaccttagctccagggccccccccccttttacgcttgtaaagtgaagagtgattctaagtcccgtgaaaccgtgggctgcctggggcttggctgtgcccactaacctactgcgcctggggggcancatggaaggggccagttggcatttnattancagtgccaccanggtnggcaatgcataaaagttgcattgccacaagtatgtaaaataaaaatattcactttaagaataataattctacttttttgaataatgtctttttatagccnccattggatttttctgggagtttttncccttanttcccctgn

SEQ ID NO: 599624 - DNA, 134 bp, Homo sapiens
atgtatacatgagatggatggatgggtgaatatatggtagatgatgggtaggtagatgatggatggatggatagataataaatgatagacagatgacaggtgacggagcattgttagaaggccagacgcagtgg

SEQ ID NO: 599625 - DNA, 175 bp, Homo sapiens
ctagaggatcctttttttttttaagaaaaacccatttaattggcgggatgtgggatgaaagaggaggattggggctcggaaattaaagatgcctccaaaaaagagggggctgtggagtctatctcagtgccagatatggtgacaaaaacttaaggtgtcctgaggaagaggacac

SEQ ID NO: 599626 - DNA, 397 bp, Homo sapiens
ggtactggtgagttctcctcgtatggtcgggacaccagctagttgggtgcacacgttgcccttcacccgtgtaaatctggcgtggggatatatacgtcggcgacgggagccggggcaggctcactgccatcagtgggagctggagctggtggaagtgggtagttctccacagctggagggtccttggcctcggtgcctttgtctgtgccggggtgggctaggggaggctcagcacctggcagcggtggttcccccggggccccatccttggcagtaggggtggtggtggcggcagccacggtggcctggaggacactgtaggccttgatgggagtgatgatgatctgctgcagctcctgcagagcgtttcgtaggttcccgccttccagcacaagaa

SEQ ID NO: 599627 - DNA, 148 bp, Homo sapiens
cctcacaagacctgaaccatcaatatgactacacatttgattggacaatgttaaggcagaagcaggaagcaggcagaagcaggaagcggcagaagcaggaagcagcaggaaccggcagcaagcagcaagcggcgtacctgaccaccac

SEQ ID NO: 599628 - DNA, 221 bp, Homo sapiens
gaaatgaaggcggaggttcatgaccgttaattcttgacttcggtgcatctgcaggcttaacaccacctagaacctgaaaggcttggaacttgcaccctctgaagccatggcctgaggtgtaccttggccccttttacctatggcaggagcagctgggatgcagggccccaagttcctaggctgcacacagcagggggttctggacccacaaaaccattttt

SEQ ID NO: 599629 - DNA, 201 bp, Homo sapiens
ctgagtgttacccacgctgttacggacgaagactctaggatctacatgccgacaaatgagccccagagctcttgtactttactctccatattacctccctaacttttctgatgtcacacagctactgaatagtagctctgggataacagccaggtgagtcccattccagaccctgaactgggcgtcctaggtacactttgc

SEQ ID NO: 599630 - DNA, 134 bp, Homo sapiens
tgattatgatctagaggatccctgatccaagtacacgttctcatgctgcacttgaactcccacctgccactgacattttgttcctgtgcgtttccgtagcgcacagcgtgacattgaggatctccatgaccaac

SEQ ID NO: 599631 - DNA, 1048 bp, Homo sapiens
ggtcgcccgggctcgaaagggggtgcggtgcccgcaggccggaggcccggcccgcggcagtgaggcgctctctccttcgccaccgcttgtcttcgttcaggacttgtaggaatgtgaagatttaggatccgacttaatcctgatacatgtacgatgtgcgaatcagtatctgaaagaagagccagatagcgaaaaggacgttgtgttgcaaatcgagtctatcaaagaggagcctacgcgtgggtagtgtgatttgaccaaagacctgtgagagcgacatgaattacccacgttctgtgtcgtgtcgccaaagagaggtagcgagcagccagtttcgcacggcgtcatgatggagttccggcggaaattttatatagcctggctttgccaggtaacatgctcaattcccgatcatctgcgtcaagatgtgctaaattttcaggagtgaaaacatcacacgaggaaggccattaaagcccctctcgaggcgagtccatgtcacagacatccgatactcgctggaactgttattacattgcatcttaccggcgacgggacgaggcatggccgtaaacacagatgccgactgttgacccgtcctatttcttatagaacactgcacaggcaagcgaggactcttaaattacttggcttgaggaatatattcgcacatagttcattcatgttcctgaaaaagctcatggatgagatacttcagaatcagactcatgaagaactcgggagtgcactttttgactggtagactggtccgagggacaccatctgtaaaattttcaagccacgaatatagaaacgaaattcatgcatctccaacaaatgtggcgcagtgcagcagagactgacgtccttcggggttacaacaacctgtgctcttacagaacaatcaatctagtcacatcacatcaataccccaggttcatgggtaacatcatccgatagcaactgcgcgagaacaggaccggggaaccccttaaaaattcctggcacgcaccgtatggtgaagcaccacctgttggcacccaatcca

SEQ ID NO: 599632 - DNA, 126 bp, Homo sapiens
agaagtggacccatctacaggtgaactccagtccctacagatgccagaatccgaaggccaagctctctggacccctcccaggaggacccacaggctgaaggaagctgccttgtacccacatctccc

SEQ ID NO: 599633 - DNA, 906 bp, Homo sapiens
actagttctagatcgcgagcggccgcccttttttttattgttttagtgaagttaaacaaacattgggataccgacacagacaacttgaaacagtttttttaatcttttaattcaggtgttaccctattggtgcgtgcgtgcgtgctcaagaagcgtggactccatacgagggtgtggtggtgccatctgtgtccctcttgaggtttcaggagaatttcataaattgtgacatatctccagcggcttgggagacagtcatccggaaagtttgtcccctagtaatcttataatatttctgcggtattgtagtgtctcacaatgtggttagtggccagggcgccccaatatataagacattagcccaaccaagtttgcggatatcagtggtgggccattaacaatctcataaccaagaccccgagaacattagggcagtctcacttgtgggaggaaaagccgtgatagtggtgcggtgtttgaaacgcgtaattaaaagtttgattgaaaagcaaacaagggggagaagcgaagcgacacattaaaaggcggtgctccaagttgtctagggtgccactcatatatgtgatgatcatcaaggccgcgtgggctttctctcagtgtggcacacaacaggcgtgacacactgcccagtacttgcacttgtccaccggagagccctcttaaactctcagtgttctcacaaaagggggctccacaacagtcgaatgctccgggttgacggggccacaatgtaaaaacgcccacaaatcactggggaacaaactaaccaaaaagaacacaacaaaaacaacagacgggggaggccccactcaccaacaagagaaacacccactacaaaagggcacccaaactgctgtcaagcagcattacccccagagaagtgac

SEQ ID NO: 599634 - DNA, 155 bp, Homo sapiens
atctcaaaaagagagagagagatgtaatctacataaaattcacacgttggaagtgcacaatccagggtttttaatgtgttcacaaagtagtgtgattatcactccagcctaggcaacaaggcaagactccatctcaaaaagagagggagcggtgg

SEQ ID NO: 599635 - DNA, 492 bp, Homo sapiens
tactttttggtatgaattggccgtttgtggtaaaacagagagcccttctactaaacgaagagaactctagcaaatttgtgactaaccaatggatcattattttcgccacagcctttctctctagtttaagggactttgtccttcatcactgcatcacgttcttgtcatacccttcctatttttctatgataaacaagtagctacgtctggtttgtcagtcaagcaatacttaattctttctaggggggggattttttttaattcagcttggggcatgcttgtataaatatccgtataagtctaattttcccgtcctagtagtgtcatgtccaatagtgtttttatcctgcccccttctaccctcccccttgagtcttagtgtccatatgcccctcgtaacccttttgtacccataagttagctttcccttataagtgagaccccccagtattgtggttttccattcctgagttgcttcacttagaataatat

SEQ ID NO: 599636 - DNA, 900 bp, Homo sapiens
gggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgattcagatctgtgcagacaacactacaaactgatgaagttaaccctgtgcctcgatggaacaagctggtgcgggtcatgcatctatattgaccgaatagaagtggtcaatatgtcggctccttatgcagtgtttgatatcgctgcaggaactatactgcagatcatgacaagaccttaatcttcaataaaatccaccatgagctgaaccagttctgcagcgcccacacacttcaggaagtttacattgcaactcgtcctgaagcagcagcacgcattgcacccagtggcacccaattcgcgtttcacgcacacccgctcatggcccccgcacactgacccagcgcatccctgaaactcgacgatgctgcacttcctggcccgagagaaagcgaaagcagatgctgactatcatgctgcacacaacctctgcacctccaacaagcacaagttgacccggcaatatctggagcctcaaaaagtaccaggccgatgcttctaacacgtaagatctactttggccagcacaattcctaaccctgttccatgactccataatggtaaatggaaaatataacacacacacgatggcaacacaaagcatactcccgacaacgacagatactaacccccgttacaaaacatacccagacacaaaaacacaccaccagtaaatactctacacgacaca

SEQ ID NO: 599637 - DNA, 172 bp, Homo sapiens
  misc_feature (24)..(24): n is a, c, g, or t
gtcgacgggatgtcctatattttncagggatcactgaaagtacacaccatagggctggcaagatgggggaaggtgctcgctgccaagtctgatgacttgaacctgtgtggtgggacagaacagactcctgcgaattgtcctaggacctcgatgtatgctgtggcaatgcttt

SEQ ID NO: 599638 - DNA, 861 bp, Homo sapiens
ggggtccccagtcgtgccacctcacccaccgtcaattcatttagtacgcatgtgcacaggggcagctccggcacggctttctcagtgcctatgccggagcctcgacgggctggaggcagcgggaagacatggcagtgctcgagggagtgcagcaggacatcaccaggagggcgaagcggccacgggaggggtggcccccgtgggacatttgcagcaggcactggacggcttgcaggtggcgctctggcccttggctgtgtgccgccgtgtgtccccacgaggggcacttgggggggcccagggggtcgtgggttgctgagacgaagggggccccaactagggtgggaaccttctgtgttggacgtgcttgttatttgcccccttgcgatcgcgggctcctagggcccccccttgggtgtgggcttggggctttgggccgcaatggaatcggaggctacgagggctaactcccaatgggggcgaacggtcctagcatgggcgcaatagggtcgtgcccgtatggacccagatggaaccttaagggcccgcagcggctggtggtctcggagtgttgctaccgagcactggttggacaactttcgactggccgtaccttccaaagcggaacggaggggaacggccgcactttgggttgggccacagaggccatggggcgctcgtacgccaagtgcgagagccggacaacgcactgtggggcagcagaggcagaaaagccctggcggcaacagtcgcacaattagtggttgcccctttcaccaaaggaaaacgaccccacgggttggggccaccaaatagagtgcgccggcgaggcgcaccctcctcgcagcgaggagcacccgg

SEQ ID NO: 599639 - DNA, 130 bp, Homo sapiens
  misc_feature (38)..(38): n is a, c, g, or t
  misc_feature (90)..(90): n is a, c, g, or t
aattcaacgcttctaacagatgtacggggcacatgaanaacattcctcctcccgcataacgcctgcgtcagaattaaaccacttgaactngacaatttaacacgcccacatatctacatatcaaccaaca

SEQ ID NO: 599640 - DNA, 129 bp, Homo sapiens
  misc_feature (94)..(94): n is a, c, g, or t
tgcccccctttgccagggggtaaaaaaggacaaaggtttttttgtggttggaaaaggtcctatttcaccccctttttcctgtcaaaagaccccncccccatgttttattaaaagggggggtgggggtga

SEQ ID NO: 599641 - DNA, 130 bp, Homo sapiens
gactgcatcaacgcgcattggtagagtgctgcagaagataggtccttgtaggattgtcgtactcaaggaatgctcacttcatgtccctctgtctccatgtccagtattccagacagcgctgtgctcagga

SEQ ID NO: 599642 - DNA, 1504 bp, Homo sapiens
gtgcaggctgaatccgttcaatccgtggccccactgtgtacagttcagagttgtggtctcacaagccacccagacgaggcggccaagtggatcaatcgcagtgacggtcatcaatcttaattctcgaaaacgatgaaatcgagaatatctacttcttataagagaagggttccagtatggagtccccatagattacttgagttcatagcgtacgcgctcatgacttcaattgttactgcgtagagcagcgttgggagagtgtcttcccatgctccccactgtgtccttggtgagacctcgattgctcagaagcgagtcctaattgatatgtcagtaaagtgaactggcagtgaatgacgaagcgttagggacaccgtggtatcgcgaagtaattactggcgttctctcgaggggccacgaggcagcgtgggtatcagagggggagactggggtatcccactcacaagcagagaagtggcgtgaaggcacagatggcataggcagagacgggccatttcgcccgtcactttcgagttgcataaacttcactactatgatggggaccatatacacactccgtggtagagcggacgtattgggagaaggctactctaagattacacttctctcccaatgcacccgatttagttcacccattaaatagaagttttggcttaaggccctggtgggtgaggaaatccagatccctccttaggttgacatcccaaggtgaggtggatccacgaagacggaatacccaaggaatgtttactgccccacttttccggttgagcgtttctatactttctccattacgtgtggctttcgcggatcgctcgtgcttatcaaggaactaacctaacgattagaggacatagagataaccgtcatgtacacaggttgggacacttggtcccagagagggaacatttttgccgatttttgtcccccaaattaagtccctttcgttgacttggtagttcgaacgacttcctggcgaatggaaaccatggagaagcgagcaaattccctaagggtgccaaggataaaggcgtccaagcaatcccccacgcgcaaatgcgaacaaattatccttccaaggccccttttcaagcaattggttgcacacgggaaacaaacagcaggtggtctgtgggttccaaaggggcaaaacgggcttggctttggaacattttccccaattttctaatgagaatggcccacacttaaagagcacaagggtttaattggaaaacggcctaagggaaagccgcgtcgccattgtacctgggtggtggtacaaccatggtgagtttcactttggggtgaacacacgcgattattaacttggattcaaccctaagacgtggggtgtcccaaagaggaaaggtggaacggaaactggaataacactttcacaggtttcagaacattcctttaaggtggggccacgcgacttcttgacttgattcccaacacacagcgggagagaaaacagttctaa

SEQ ID NO: 599643 - DNA, 286 bp, Homo sapiens
ttaggctgcccgcccagatttccatccagacaagatagtgcgcgtgatacactacccccattgggtcggtttcagcgtagcggacttcgactgtttttcagctactttcaacgtcgttcccccattcgtttgttgtttcttttatcttatcatatcagtgggaatttgtcccacgaagaaagcgaccccatcgttggggtcgctttcgtttatctatagccgttttcccttgctctcgcttcgtctttaatttcttcgcgcatcgcagcaattgctggttccgctg

SEQ ID NO: 599644 - DNA, 304 bp, Homo sapiens
ccaacccccccctttggggtttttggttggggaaaagggggtttttttttgaaacaggggccagaaaggccaggtttttaaaaaaaaaaaggaagggaaaaaaaaaaaccccccctttttaagaaaaaacccaacgggttttttaaaaaggtttttctcccccctttttttttaggtttttgattttcaggcccggggggcttttaactcaaactggggagacaaagggggttttggttccgaaaaatatgaaatttggaaaggttttatttgggaaaaaaaaaaaaaattcctttacccttta

SEQ ID NO: 599645 - DNA, 761 bp, Homo sapiens
tggagggcctgagagtcgctagtggaccatgtagaatgttgcagagtatgttgtacagagctctgtatcaccaagcccggaagagtcagagatgtatattggaaagatttacaattccatctacattggttcccaggacgctcgtcatagcgacattacccaagaatcgtacaacgatgagtaagaacacctatattcgttatgaacgttgagctatatcttagtagattcgattgtggatacgtcgtgtataagtgcacagctacttcacaccttaaacttgcttggatttggtgatgtaaagcttttaaacatatgcagatcaggtggtagaacgtgggtcatagaggaacgagctaggaagatccagtagcagtgacttcttgaagagtagacctggtcttggggttttggagtgtttaagagcatgtaaagtgccaggtaggtgaagcgaaggaagcagcaggtggagttatagtagcagcgtagtagcgtgggaggggacttttcgagtttagtgaagttcagtcgtgttagtggagaggactttaggagagcgtcgagtatcgcgtgtggtgggttcgtaagaaagggcgaagagtgggtgtgtagatgtgggaaggagaggagtagaaggcagtgtgtgggtggatagcagaagagtggcttaagaggggagaaaggaggaggggagagggggaggaggagagtgatagagaaggaaagagggagagaaggagaagagaagagaagagagggag

SEQ ID NO: 599646 - DNA, 144 bp, Homo sapiens
tgcccccggttgcctgattgggccccatgtggaaggcagatgcatgctcactctgtcacctgtgcctctcagaacaccggcagttaacgttcaagacattccacatgttaaaattatttattttgtaaggagaggttttattta

SEQ ID NO: 599647 - DNA, 276 bp, Homo sapiens
gttactaccagacaaccttagccaaaccatttacccaaataaaggtataggcgtatacaattgacacctcgcgcacataagatataggtaccccaaagggaaaagatgtaaaaacttatatcccacgcataaatatagcaaaggacctatccccctataccttcttgcataaatggaattaacctagcaaatatctttgcaaggggcaaccagagctaagacccccgcaaaccagacgcgctacctcagcaccacctatagcgcacacccctctat

SEQ ID NO: 599648 - DNA, 728 bp, Homo sapiens
ccggctgtataaaggcccgaaatacagtacagtacaaaaagtatcctacttatgcagactcaataaatagtcaatttagtacagataaatataggaaactactttaaataattggacaaataagaatttcagtagtgtcactaacctaataattaagtagcagcacaccacaaccacagcaagtaaacactaatctcctctactgccttatattaggggtctatttccagatcacagagagctaaattatacagggataaaccactgagtttcaaaccaaatctctagaaagttcctattatatatagagttttagaaatattacacaaatagcatacacctaacaatatcagtaagagctagtattttttacttaactacttccactaactcagaatttaaaataacacatatagtaatagtaattacaaatatattataaaacataaggtgtttgtacttaaaattgatataaattggcatattgaaaataacaacaaataggagtaaggatagtataaccaaaaaacaataggagatttaaagagtaataataagaaaagcgattaaataggttaacttagaaaaaggcaacagagattcacaaattgaatacaggatacaaattataaaaaaaaacctgctctataaattaatccagtagtatagtaaagtgcataaagttttagaagaaaagaatatttaggagagaattaccaaaacttgag

SEQ ID NO: 599649 - DNA, 110 bp, Homo sapiens
cggatccccctaaaaacttcccgcgcagtccggtaggccggataggcgtttacgccgcatcggcagtcgtgcgcagatgcctgatgcgacgctaacgcgtcttatcaggc

SEQ ID NO: 599650 - DNA, 323 bp, Homo sapiens
cgcgcatcttctcccatcagcttctcactcagcgcatggtaaggctggtcagaggcttcctgaatgaatgaacctcgaggactttgccccagacactgggctgctccatcagtgcgctgtcgttcgtgggtcttaaagttcccaagcacatccttccttctctgcctttcaatggaaggatcgggtggagagcgtggcaagcctgaagactgggagggggtagttctagcctgatgggagaagactgcgcgcatcttctcccatcagttttctttagttctcattacatctgtccaggctcttctatcagcatcaatcctttc

SEQ ID NO: 599651 - DNA, 736 bp, Homo sapiens
  misc_feature (143)..(143): n is a, c, g, or t
  misc_feature (165)..(165): n is a, c, g, or t
  misc_feature (268)..(268): n is a, c, g, or t
  misc_feature (309)..(309): n is a, c, g, or t
  misc_feature (314)..(314): n is a, c, g, or t
  misc_feature (331)..(332): n is a, c, g, or t
  misc_feature (362)..(362): n is a, c, g, or t
  misc_feature (381)..(382): n is a, c, g, or t
  misc_feature (387)..(388): n is a, c, g, or t
  misc_feature (422)..(422): n is a, c, g, or t
  misc_feature (425)..(425): n is a, c, g, or t
  misc_feature (434)..(434): n is a, c, g, or t
  misc_feature (438)..(438): n is a, c, g, or t
  misc_feature (441)..(441): n is a, c, g, or t
  misc_feature (475)..(475): n is a, c, g, or t
  misc_feature (486)..(486): n is a, c, g, or t
  misc_feature (488)..(488): n is a, c, g, or t
  misc_feature (494)..(495): n is a, c, g, or t
  misc_feature (498)..(498): n is a, c, g, or t
  misc_feature (521)..(521): n is a, c, g, or t
  misc_feature (531)..(531): n is a, c, g, or t
  misc_feature (533)..(533): n is a, c, g, or t
  misc_feature (535)..(535): n is a, c, g, or t
  misc_feature (556)..(556): n is a, c, g, or t
  misc_feature (582)..(582): n is a, c, g, or t
  misc_feature (584)..(584): n is a, c, g, or t
  misc_feature (600)..(600): n is a, c, g, or t
  misc_feature (605)..(605): n is a, c, g, or t
  misc_feature (612)..(612): n is a, c, g, or t
  misc_feature (623)..(623): n is a, c, g, or t
  misc_feature (628)..(628): n is a, c, g, or t
  misc_feature (636)..(636): n is a, c, g, or t
  misc_feature (638)..(638): n is a, c, g, or t
  misc_feature (640)..(640): n is a, c, g, or t
  misc_feature (678)..(678): n is a, c, g, or t
  misc_feature (680)..(680): n is a, c, g, or t
  misc_feature (687)..(687): n is a, c, g, or t
  misc_feature (689)..(689): n is a, c, g, or t
  misc_feature (692)..(692): n is a, c, g, or t
  misc_feature (695)..(695): n is a, c, g, or t
  misc_feature (701)..(701): n is a, c, g, or t
  misc_feature (704)..(704): n is a, c, g, or t
  misc_feature (709)..(709): n is a, c, g, or t
  misc_feature (717)..(717): n is a, c, g, or t
  misc_feature (720)..(720): n is a, c, g, or t
aaaaatgtggtggggtggggtcaattccatagtctatgacctgattcggtaggcgactgaaaaacatgtacaactcttaaaaaaagggaggaagaactcacacttaaccaagcaaagcaaggacaccgtgttgacatacacangtttcggttaacatggtatcanggaaagcgaggactgcctgtacttaaaatgatcattaagactaatgattctacgttttggcattgaggatgaatgcagatatatcgacataatgtatagcaangaatatttaccgtcacatttcatggaccaataaataacgcntttcnttctcaaaatgcccaannaaaatgtgggagagaaaatgttcatttatnttcaagattaaactttctnnctttnnatcatcagacttcagctgtaaatttatttcagtnganaggtttgangacntantaatgaatattctaaaattccggaaggtgtttanaagataatttnancctaannaanaaatcctgcctagaagtgacatnataagcattntntngagcacctactatgtgtcatngtgctaggtgatgtactacgttattncnatactccggtcacgtntcgtnctctcanttctctatcanaacgntacatgtnantntaactatatactgtacgctagttattatcataagtggncnaagagtncntancangagggnccngaagnactacctnttnctatcgtaagatctgt

SEQ ID NO: 599652 - DNA, 721 bp, Homo sapiens
atggttagagaaaactgaagacggcacccccatgggagggagacccgaagggactcagacggagccccgtgtggcagcgcctgggtgtgggcccactttggggacccaaccacaagactgtggtcggatgagtgcccggacccggtgtaccgggacacgtgggagtcctccccagcctgaagcttgactgacccgaggaaggtcctcaagttgtcgtgcctcgtcattctcggatggctgtgaggcattccttggccagggacgctgcgtacccgcggtcctcaccgcatctcacctggcgtcctgtgaatgcatgttgtcgctttcccccccgggagtctccctctctcttcccttcctgctgtcacgtaagagatcacatgtctgtgtagtgtgaatgccttgtcgctgtcctgtgcttttgcacccttgagttgagctgcctctgagagagcagcacctaggcctgttgagaatgccatgtgctgccctgagatcccgtttccagaatgggcacggtataacgcacgtgtgggagaaggaatgtgggatgagaaacttggtggttcaccgctgtactatttgtgtaaatgtttacgtatgtgataagctacatgtatgtaatgttgccataccccttaccgtcgagtagtagtctcccttaccgggatttttgacggggttcctcatcatccatacccaatcatatatgtaggatgga

SEQ ID NO: 599653 - DNA, 673 bp, Homo sapiens
cgctctcgccatgtttccagactgagagcctcgggcgcggagacgctgttggaaggaacgccgatatggctgatcagggagagccccaggtccagttcaaacttgtattgcttgctgatgactgtactggaaaaacgaccttcgtgaaacgtcatttgactgcagaatatgtgaagaagtatgtagccaccttgagtgctgaggttaataccctagaggtccacaccaacagaagacctatctaagtgcaatgtatgggacacagccggccagaagaaatacatcggactgagagacggctattatatccaagcccagtgtgccatcataatgtttgatgtcacatccagagttacttacaagaatgagcctaactggcatagagatctggtacgagtgtgtgcatccacatagtggagtgtggcaacaaagtggatattaaggacaggaaagtgaaggcgaaatccattgccttccaccgaaagaagaatcttcagtactacgacatttctggcggtactacaactatgagatgccgttactatgactagctaggaagcacattggagaccctaactctgtttgatgccatgcatgctctcgctccagcagacattgtcattgacccagcttttgcagcacagtatgagcactacttagaggctgctcagac

SEQ ID NO: 599654 - DNA, 271 bp, Homo sapiens
cctactttgtctgcttttctttatagtgaaacatctagaaagttttacttatacttccttagttccttatatccttttcattcacttcccacttcagttttgtctttgtcctcatcactacaccaaaatcacactttgaaagttacaggtttgcatctagacggtctattgtgtgtttctgtcccatttcagagtatctcagcattctacagtgttgatttcctcatcctgcagctgtcacctcctttggctgtcatgcttccctggtgta

SEQ ID NO: 599655 - DNA, 103 bp, Homo sapiens
ggcacataccaaggcacacacaccacctgtccaaaaaggctacgatacgggataatcctatttatacctcagaggttttttcttcgcaggattttctgagcct

SEQ ID NO: 599656 - DNA, 112 bp, Homo sapiens
catattctttattcgtttaattcctgttccattggttctttgaaaggacaaataatattgatagtaccattaacaagattaaccaagaaaagaagagagaaaatccaactaa

SEQ ID NO: 599657 - DNA, 194 bp, Homo sapiens
tttcttacgcgacatgatgtttctattcagtatcctccctctggccttgcctatgaaatgacgaaaaatggattggatcctgaagctgcctgcgggctgctctccagacatgatcctgcaggcatccctgcagacaaggtcattagcctgacagcagggacatgaacatactgcttagcaagctgtgatacctg

SEQ ID NO: 599658 - DNA, 750 bp, Homo sapiens
cgggggctagagtccgccgagccggacgtgtccgcggaagatggcggggcggtagcatgcaagcggaaagatgtcctacagatgaattatctttaaccacatggtgcagttgtgaatgaagaaggatttgccagtctggccagtcgatgtgattgtgaggacctcatcccaatcacaggtacacatttacactgaatgacacatccatcggatggttccagggagcattggcattcagttaacctcagagaaaatgggctgggcgtttctatcgggcaagaacatacgaagtctccttagtatacacttgtgacaaagcacaaacagtgtattggcacgaatgaccatcgagagttgattctcctgcagaaaaaaagcattgactccagcccttatgacaccgacaagatggcacgcagaatttagttcagcaagttcaacagaccaggccttctcagtgggacaacagcttgatctttagcgttcaatgaacagcttttctggcttactggtgaaggaccattgaagcccatggatcctagcatcctgaagggagagccgtgcgatagggaacaggcagacacgatgacagtaggactggttggttggaaacagttcaagatcgccatctgaccaacagcagaacgattcgtcactgacttctactggcaaagctacaaaccaaggaccgtcgcaaatcaagatactcaagtctgactggaacttgacaagagggcataggaggtgaca

SEQ ID NO: 599659 - DNA, 106 bp, Homo sapiens
gtttcgaagtgtgcggcacatgatctatgaccttattgattggcgatcacaaatctttcttggacctctgcttatgatgatcttaagaccttagaggatggctaca

SEQ ID NO: 599660 - DNA, 224 bp, Homo sapiens
ctagaggatcccaagttagtcgggacgaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtcttttttttttttttttttttttttt

SEQ ID NO: 599661 - DNA, 611 bp, Homo sapiens
acacatcctgggcctatggcgaggacgaacgggtgcgacgccgcaaacgcataaatgggctttatggcgcaacgggtgccccgtggacattacccccatagggtttcatcttcaggcattcttgggttttttgggagcaacattgcggtactggcacatattttcttagacaagactattatgttcagagagtgcttgattacactcgcccttctataggcaccccacaataataagaaccatctcgtcgtcgaggtcgtggtcatcgccccagagaatacccccccgggtagatgcccaacatatacaactatagggaaagatgggatgcaacgattaaaggaggaagttggatacttgatggagtgcttggggattcacacgggaggaactccacacgtggcacacaattctttacgcgcccacaaaatccttgttggtagccataaagaacggacacacactctctggggtgggtagcatctggtcgccgccaatatcatcctcgagaatacatatagtgggggaagttgcggccgacttacccacgatggataatgggttctttttaaaacaaaaaaaagggattcccttcccccgcgtacaaaaca

SEQ ID NO: 599662 - DNA, 171 bp, Homo sapiens
ctagcctcaaagatccaagaaacagctgtttgtggggcagccattggcactcatgaggcatgacaatgtatagggctggacttgctcgcccaggctggtgtggatgtaggggtttgtggactcttcccaggtgcaattccactcttccagaatcaatcatgatcaatgtac

SEQ ID NO: 599663 - DNA, 165 bp, Homo sapiens
gtgtctttgctgagggtcacaattgagctgcaggttgaatcccgggtgcccttaggattcagcaccatagcgggagacatgtagacccaaatcaagagctacaagacgacccctttgacaacagcgttcccaccagagcagactgaacatctggagactaccatg

SEQ ID NO: 599664 - DNA, 561 bp, Homo sapiens
ccatgtatgtttgtattcattattattggacatttctatcattccgcgtttggctattatgaagaaactatcatgagcatccatacgtggcaggccaggtctcactaacacaggcctccctaacaactgtttcagtaccgactgagtggttcaattaaatattaagaggaaaaaaaaaaagaagccagtgcccttatacaaaggctggaatgtaacaaaagcccaccaagagtttggcctaggttttccctgggccttaaagcatgacgaaataacgaaggcattcttaacaggagccatttagtataaaacgagttttatggggggtctgaagaaactccccaggcctccacaaacaagtttatggcagatctgaagggactctccaaacctctgtgatttagcaggagacaagataagggcccccagcacctagacccatttagattaactgaatttaactgaggtcccagaggaaggtcttcaggactcagacttatagattaacagaagttcatcatttatgtatttagatgaatgcgcccttccacatacacatat

SEQ ID NO: 599665 - DNA, 252 bp, Homo sapiens
gggaaacagctttcgcaacattgcaaaggcccaccccagatacgagtagagcagccggagcatgcgcgtcttggattgttcgccgttcgggatagaatgaagccggggcgaaacagatagaccgcgcggaatcccaggcgctgtagcgatgtttccgtcttgcctttgacacgcgcccacatgacggggcctcgttcggtggaatcggtgccgccgcctgatacgtagacgaacaccatggcggcgtgacgg

SEQ ID NO: 599666 - DNA, 644 bp, Homo sapiens
  misc_feature (577)..(577): n is a, c, g, or t
gctgctatatgtgttgaatctaatatagcagttcacacgatggtacaatctaacagcactaaatataaaattaactacgatactccaaataagaagcaaagatgatcacataggattcatgaagtctcagataacaacaacagtagcaagtagcagaaattaaactgatgtggaacaaagatagggtgaaggtaaaacgataccaaaagtacccgcatgccatcactaactgaagaaagagcttccacagactaactaatatcagacacgtgtgtactgcaggtggtgagcgatgtcggaggaagagaggcatttcataaccacccaaatgccgtgcaacaggtagataaaacaattatcaataagagagcaatccacttcatataatattcaaaagtatgtgaaccaaaaagttacagaactaagagacagactcatccagaagcgcagactctcaggggccgctgacccagcgttcctacttctggatctgtactcaacagaagtgtgaatacatgcacagcagaaggaggaaagaagctttcattgtaaaagcctagaattcagaatgtacccnatgtccactaacaggagaccggatacatgaactgtgggctattcatatcataccatattatatacga

SEQ ID NO: 599667 - DNA, 963 bp, Homo sapiens
  misc_feature (697)..(697): n is a, c, g, or t
ggcggttttcctgcctcagcctcctgagtagctggaactacaggcgccgcgccagcactcccggctaatttttttattttatttatttttattttagtagagacggggtttcaccgtagccagaatggtctgtgatctcctggactcgtcattccgcccgcctcgtgcctcccaaagtgctgggcttacaaggcgtgagaaatgcgcctggccatatactacttttgtgtaaatacctaggaatagaatggtttgtattacatggaataattggttttaaaaaaggtgaaatgagagagcgaaagtagaatatactcaccccaaagtttgcctcagagttgctggaggtcactcttattctctcatgttgctcagacctccacttcaagaacagggacaccacattgacattgtggtgcaaaacctggacaggaaagattccttcaggagacttggtaccctgtcctcaatcatcactccggggaagggcaattccacctatgacctgtgggtcctcaagaaccccaccagggccaagggaaacatttttccaccaaattgtgcgatatccacgtatggtcctcatttgacaaaagacaaactgtggagctggctataattggtttcatgtggaccaacaataattactttcagttgggaaaaccttttctccaaaacaaaagcttcaaggagaggncatccaaatagttgaaaaatggcttttccaagcaattatgtggtttcctgaagcaatcactgggaggttccaagtttggcatttttcccctgtgggtgcccggggaagaatggacaagtttgaggggaatttccacaacaaggaggaaaggacatggggcggtgcaattggtaagaatgccagtttaagtgtaaacgcagggcgaaaatatcatggcatacatattggagtgttgtggaatggcaaatggatctaaatgggtatag

SEQ ID NO: 599668 - DNA, 156 bp, Homo sapiens
  misc_feature (111)..(111): n is a, c, g, or t
  misc_feature (138)..(138): n is a, c, g, or t
gtgcagttgtcgtgagtcactggcgtcttcaccaccatggagaaggctggggctcatttgcaggggggagccaaaggggtcatcatctctgccccctctgctagatgcccnccatgttctgtcatggtgtgtgaaccnatagagaagtatgacaac

SEQ ID NO: 599669 - DNA, 469 bp, Homo sapiens
acgagtagagcttactaagtggcaggtgtagagacccggtgtgacggtcatgttcctcgagaatctttcccaggcctcttcttcctagagggattacgggagagctcccctcttagttggcagtttctccggggcaacattatccactcacacccttggctagggccagtgtgcccaggaatgctacatgtgagacccagacagcctcggatgagtccaacacctctacgggggtatccacacatgtccctccatccccaactcagggaacggcacccggccatggccacacacagagccggggagccaccatcagctcctctcttaaccctacagccaagggctaactcctaatatcaacccagaccttctctttaccccatgccagtcctggatccagaccgtccatggcctcaggccctccaccccacttctaaccagttctccttgcctcctggatacctagcac

SEQ ID NO: 599670 - DNA, 134 bp, Homo sapiens
tctcgtattatcgactgtagtgtgtgatgatggtgctgtaatagccactgcactccagcctaggcacacagaaagaccctgtctcttaaaaaacaaacaaaaaaatttatttttcctttttaggaaataatgat

SEQ ID NO: 599671 - DNA, 134 bp, Homo sapiens
ctcttccttcttagttcttcttcctcctctccttcttctcttcttcttctccttcttcttccttttcttcttttcttcttctcctttcttcttccttcctcttcttcctcctctcccccttctgtcgtcttctc

SEQ ID NO: 599672 - DNA, 676 bp, Homo sapiens
  misc_feature (79)..(79): n is a, c, g, or t
  misc_feature (157)..(157): n is a, c, g, or t
  misc_feature (196)..(196): n is a, c, g, or t
  misc_feature (497)..(498): n is a, c, g, or t
tggctgtaggcccgggtggttgctgccgaaaggggcaagttcatgaaacctggggaaggtggtgcttgtcctggtctgngacgctactccggacgcaaagctgtcatcgtgaaaaactattgatgatggcacctcagatcgcccctacagccagtgnctcgtggtggctggaattgaccgcatacccccgcaaagntgacagctgccagtgggcaagaagaagatcgccaagagatcaaagataaaatctttggtgaacagtgtataactacaatcacctaagtgcccacaagggtactctgtgggatatatcccctgtggacaaaactgtcgtcaataaggatgtcttcagagatcctgctcttaaacgcaaggcccgacggaaggccaaggtcaagtttgaagagagatacaagacaggcaagaacaagtggttcttccagaaacgtggggtttatagaatgcttggtttggactcattaaacttttaatagaannacaaacaaagagaagaaaaaaaagagcggagagatcataatattcggggtgggaacaagggttaattgaaggggagagtatatagttgtttggaccggtttttttgcaaagtggaaaaagcgggacacccatgaggagggaaaattgaaataccggtactttatgtgcgcgagaagta

SEQ ID NO: 599673 - DNA, 551 bp, Homo sapiens
  misc_feature (127)..(127): n is a, c, g, or t
tatgttcttgtaatagttggcatgtttctggttggatagaagctttcctgtgtaggagagctgatgctatggcagtagctaaggagttataagaacatgtgtttcctttatggggcatctctggaanaatctccagtgacagaggaactcattttattggacaaactatgaagcagctaaataaagtgttagaaacacagtggtactaccattgtccctttcaccctcagtcttctggaaaggtcaaaaggacaaatattttaaaactaaaattggcaaaattaactgaatcgattggattatcttggccaaagataccaccattggctttgaatttcatttttttctgatctctgaagaagaaagccaaccattgcctttggtcagcagatcagatccattcctacgacagacacagattgacccctatgaaatagttactagaaagcctgtgctcctaacagaacttcacgtagttcctactctcctaaatgctgatgccactaaatactacaaagctgtaaagcattctgtcacgctgtattttgaca

SEQ ID NO: 599674 - DNA, 414 bp, Homo sapiens
  misc_feature (401)..(401): n is a, c, g, or t
caggtgttgccaatgtgaagataatgagaggtgggacctttaggaggtgattaggccatgaggactcctccatccttcatgggattaaggcccttataaaagagcctccacagcttgggcacggtggctcatgtttatagtcccagcactttgggaggccaaggcgggtggattgcttgaggtcaggagtttgagaccagcctggccaacatggtgaaaccacgtctcacgtctaaaatacaaaaattagctgagcatggtgtcatgcacctgtaatcccagctaccagggaggctggggcaggagaattgcttggacctgggaggcggaggttgcagcgggctgagacggcatcactgcactccagtctgggcaacaagcgagactggcgataagcagtnctccgtctcaaaa

SEQ ID NO: 599675 - DNA, 855 bp, Homo sapiens
  misc_feature (193)..(193): n is a, c, g, or t
  misc_feature (224)..(224): n is a, c, g, or t
  misc_feature (234)..(234): n is a, c, g, or t
  misc_feature (263)..(263): n is a, c, g, or t
  misc_feature (318)..(318): n is a, c, g, or t
  misc_feature (321)..(321): n is a, c, g, or t
  misc_feature (323)..(324): n is a, c, g, or t
  misc_feature (329)..(329): n is a, c, g, or t
  misc_feature (577)..(577): n is a, c, g, or t
  misc_feature (767)..(767): n is a, c, g, or t
cgtatgctgagatactcacgccggatctcgcaccggaacttgcgagcgacatatgcggtcaacgagggcacacatagtacatcgcaggtattctttttctttgattgagtctccacttcgttgtgtcttattcatatgagttacttgtttaacgacttcgaacacacgcatcttattgacacacgaaatactntttgagcacttttacaacacgaagcaaacgntgcagtgccnttttttgtataatatatataacgcacttnttgtcgtgtcgagagaacatatgtggacgccttctcacactcctctaatgagacnganannagaanatcataaggagcgttttcacagtccattttcctggccacgcgacaaagagttctatctcaccaaaacaatccctttctagggatagcctgtatattttaccaacttctttacttttaccgcgacagcgcataatattttcaagatttactcgaggacagggaccattctcctcaacccatcttggatctggtttcaaaagccttttagaagtcttcaaaataggtgaacccaggaacctctactaaantcttatccatatacattatgaccgccagacgcatttgcattctaaaaacgtgtcttccaacgaacacacgcgaaaccatctaattttaatttctaacatatctccacactttgcaatatctcattatgctcgcttcaatgcaggggaaactatctctcatttctgcgttccacaaacagacctaatgaancttgtgctactttttgctactctatagcttttttcttttagggacacaccaacgccttaaattctcttagcgtttcttctggcgaccg

SEQ ID NO: 599676 - DNA, 519 bp, Homo sapiens
ccgggcaggacgccgccagcgctgaaggcgcagcccggaggccgcgcggatgcagatctgtggatccagcgtagcatcctgtaagcagctggggacattcatttccagggttttgggccccgcgtgtgtctgcgcaacaacgtggatctcgaagatgcgcagctcagggctgcctttgcgggtggtctacagccttgctcctgagttgccttgtgcgcttggtccttccctttttcccgaccaggcacccggtgccctaatggttggcaaccccccaagggacttgcaagttcctttcccaaggttccccacttgacgtgttcggtcgcgcccgaagcgaccagtcccttggcgcccgttcatgtgcccgctgctgtggccccttggggacggttttttacccccccatgtctatgtcttcccttgcctgcttcggggttggccttctttttcccccccttgtgctttggatttcttccccggggttttcccaagccccttttccttttgcggcccttg

SEQ ID NO: 599677 - DNA, 337 bp, Homo sapiens
cttttgctagaattaaggtagtttgctgcatgataaagtagtatggtctcatggtcaggagcttgggctttagagtcagtcctttgagttttcagtttcctctctgtaaaatgggaatgagagaatgcctgcttgcaaggtggctgtgagtgttagaggtgatggtaatagctatggctttattattgttgcatctttgttatatgaaagcgctgtttttccctgatgatggtgctgttattctgaacttgagagcagggtctgtgtctgagttgctccagggccccatcactcaacccaggactggggacatctcagggactttcacattcttttg

SEQ ID NO: 599678 - DNA, 1409 bp, Homo sapiens
  misc_feature (314)..(314): n is a, c, g, or t
  misc_feature (1409)..(1409): n is a, c, g, or t
tttttttggaggggtgtcctttttatggggaaaccttaaatactggttcaagaatcaatcaagggctcttgtgccagcctacacagaaaaatggaaggctttttgggtgttagggcgcaaggaagagatgacagtacaaggggacaaagacccctcacgatgaatgtgctctttcagccagcctttatctcagcttttgtgccaacagctttcttctcaatgtgggtctcccacccattattatagaaggccgtgtttcgtgggaagagtggctcatatattctcaccctgtgcacaaaatctctgtgcgtggnaatctcctgttgtgagtggtctctctcctgtctacaggggcgtatcacccaggcttctccccatatattgtacccgtgtgtgaagagacctctctagacaacccgtgagaatgtggcgtgagaaaacaagagaaaaacgcgccgtgtgtatatttgtctccggtgtgaccacgcgggagacacaacgcgggcctcaaacctgtgtgtgtctttctcccctctcacagaaaaaggtgtctcaatctcacatatatcccacaggtagatgtggggcacatggtgaaaatatctcctgtgagaggggcgattttctggagacacataaggttctctaatagagatatcgcgcgaaagggcgagggccgcggtctcctataagaaggatatatcccccctccagaagggggggccccccaaaaggctatataacccgcggattacccccaagggcgttctccttttcggttcacccacaaagcggggtgtggctccccccattaaatatagggtgggaagcctccgggaaaattaataattaaacgacattatgaggccacttgttgtggcgccggatatcagcagtttattaacacaacagccgtttcgtcgtaggcacccttgtggggaaaacaacaccgtgggggtaaaacctcttgggggaacttcctttctgggtcggaacaacggggaacaaacccctttataaacttccccgttggagggcgcgggtgggtggtgggcacccactaaaaatcgtctggcgaccaccacaaaaaccattataacccctcttatccacaggagaaggcactctatttaacaaaaaagggcgccccctaaaagaggggggaaaaaaaccttcttatctcaaccacacctctcttttaacaacaaggtggtgcacctatctacactcgggtcgtgttcgaaacacccctaagcgcctgcgcaataaataatgagttacttgactagccgccctttcataaccaagcaactttctgcgccactacacccggagaggactaccacaacttctttgtgcaaccaaattttaatcgtgcggcgtcgtctcagactataactactaaaccn

SEQ ID NO: 599679 - DNA, 194 bp, Homo sapiens
cttttttcttgtaaatttgtttgagttcattgtagattctggatattagccctttgtcagataagtagattgcatttttgtataaggtgagaaaagaggatccagtttcattcgcctacatgtggcttgccaattatcccagcaccatttgttgaatagggtgtcttttccccactttatgtttttgtttgctt

SEQ ID NO: 599680 - DNA, 457 bp, Homo sapiens
  misc_feature (99)..(99): n is a, c, g, or t
ccgttttggtaaaaagcggaagatggccctaattcttgaagtctggggaagccgccattgttgatatggttcctggcaagcccatgtgggttgagagcncccagacctacccacctttggggcgctttgctgttcgtgatataaaaccacacgtttcggtgggggtcctcaaaaccgtggccaaaaaggctgctggagctggcaaggtcccccagtttgccccaaaagctcagaagggttaatgaatattatccctaaaacccgcccccccccttttaatcagtgggggaagaacgggctcaaaaccgtttgtttccattggccccttaagtttaggaggaaaaggctgggttatgatacccatgcctcgttaacccctccaaaggaaaggagaatgttttgggggcccccttgggttttttttttggggggggccggtttaaggtattaggttttt

SEQ ID NO: 599681 - DNA, 411 bp, Homo sapiens
  misc_feature (6)..(6): n is a, c, g, or t
  misc_feature (27)..(27): n is a, c, g, or t
  misc_feature (37)..(37): n is a, c, g, or t
  misc_feature (72)..(72): n is a, c, g, or t
ctttcnaaacccccaatgttatattgncctgtctggnaaatgtttcccttatacaactcaaaggggaagagnggaatatgtccgtgagtaaatggaattatttttctctgcacccacatcattataaaaactcgaagaggttgggtgccagtgtcacgcccatgatcccagcactttgggaggccaaggcaggtggatcacttgaggtcaggagatcaagaccagcctggccaacatggtgaaatgctgtctctactaaaaatataaaaattagacgggcatggtggtgggcgcctgtaatcccagctactcgggaggctgagccatgagaatcatttgaacatgggaggcggaggttgcagggagccgaagtcgcgccactgcactccagcctgggtgtcagagtgagac

SEQ ID NO: 599682 - DNA, 181 bp, Homo sapiens
gtagagagatagagggatgacagaaacagaagcctattgagctctggggacagggaagcctggtcagcgtgtcacaggatacccgaccagcccaaggtcttcccgctgagcctctgcagcacccagacagactggaacgtggttatcggctgcctggtccagggcgttgttgccccaggaa

SEQ ID NO: 599683 - DNA, 242 bp, Homo sapiens
gattcggatacgacaacacaacagaagggaggtcagatcttcggcacagaaaaagtgtaatattacgttccggagcagcgcaagtttgatcacaaagctgtggcctcccaaattttaccaaaaatcaaagctattcctcaggtccagggttccctccgatctgggtttgctctatcgaatggaacttatcctcccaaattggtgtttttaatgtcttaagaacctaattaaatacctcactg

SEQ ID NO: 599684 - DNA, 337 bp, Homo sapiens
  misc_feature (35)..(35): n is a, c, g, or t
cctcccaaagtgctgggattacgaggcatgagccnaccgtgcccagccccattcagtatatatagcttttccaaagtatgctattgatttattcatttatatagctttatacaggatgagtatccctaatccaaaaatctgaaatttgaaatgctccaaaatccaaaacattttgagtgctgacatggtgccataagtggaaaattccatacctggggccaggcaccatggctcatccctataatcccagcactttgagaggccgaggtgggagcattgcttgagcctaggagtttgaggccaggctgggcaacacagggagaccacacctttaccg

SEQ ID NO: 599685 - DNA, 760 bp, Homo sapiens
ccccaaataaaaaaacctggccccccccccttgtgggaacaaacacccttaaaaaaaaggggggctctttaagagccccccctctgaaaacccaaaaaaaaagaacccttccgggggggggggcgtttttccccctttaaacaagggggggaaaaaaggccatttatgccggggtttttcttaatatttgaaaaaaaaaggggcccagcccgggtaatatacagtttgaaaagggttgggccaagggccccccccggggcccctttccaaaaaaaggccaaaggaaaatgttccccccccaaaagggggaatccccggggctaggcttcaaaagcgcggccccaaaaatggccgagttgcatgaaagttaagccacctgtcagaaaatggatttaagggggtgccaattgatcccattagagcggatcggggaccaacaagcttggatttgggttcgcaattgcccgggccccttttggttctaaagggaaagtgcggtcccattatcccaaagttaggaattaaggccaccaagaaccttatcacgccacgcatagaggtcaaagcccggctagagggtatcagcaaaggggtgctcctagtcatgagaggacttgggagcgcctccctgggggcacccttgaggggccgtacatagatgattatcctgttaggggttgtgatccggccagctttctggtgttcagaatcaccgttatccaagcggagggtttgaattttctagaaagcctctacctgc

SEQ ID NO: 599686 - DNA, 414 bp, Homo sapiens
ttgcgcctcctaatacctctcccctcagcacactggcctcctggccactctgccaataggactggctcctggtcacctcagaggcacagcgccagcacccctgcccatagacctcacctccctcatagctgcaaggtgggaccctcgggtgcctggaaggctcagataccaccttctagagacctgcctaccaccttcacggtgctgcctgaccctgcagcctcagcctcccctgctcctgctctagctccagctttcctttgctcccaaggctcttagctcctcacagttgtgtaatttacatgttcgctgggggctgattattcattgcctgtccccactgcgcaacggagctccatgaggtggggacatggctgcttaattcacgataacgcccgcaactggtacggcggg

SEQ ID NO: 599687 - DNA, 251 bp, Homo sapiens
cggaccttttctgccaacgcttattttgaaatgatgtatgcatttatatgtagaataaagcaaataatgttaatgtagtaatgaaccaagattttcagcttaagaggtaaaatcaaagaatatttaaaaacccttataatcttaacatttgaatggaaaacagtatgaattcatatttttcaaaaatacatgtgtatatcccatgctaaagtagttaagggtgaagggtcctgatctctaatacaacctca

SEQ ID NO: 599688 - DNA, 243 bp, Homo sapiens
tgaagattagtcctgccgttatctgtgtactcgctggttcattaccattggtggctaatttatttgatggtaagggagggatcgttgacctcgtctgttatgtacaggatgcgtatggatgggagggcgatgaggactaagatgattgcgggcagagtatacttcagatcggtttcgtattgtcctgagcgtctgagatgttcgtacttagttcgttgtgtcgtgagtgtgaagactatggcg

SEQ ID NO: 599689 - DNA, 305 bp, Homo sapiens
tgtcacccaggctggagtgcagtggcacggcctcggctcaccgcaaccttcacctcccattccaagtgattctcctgcctcagccacccgacagctgggaccacaggcatgcaccaccacgcccagcccactcttgcattcttagcagagacaggtcccaccacctcggccaggctggtctcgaactcccgaccccaggcgatccacctgcctcggcctcccaaagtgctgggattaaaggtatgagccacctcgcctggtgtgagccacctcgcccagcctgagccacctcacccagcctaagc

SEQ ID NO: 599690 - DNA, 261 bp, Homo sapiens
ttttcttttagcccccttaaaaaaaaaaaaaaagccccaatgggtgagtgtggtccgttatataccctgaattgaacctttggccctagggatcagagccttttgtcatatagcctttacatgttttattaaagggcatagtgtcaaagggatagaaccccccgccttccaaaacagctttgtccactaggccattaaacccttttcagcatatccctttgttgtccctcctttaaaaccctggcagccacttttgaatga

SEQ ID NO: 599691 - DNA, 219 bp, Homo sapiens
agcgaccgacgctaaatgggatgaaccggatcagcgaaggaggcacctgtagaaggtgaccgtcgtcaaggggctgggtgtctcaaattcgctctcacacagccgttgcttaaagcagtctccccgactgctgggtgtttaagatggctgtggggactcgatcagctttataacgtcggtgatagatcttttatgtttgctatatactcactttgtgaa

SEQ ID NO: 599692 - DNA, 403 bp, Homo sapiens
aaagctaaattaaccagataagtctttctgaaagttttagtgtcttagtttgttcctgcgctgtaacagaataccttagactgggtaacctataaataataggaatttatttctcacagttgggtgcgggtgtcgcgcctgtggtcccagcactttggggggccgaggcgggtggatcgccggaggtcagaagttcgagaccagcctggccaacgttgtgaggccctgtctctactaaaaatacaaaagttggccacgtgtggtggcgggcgcctgtgatcctagctgcttgggaggctgaggcaggagaattgcttgagcccgggaggtggaggttgcagtgagccaagatcatgccattgcactccagcctgggcaacaagagcgagactccatcttgaaa

SEQ ID NO: 599693 - DNA, 109 bp, Homo sapiens
cccactcaccttaccacagacaaccttagccaaccaatttcccaaaataaagtaatggcgaatgaaatttgaaccctggccgaaatagaatatgtcccgaaagggaaag

SEQ ID NO: 599694 - DNA, 266 bp, Homo sapiens
  misc_feature (1)..(1): n is a, c, g, or t
  misc_feature (11)..(13): n is a, c, g, or t
  misc_feature (22)..(22): n is a, c, g, or t
  misc_feature (39)..(40): n is a, c, g, or t
  misc_feature (52)..(52): n is a, c, g, or t
  misc_feature (57)..(57): n is a, c, g, or t
  misc_feature (68)..(69): n is a, c, g, or t
  misc_feature (74)..(74): n is a, c, g, or t
  misc_feature (77)..(77): n is a, c, g, or t
  misc_feature (84)..(85): n is a, c, g, or t
  misc_feature (136)..(136): n is a, c, g, or t
  misc_feature (160)..(160): n is a, c, g, or t
  misc_feature (249)..(249): n is a, c, g, or t
  misc_feature (263)..(263): n is a, c, g, or t
nacattataannntaaaacatncccacacttatacacanntaaaactagttnccctntttttccagtnntaatntgnacttttnnttttttgcaatttttgaaacagctacattaatccctaaaaatcccaccatnctgaaaatgtatggcgtgtatttnctatagtaagtaatatgaggaaaacatgattagctgtgccaaagaaattttatacattgtttacatgatgaggccacagtacttactgngggcttcatatggnttt

SEQ ID NO: 599695 - DNA, 229 bp, Homo sapiens
tatagacacggctcccctacttcttcagctactgcagagctgaaagggcagatgaaaacttctacagctccaacttctatttacacaaacctctaagctacaacatcagcggcgacttctgcaaacgccaatctacagacagcaagctcaactgctagccatttcccctgactggcttggcctcctctttccttccctgctgctgctgacaacttccctactcctagct

SEQ ID NO: 599696 - DNA, 182 bp, Homo sapiens
aagcacctgggctccagcgcgaagccccccggcgacaagacgctgcgcaacgtggggccctcggtcacctacaagctgcgggacgcgagcggccagtcgcgcgagttccacaactacatgctgccgatcgaactcgacgctcagcgcgtgttcttggccggcgtgcgcgacagcccggccga

SEQ ID NO: 599697 - DNA, 185 bp, Homo sapiens
ttgcgatccaaccatcggcaagccgattccgtgtgcttgatcacggggtgggagggaaccgtggcgtacccagcgtgggcccatgggtgagacactccagtactgagacctagagtccagatactttgtaggagccaagtcgtgttctaagtatttatttaaaacaaaaagataccgttttttta

SEQ ID NO: 599698 - DNA, 142 bp, Homo sapiens
tctagagatccccctcccctgtacgggacatacattgccctgtgggctcgaggaatggaagtggtccttttctaccgggagttgatccactgcgttttacagtttgtcattctctctgtggcacaggagaaattcatgttag

SEQ ID NO: 599699 - DNA, 162 bp, Homo sapiens
cctagacatttattccaaaggaaatgaaaactatatattcacataagaatttatacacaaatgttcatagcactttatcagtaaaagcctcaaagtggaaacaagatagatgtccctgtcaagtaggtggttaaattctgctatatccataccatgaaatac

SEQ ID NO: 599700 - DNA, 818 bp, Homo sapiens
  misc_feature (93)..(93): n is a, c, g, or t
  misc_feature (322)..(322): n is a, c, g, or t
  misc_feature (359)..(359): n is a, c, g, or t
  misc_feature (361)..(361): n is a, c, g, or t
  misc_feature (369)..(369): n is a, c, g, or t
  misc_feature (372)..(373): n is a, c, g, or t
  misc_feature (397)..(397): n is a, c, g, or t
  misc_feature (399)..(399): n is a, c, g, or t
  misc_feature (412)..(412): n is a, c, g, or t
  misc_feature (415)..(415): n is a, c, g, or t
  misc_feature (424)..(424): n is a, c, g, or t
  misc_feature (448)..(448): n is a, c, g, or t
  misc_feature (470)..(470): n is a, c, g, or t
  misc_feature (488)..(488): n is a, c, g, or t
  misc_feature (510)..(510): n is a, c, g, or t
  misc_feature (575)..(575): n is a, c, g, or t
  misc_feature (577)..(577): n is a, c, g, or t
  misc_feature (588)..(588): n is a, c, g, or t
  misc_feature (624)..(624): n is a, c, g, or t
  misc_feature (631)..(631): n is a, c, g, or t
  misc_feature (636)..(636): n is a, c, g, or t
  misc_feature (645)..(646): n is a, c, g, or t
  misc_feature (666)..(666): n is a, c, g, or t
  misc_feature (671)..(671): n is a, c, g, or t
  misc_feature (675)..(675): n is a, c, g, or t
  misc_feature (681)..(683): n is a, c, g, or t
  misc_feature (685)..(685): n is a, c, g, or t
  misc_feature (694)..(694): n is a, c, g, or t
  misc_feature (697)..(697): n is a, c, g, or t
  misc_feature (705)..(705): n is a, c, g, or t
  misc_feature (718)..(718): n is a, c, g, or t
  misc_feature (721)..(721): n is a, c, g, or t
  misc_feature (730)..(731): n is a, c, g, or t
  misc_feature (734)..(735): n is a, c, g, or t
  misc_feature (743)..(743): n is a, c, g, or t
  misc_feature (750)..(750): n is a, c, g, or t
  misc_feature (757)..(757): n is a, c, g, or t
  misc_feature (763)..(763): n is a, c, g, or t
  misc_feature (770)..(770): n is a, c, g, or t
  misc_feature (776)..(776): n is a, c, g, or t
  misc_feature (787)..(787): n is a, c, g, or t
  misc_feature (790)..(791): n is a, c, g, or t
  misc_feature (797)..(797): n is a, c, g, or t
  misc_feature (799)..(799): n is a, c, g, or t
  misc_feature (804)..(804): n is a, c, g, or t
gaggggccgagagaacaaggggggacaacacagcaggcggggaccgggccggaaggcccgggagcacaggcgggcgggaaaacgaccccgaanagccaaaaggggaaagcgcaaaagcacgcagagcaacaggggcggcaggggacacggagaggcgggcaaggccaccacgacgggccagcggagcgagaaaggcgggggcagcgacaaaagaaccagggaaaaaggggagaaggaggcggcggagaggggaaagggcgccggcaaggaggccgggggcggggagaaacggaaagcggagcgggaacgggggagcaccagngagagcgccggggggaaaggggagaccagcaaggacnangggacgancanngaggccccaggacacagagacggnancaaaaacaggagnacngggacagcncaggcggacggggcgggccggagnggggcggcgggggggggggaangggaagcggggagcgccnagaaggggcagacccgagagcnggcccggcgggcggacacacggggggggaaacaacgaaggggcggggggaacaaaagggaggccncngagccacccgncagccagaagagagaggaggaaagggggaaggaagncagcacntacantaagaaaannggcgacaaccccgacacagnagcanttgngccaannncngggtggaanggngacaacangcgggagccaagngcnaacatgccnnggnncaaggganggaaagncacccgnaaggangggcaangccagnggaaccacgcngcnngaggcncnggacngcagccgaccacca

SEQ ID NO: 599701 - DNA, 484 bp, Homo sapiens
taaaatagaatgtaatgggttgaagcttttataaaccttgtattagagacatttttattgtgttctcacctcatgcgaagggtgactcctttaacatgccaccaaagattttttttaaacacttggttctttttgtgtgttaactttctaagccaaattaatggatatataagtatatctaatttagctttgccacagtttgatcaccaagaagccaaagctgacaccccgtaatgggctttagatagcatatatgtttccttggtgaacaatgtgtgtgtgtgcgcgagcgagtgtgtgaacattttcacccccaatggtatataaccagatgttgtccatgtataaaatgggtacaagtccacatagtttaacaaatgttacagtgcccgtgccaaagttttaatggcctcctcccattccctctatgtattatgaatgatgtgcctttattaggcggctaagaataagccactgggcaatt

SEQ ID NO: 599702 - DNA, 389 bp, Homo sapiens
ctttcagagacagcagagcacacaggcttctaggacaggagccaggaagaacccaccggagggaaccatctaactgtgtgtaaacatgacttccaagctgcccgtggttctcttggcagccttcctgatttctgcagttctgtgtgaaggtgcagttttgccaaggagggttaaggacctaaaatgcaagggcataaggccatactcaaacctttcccacccaaatttaatcaaggacctgaaggggatgggaagggccccccctgggccaaccccgaatttattgcaaggtttttgggtggaaagaaagctttgtttgaccccaagggaaaccgggttcaaagcggttgcgcacagttttttgaagagccttggcatttcttactact

SEQ ID NO: 599703 - DNA, 872 bp, Homo sapiens
taacccctctttattttttgggctcaaaaaccaatttaaacccccccgccattttaagagggggggaggggaacataaggacaataaatctcacaggaagccatgctctggtgaacccacctcgttcggtgcccccggagatttgattgcccctgtgattgtcgatttggtggtttacacctcttgctccctgtgtatggcttgggaggtaggactatgaggagtgtggacgccgtctctgtgggcggcgagccatggtcgactatgtgatgcccctttggagagacttctctaacgggccgatgggaacaagagccgcagttgtgcgcgcaccagggattcgtgggggacagaagggtggtggggtcacccgcaacaagagtgtccagtgagaggcgcgccggaagcggcgcgagtgtctgggcgaagaggggacctctcccccaggagtggatcaagagagagggttcgaccggagacgcccacagggagggtggggcacccctgtgctcgtcgccatgcggtgcttgagccccgaaagagacaagagtgggcctcgccaagcgggttggttgttaagccccgagagggtgcacaaatcgaagagggcggtggtgcgcagggaagtcagcacggcttccaccgcgaaacacttgtgaaggggacaccacactcgccaattttcccctgtcaggggagccaacagatcttgtgcacgcgcgcctccctattaaggaaacacagtggccggatctgatatatccacacaagacaaggtcgccacgagaagaagtctttggcggtagggagaaccacttacctatcgtggtgggagcgaacaccgtgaggagagatgtagcagcccccaaggg

SEQ ID NO: 599704 - DNA, 201 bp, Homo sapiens
cccgctcccgggaggtaccactattgatgccgaacttagtgcggacacccgatcggcatagcgcactacagcccagaactcctggactcaagcgatcctccagcctcagcctcccgagtagctgggactacaggggtgagccaccgtgcccaacctcacttgcttcttatccttacactcccccagccccagagaaactgg

SEQ ID NO: 599705 - DNA, 414 bp, Homo sapiens
  misc_feature (10)..(10): n is a, c, g, or t
  misc_feature (35)..(35): n is a, c, g, or t
  misc_feature (43)..(43): n is a, c, g, or t
  misc_feature (45)..(45): n is a, c, g, or t
  misc_feature (123)..(123): n is a, c, g, or t
  misc_feature (134)..(134): n is a, c, g, or t
  misc_feature (171)..(171): n is a, c, g, or t
  misc_feature (227)..(227): n is a, c, g, or t
  misc_feature (244)..(244): n is a, c, g, or t
  misc_feature (277)..(277): n is a, c, g, or t
  misc_feature (282)..(282): n is a, c, g, or t
tggggggttnggccaaactttttatttaatattcnggagttgntnaacacacacttaaatggttttattgggggaagggaaaggggaggtttttgcaaattcccaaggaaatgtcaaaaaggnaaaatggccancattatccatttgcttttttgggtttactgggggaanaacactttccttacataggcatgtgatttcaggtttttcgtactgaaaacattganatttcagttggaaaacnccctgaaattttatgagtagcataccccaaccnccctntaataactagcttgtttgtataggtaaaatgattcatctttccattttaaagggctaaatgttttggggaaaaacttaaaattgcctgcctcatttgctgggaaaaatcaaataggaaggggcctttagggg

SEQ ID NO: 599706 - DNA, 236 bp, Homo sapiens
tggtcatgggaaaagtttatggaaaaaaaaaaggtacaattaagtcctgggatggatagcaacaagggctcatgtccccccttccctccctattcttggaaaaattaaaaagggaagaaacaaaacaaaaagttcatccccacaaggccagacacgagtgcttcttgaccagagtctgcccagaaagcccctccgtgggagctcctttctcaatcccactactccccatatctaac

SEQ ID NO: 599707 - DNA, 146 bp, Homo sapiens
gtatctgcccccggttcacctgtgctattgctatatcatattgtcaagctcaaatgccatcacagccctcggagagtgtacaaattcagacggctgggaccgccctcaggatttctgatccaagaggcctgggggcgggcagaggg

SEQ ID NO: 599708 - DNA, 1811 bp, Homo sapiens
gactcttccgtggtgtgcgcggacgcgatagacctgggcatcgcaggctgtggtgtgtaccctggtgagccctcacgagctccgcatacaatcctcgtgacccaagcattattggcagtgagatacaactcatcgcaagtggactagcagctacgtccgaggcgcatcgtatcgatacgaccgcactctgggccacaatgaactaggctagtccgagcgacgaatccgcgcgagcgtagcgacagagggtccgagcgccgaagctcgtggcaaaatgctccaaggggagcgcacgcatgcatttgggggcgcgggaggtggaggactggtacttcctgtctagaaaccagccatatcgtttccaacctagaacggatccgggtggggtcggtagcgttgagagcctagcagctcgcctgcgctgggtggctaggtcgttcgtggtcacgcagcgtgtcgcgcacaactcgcgaacgacgttgcgaatctcgtagtagcagagggtctgcaagcccatcgtggaggcaagccctttaccacaaggcacaagggccatgcttcttgctctatcggctcgttcgtaggacaaggggcatgcgagttcgatcgaggaggctaaacgcgggagacagtaatagaccatagtcctacatttataccctgagttgtctcacagcacgggacagcaagcaataaacgaatctgctactcttgtaggcaccatggacgaacggcacactccaatttctcgaaggccaattttgagcttggttatcgaaggagccacagaacgcgtctgctgccaaaagggaactttgtggtagcctgaagcaaccatgtggtaaggctaaacacatggttgggtggcttattgcgacacggaggggctatttttctgtggtgggcgcactcctgttgcgccacccgaagagcggtattgttgaacgcttgaggggtggtggcacatcggtttgggcctcctccgtggggggatttggcaacgcggttcaccctactgagacggttgcacttggtggacatctgtgtcccttcgtgcgaggactatggcactttatcaatggggggcacttccaggaaagaatgtctccccggacagtgttcctgggggagggatcggcaatccggcaaatatatgaacccccggaagaccaaccccgcctgattggcttgttcgccaagctaggggcatggttctatgctactccaagtcccccagtcaacacgggcactctcgcgaattcacggttcaactcgcaagacccaacagaaccaagcacaccgtggggaggacacagcgttcctctgcgaaattgtgggaccgcgttacgggtgggagtaacggagccacctgggaggggccccactttctttatgtgacacacactctgtggtccgagtagaaaaaaccacttctcgaatcattacgaagacgaccccccaaacccttaagacttaacaccttttaagacaggaacttatatttaaccccagaatttgtgtgtcctccccaatccaactgtggttccccttgaagcacttgtcggtcgggagccccttgaatttggttgagcccttgacacgaaacttcagaaaccacaccttgtgtgggcctaaaccccagcggattccatatccctctttgggccaacaaattatgccctgtgaattctctcggggagaaaacgcaacctcatgacacaagggtctgtgagaacagaagaaccacatgttgtgtttgaacgaccgacaacgatggtgtgaatctgagcccggacgcgacagaacacagg

SEQ ID NO: 599709 - DNA, 246 bp, Homo sapiens
ttggggtgggggccctgctggcaacccttagccctgtccaaggttccctcttgtcagatttgaaatttcctagttatgtttggggccctttgggaggtgttatcatttcagatcttttcgcccatatatgggtgtgttgtaacatttgtcccctcatttttgagatccccccattttttggaaatattttgctgcccccttttttgtgtttggggttcccccatcccatttaggggtcctccaaga

SEQ ID NO: 599710 - DNA, 1518 bp, Homo sapiens
cgtcgtggttggtcggccgcgctaggttgtgtggagcacgtggtaggtcattttgttcagcggagcgtcgctgcgttggtcggcgcttcttgtgtcagtcctcttttttccgcggtgggttatatagcgcctcctgttgtggctcgccgcgtgtgtttgccccctcttttttatcggcggcacactcattttgttggggggcgcccacccgcggggtctcgccccgcgttgtggcgtgggctcacctgtgtgttagcgaggcggggtttctctccgcgggtgggttttttgcccccgccttgtggggtgtgcggcccccccccccctgtgtgtgaagagcggtggtgcgttttgttgggaggcccaaccttttgtggggagttgttttaaaagagaagcgggttgtgtaattcactcgcgcgtctctcgaaagaggctccctctatgtgtgggtagaatttgctctccgggggaagggtgtgttaccacacgccgggaggaggcccccaaatgggcgtgtccccaccaggagccgttttcgcgagaggtttggaatgggcgcccccgcaccaccgcggggggttgtatttggtttcagccggagcccactgttgtgaaggagagttgcccccggaaggggcccagagtgttgtgtgttgtgtgggaccgcccacccgtttctgtgttgacgtttttgtgagacaccccccggtccgcaaagtgttgttttgggggaaaggagccgggagacgtttgtatatcccagagggatatgtgttgtttgagcccccactctgtttttgtgtggagagttgggcttataaaatttgggggccactcacacataagaggggtccacacagtgtgtatagacccacaggagagttagagatataaagagggctcgtctcactttggaggtgtagcagcacgctgggggccctctgtgtgacacactgggaacacacagagatttattgggggccacacaataatggagagagtctatactctacacctctctattgggggagattcggcccacgctgatgagaagatatataggggggaaatgtgttcttttttagaccaaccacactggccacgccaacgagacactctccacggagatgtgggaggctgctcgagatgaatgttttgagaagcactcttgttgtatattgagcccccgctataagagacactataaatttggggtttatctgccacacaaattgagtcacgagcccacgaggagaaaaggtataggttggtcacagctcacataggcaccacacactcggaccactcttgggaaaccacgccacgtggcacaccacactgtgatgaccaccaccttaaagccctcggagaacccacaattctgagacacacaaagtggagaaaaccacccctctttgaggttcttttctgagataacctgcgaggtttttaagcttataatttttgttttttgaaaaaaaagcccctaaatcatagtaaacccattataaacta

SEQ ID NO: 599711 - DNA, 1265 bp, Homo sapiens
  misc_feature (389)..(389): n is a, c, g, or t
caccttgactaccagaacaaccttgagccaagaccagtttgatcccgaagaatacatagtactaggcagcatagagagattgacaacctgagcgcaatagatgataggtaccagcaagggtgaaatgatgagaacattataaccaagcataatatagcaaggacgtaaccccttatacgcttctgcattaatgaattaacgtagaaataagctttgcgaatggagagccaataggctaatgacaccccgaagaccagtacggagactaatcgctaagaagcagctaatatagagcatcatccacgtcttatgatagctaaaagtagtggggaagatttgataggtatgaggcgacaagagctaccgatgcctggtggataagctgtgtntgtccaaggataggaactccttagttcaagctattagaattctgcccacgagatagaccttctagaagtccacctgtgtaacaatttatacctgttacgtccataagacggaacaggctcgtgttggtagaactaggaaagaaaagcctagtagagtagagttaaaatagattgtaagaggccagtaggtaggccgtaaaaggaggcagcaattaagagagcgtacaaggtcagaacgactatgtagaagagtcccagaagatagtaactgaaagtccctcagcagccaattgggagccaatcgtatcagccgtatagaaggaactaaatggtagtataagtaaacatgaaaacatttctcgctccggataaagcctgcgtcagattaagaagagtgaaatggagaattgaacaggcgaataatctacaattcaggcaacacggtcattattaccttcaatggtgaaccaagaagaacatggttcatagggaagggttaaaaaagttaaaggaatcggggaaattttaacggctggttagaaaaattcacctcttagagactaccggaattaaagggccgacgtgccaaggacaacaggttaacgggcgggggaacctaacgggcagaacgggtagaatataatgggtgcctaaaatgagcgcgtgaataggcaccaagggcaaaaagacaaactaacacggagataacatccgagaagaggggtaaaaagtaaagactagtacgaaaattaagagaacaaaacagaagaaaagcgctgatgagcgataaaaaaatagtaaaatcatgatcagaatagcggataaagaatttactgccgataccacctatttagcgctatagaaaaggaagaatag

SEQ ID NO: 599712 - DNA, 159 bp, Homo sapiens
  misc_feature (7)..(7): n is a, c, g, or t
  misc_feature (47)..(47): n is a, c, g, or t
  misc_feature (67)..(67): n is a, c, g, or t
  misc_feature (119)..(119): n is a, c, g, or t
agctggnacttggcccgcctcgaaagaccaggcccttaaggccgganccagagacacaggcacgacnagaagcaccgctagaagcagcaggaagcggcaaaccggcaactgctgacggnaaagctccggcagaacctgaggcactccggagacagacaa

SEQ ID NO: 599713 - DNA, 111 bp, Homo sapiens
accgactcaccaatgcacagacttgttttccacaagcacgttcttaccttagccacgaaggtcaccaagccacacggtactaaagggtggaacttcaaaggttatgtccgg

SEQ ID NO: 599714 - DNA, 409 bp, Homo sapiens
gtccagaggcgccttttgatccgtccaagcccccagttatcgagggcttcagccgacggtctactccaacccagaggcgtttaaggaaaagtttattcgcaagacccgtgagaacccaatggtgcctatagggtgtctggggacggcggctgcctcacctatggcctttactgcttccaccgcggccagagcaccgatcccaactcatgatgcgcacccggatcgctgcacagggtttcacggtccgtagccatcttgttggggttagcggcatctgctatgaagtctcaagcctgagtatagccgggtcttaaagcgccatggaaaccattacaaaacccaaggaacaacagacatcccttgtcagacttgctccctccgtttcagaccggaccttattgtcatttgg

SEQ ID NO: 599715 - DNA, 370 bp, Homo sapiens
  misc_feature (256)..(257): n is a, c, g, or t
  misc_feature (261)..(262): n is a, c, g, or t
  misc_feature (273)..(273): n is a, c, g, or t
  misc_feature (290)..(290): n is a, c, g, or t
  misc_feature (292)..(293): n is a, c, g, or t
  misc_feature (298)..(299): n is a, c, g, or t
gggccgggctggggggtggtttgcgccccgagccccttcccttgccggggatggggccgcaggcattgctcccttctctggaggggtcaggggcgtttgccatcctctccaaaagaacccgtgtggggtatctttgtgtccattgtggggtaccctataatggtgtatttaattatgacttaccctttggtcagtggagtaggagtgttgtacatcctttgaataagggttttccccacgaagcaagagggccagnncggnnggctcgcgccngaaatccctcccaaagngnngggannacgggcgtgacccccgcgtgccagccttttgtggacattttaaacagcagggaaattaatcctgagcaata

SEQ ID NO: 599716 - DNA, 551 bp, Homo sapiens
  misc_feature (42)..(42): n is a, c, g, or t
  misc_feature (68)..(68): n is a, c, g, or t
  misc_feature (144)..(144): n is a, c, g, or t
  misc_feature (219)..(219): n is a, c, g, or t
  misc_feature (315)..(315): n is a, c, g, or t
  misc_feature (367)..(367): n is a, c, g, or t
  misc_feature (407)..(407): n is a, c, g, or t
  misc_feature (427)..(427): n is a, c, g, or t
  misc_feature (439)..(439): n is a, c, g, or t
  misc_feature (480)..(480): n is a, c, g, or t
  misc_feature (486)..(486): n is a, c, g, or t
  misc_feature (534)..(534): n is a, c, g, or t
tcttgtcaaattatagttttctctttttctaaaacagcaggnagtcccttccagtccttgacaaaganaaagggagcccccatggacttgagttactccagaggagcaccgtggtgcacagatgttttcccacagtggccagcngttatcacgtcttccaccacaggaatggagccataggagccagcctcaaagattcgatagcattttgtgtttacnccgaccgggcacaatgtgagaccactctgaagcaagggatctgggtaattcttaagactttcatttgtttcctgaggctgccagtttcctcttgcngaaacccaacaaagcttatggttcccatcttttttcaaaatgttcattagtncctgtttggatgaattttcataaatcgttcctaagaaatnacataaatatggcctctcancaggcagcattnaccaactggcctccaccacaggaaaatccctgtctgtggcnactccnaaaggccactgaaaaacatccacgtcattcacccaggggctgtgatanattatgaaaagcagcgc

SEQ ID NO: 599717 - DNA, 183 bp, Homo sapiens
cagtttaagttttcctgcaaggtttaatttgttttcatgtaaatattccaaagcgggctgccttgtggttttggccagccttgtgctatgttgataagattgatttgctgcttaaaatccctttgctttatccaatttttactggactttttatgtaaaaaaattaaatcgtttaaagaccca

SEQ ID NO: 599718 - DNA, 484 bp, Homo sapiens
gctggtgtctgtgcctgtctcctgctgtcctgggcctgggcgttctgctgctacaggtgcgcctggtatgggcagcggacgctgacctcctctgtgcgcatcttcctgtcacgtgctcggcagctgtccgtctgccgcgctcgaagctgtttccgtctctcgtgtcaattggactctgagcatgcacgacgacgttcgtcgctcacgtcaagcgcgctacgatgcacgatcatggtcttcgtcagcggcgccttaatctgtgtcgtccttcaaaggagtcactccgaagagtgggtggtactgcaggagtcatgcgagtcaggacgcagtgtgatcatgcatagcatccattgtcttaatgtgtagctctcggctatcgctcacaacacgaacctagatgaacgttgcggagacaccgtaacactttcttttccatgcccccggattatgggcgagaagtggctccaaatgcgcacatatcagt

SEQ ID NO: 599719 - DNA, 290 bp, Homo sapiens
  misc_feature (250)..(250): n is a, c, g, or t
ggtattagagatcgtatgtgtgtacgtgcgtctgtgatatggagtcaggatagggtcaatcgagtgtagcgcgttaacagagcaagcaatgggaattgagcacgttgcaactgcacacagtcagggaacgcgggatcttaaccatgagcaaggcagggatcgtatggaggtcccaggataggggtcgaatcgaagctgtagccgccgttctacaccagagccacagaaacaggggatctgagccaaggtntgcaacctacaccacagggttaccgagcttcgaatcggta

SEQ ID NO: 599720 - DNA, 137 bp, Homo sapiens
attaccagcagtcatccagcaatgagagaatactgcctctgtagaccaacatccagatgtgattattagtagtctagagaccacaccccagatagcagagttacagccatgatcaccgatgccccacttgattccca

SEQ ID NO: 599721 - DNA, 425 bp, Homo sapiens
cactaaatgaaaaccatggttgaaagacacagaaggtctacacgctacagggtgcgggcatggattcaagcactaaatataaattcattaggtggtcatattaacctcagatgttatggtgttattatcattttttgagacagggtcttgctctgatgcccagggtggaatgcagtgatgcaaacacagctcactgtagccctgacctgccaggctcaagcaatcctcctgcttcagcctccagagcagctgggaccacagcagcacaccaccacacccagcgtaaatatgtgggtctgtattgattttatttcttataaataaaaagggggcccccccctgtggcccaggggggtcccaacccccggggcccaaggtacccaccggcccccgccccccaaagtgccgggcatccgggcttaacc

SEQ ID NO: 599722 - DNA, 242 bp, Homo sapiens
gaaaacagccaaaattaccaaggcgtgattaccatactccctttgcttaaaataatttagtggctccccattaggaaaaatatccaaattcttaaggaagcctacaggggtctgaataatcttgcccctgctgacttctgtagatttgtctcaggacagtctccctttctctgtctttatttcaggtgattcctttcaattctccaagaccaggctcacttgtatcacatgacgtttgtacc

SEQ ID NO: 599723 - DNA, 179 bp, Homo sapiens
accgattatgctcctagacggggtttcgccatgttggccaggcggtctcgatctcctgacctcagctgatctacccacctcggctcccaaagtgctgcgattatagacaggagccaccgcccccgaccctctctcacttctcgaatctctttcctttttccaccttctaggagcgtaat

SEQ ID NO: 599724 - DNA, 857 bp, Homo sapiens
ctaaccacagacatcatgacagggtcacccagccacagaggcaagggctgtgtttgaggactgggctgctgtctgtactgaagggtccgctggtgatgtgatataatagtactgagtcttttcagatttatatttcaaatatttggcctattcctctaaaatttcttgaatcctttaaaacgaaggtggctatcatttaattgattagcacatgacacaacacttaacatccttttaggctcttcaaacagagatccagacctagcttgaaaagggtacagttggacccaataatgcctgtgctgctgtggtgaaaggagatgggtgtaggggtggagatcggtaagataggctttttagacatgttggacagaatggatacagttctcccactcatggagaaacggtgtaagaaaggtacagcagatgcagcccccatgtgtcctgtggtgaggcttctttacccataagggctaaacccaatcacttaagaatctcttgcctgggctacttgttgctgaattcttcacattgcctctgactgcctgggtccctcaaacatggtaagttttctcctaagtcaaagagtcggaggctgagcatggaggtgcctcctgtacccaaccaacttcagtttcttttatcagctttatataggcttttgaataggatttattcaggaaataaaaatagtcttgctactataaagtaagaatacctatggctagaagttttaaaaaaaagtattatagagtagtggtctggtcaatactatttgctccaagcttattaaatgggcactttaatatagattgttaaaaatctcatttgttctacttagaaaacacagggatatg

SEQ ID NO: 599725 - DNA, 197 bp, Homo sapiens
tagggggtttttttgggaaagccccccatgggttttgtgaaaaccctttccaaaattttttcccgcgggtttttccctaaaaaaaaaccagttttttcccccttttaaaattttttcgaaaaagggggtttttttttccttctgggggtgaaaagaaaggggggtttccgggagaaaaataaacttttggggcccca

SEQ ID NO: 599726 - DNA, 131 bp, Homo sapiens
gaggatctcgtcgacattctgctctagcctgtgaacagagtgagacctgtctcaaataaaacaaaaaatagggcaggtgtggtggctcacacctgtaatcccagcactttgggaggccgaggcgggcggat

SEQ ID NO: 599727 - DNA, 757 bp, Homo sapiens
  misc_feature (20)..(20): n is a, c, g, or t
  misc_feature (494)..(494): n is a, c, g, or t
  misc_feature (510)..(510): n is a, c, g, or t
  misc_feature (553)..(553): n is a, c, g, or t
  misc_feature (610)..(611): n is a, c, g, or t
  misc_feature (626)..(626): n is a, c, g, or t
  misc_feature (661)..(661): n is a, c, g, or t
  misc_feature (665)..(665): n is a, c, g, or t
  misc_feature (673)..(673): n is a, c, g, or t
  misc_feature (679)..(679): n is a, c, g, or t
  misc_feature (681)..(681): n is a, c, g, or t
gggcagccgggaggagcggngcgcgctcggacctctcccgccctgctcgtacgctctccagcttgggatggccggctacctgcgggtcgtgcgctcgctctgcagagcctcagtgctcgcggccgtgcctgggcgccggctggccctgacagcccccacctcgcaagagcagccgcggcgccactatgccgacaaaggatcaaggtggcgaagcccgtggtggagatggatggtgattgagatgacccgtattatctggcagttcatcaaggagaagctcatcctgccccactgtgtgcacatccatgctaaatgtatttagagctcgtggtctcccaaacctgtgaccatgactgatgtaccatggtcaccattgactctgcactggccacccagaaggtacatgtgtggctgtcaattgtgccaccatcacccctgattaggcccgtgtggaagacgttcaagctgaagaagatgtggaaaagtcccaatgnaactatccggaacatnctgggggggactgtcttccgggagcccatcatctgcaaaactnccacgcctagtccctgtgctggaccaagcccatcaccattggcaggcacgcccatgnncgaccagtacaaggncacagactttgtggcagaccgggccggcactttcnaaantggtcttnaccccnanaagcatggcagtggtgtcaaggagtgggaagtgtacaacttccccggaggccgccgttgggcgttgggcttttcaa

SEQ ID NO: 599728 - DNA, 566 bp, Homo sapiens
ggcgacgcggcggctgcggggactggtgcggctggtgctggatggttgctggcgtgcgtgctgcggcgcagccccgggcggcgggtgggaagaggactaccagaggggcctgcgggagacccagggtcggacccataggagtcctgtcgtcaggacctccttgatcggtcttctgcttgggttctcggtgaaggaggagcttcggggtgttggctgggctgcgcggactcctcttgggatccgatgatggatcccacccggtgatcgggaatggggttacaatgcagtgaggcggaaaggctctcgccggggcacagaaagatccccagtggccgcaaggctgtgctgtcgcctgcaaaggcactgacccacgagcccactgcctccctccttcctgggtggagcaggggcctgccttcatctccaaggcccgggggctccggcatctcgacgcggcttctggcgacacgggcaacagagagacagaggctagtccgagccggagccagtgtgaccacacgtggcacttgacgtcccccaagagcacatgcagtgagcctgtgtct

SEQ ID NO: 599729 - DNA, 576 bp, Homo sapiens
  misc_feature (20)..(20): n is a, c, g, or t
  misc_feature (313)..(313): n is a, c, g, or t
  misc_feature (329)..(329): n is a, c, g, or t
  misc_feature (372)..(372): n is a, c, g, or t
  misc_feature (429)..(430): n is a, c, g, or t
  misc_feature (445)..(445): n is a, c, g, or t
  misc_feature (480)..(480): n is a, c, g, or t
  misc_feature (484)..(484): n is a, c, g, or t
  misc_feature (492)..(492): n is a, c, g, or t
  misc_feature (498)..(498): n is a, c, g, or t
  misc_feature (500)..(500): n is a, c, g, or t
gggcagccgggaggagcggngcgcgctcggacctctcccgccctgctcgtacgctctccagcttgggatggccggctacctgcgggtcgtgcgctcgctctgcagagcctcagtgctcgcggccgtgcctgggcgccggctggccctgacagcccccacctcgcaagagcagccgcggcgccactatgccgacaaaggatcaaggtggcgaagcccgtggtggagatggatggtgattgagatgacccgtattatctggcagttcatcaaggagaaggttcaagctgaagaagatgtggaaaagtcccaatgnaactatccggaacatnctgggggggactgtcttccgggagcccatcatctgcaaaactnccacgcctagtccctgtgctggaccaagcccatcaccattggcaggcacgcccatgnncgaccagtacaaggncacagactttgtggcagaccgggccggcactttcnaaantggtcttnaccccnanaagcatggcagtggtgtcaaggagtgggaagtgtacaacttccccggaggccgccgttgggcgttgggcttttcaa

SEQ ID NO: 599730 - DNA, 584 bp, Homo sapiens
  misc_feature (553)..(553): n is a, c, g, or t
  misc_feature (573)..(573): n is a, c, g, or t
  misc_feature (579)..(579): n is a, c, g, or t
ttcaggtgatttatatctcattaatatagaagggttttttctgtctttttattttagctatttcggtgggtgtgtagtagtatctcattttggttttaatttatatatttccctgatgattaaaaggggatgtcctgtaaatgttttcttttgtgaaataccatagcacacatttaagggataaagaaggcccgtcccagaggcaatgttgcatacagttcctgtcccactggccctgctgactagatggggagtccagggtaacagctacccgataccacggctcgagagttaagatttatggcagattgatacctgcctggtcgcatgatgcaatgagtatttttagacgagggaattatttcaagggccatgataggaggccttgagctaaggtatccgcttcaaggcctcctatccatggcccttggaagcggataccttagctcaaggtgggacaaacaggttatttgtagcccagggagttcagatgaacctgggttccctctgcccttccccttcactccccgtgtgccctggggcaggttatttncccatgtctaaaagttaccnggcctnagagg

SEQ ID NO: 599731 - DNA, 1379 bp, Homo sapiens
ggttgtaagtgaagtctgtttagtagcgtgccaaggggactctgagaagccctgcggagatctagactgactgaatgcaatactctgaccgtcaccggaggtcgcccgaccgttctgatggacgagcatagtatatcttctgggcttgccgtggtaggcagaccctgatccatggaaatattgcagtcaaggactgtgacttccgtgttgatagaagccgtctcgtcaatgatactggacatgtggtcggagcactggcccactcagtggcatgcatgatgatgcgcttgatcgggactggtggcatatactactgaatgtgacaacatacgcttatactattgagaagatgtgtcatcgtcgctagtaatagcagtaggcttatgtctaattaattggctcgtggatgtcaatcatggacgcataggggcacatctttctcttgtacttggtacgccaaatatgtgggggcaccttgtggtcccggatgcgttatggtgttacttgtcttacaacattggttgagcaggtttccaaaatgggtaaccagatgtgtttcccgagttcccttaatggcagccattttcaaggggaggccaaagcagtacacagaccccctttgttgggtaaaggtcagcatccagaggaaagaggtgcctattcggcgtacggagcgaacctcggtataccgtgtccaaaggttcacattggagcaacaggtttactttggaaggccctaccttacaactatagaccccacgcgttgggacgaaatcggtgaacacacaggttggacaccaattggcaattcccattgcccaatgtggggcaaccaaaagtgtcgccatatttcccctatagaccgcgagggttaactacacattaggacaagttttttacgatggaccgaaacgaatgatggcccaaaatccctatttaattcatgagagcacgttgttatgttaactagaggacaatgtccgttgacgacatggggatccttccaagtagtaaccggggacaacaggggaagtcgactccggatggtggacagcaacgggcggcacaggggagacacagttctatccagttcacacgtattaacaaacccaaagagattcgcaagaggggggcgggaaagaacagggcggatacacaaccgttcggggcaaagcgccaggaaaatataacaaggtcagtcacagcatgtggtattcagcgcccggaaaccgacgggcaagcgcctatgatgccgggactacgttaaaggcacacgaacgctaggtatcggcgttagggatacatatccggagggatacgcagcactttgtacctgcatcaagttgtgggtagcgagagttcccgcaggacgcgccaca

SEQ ID NO: 599732 - DNA, 302 bp, Homo sapiens
taaaaggggaaaaccagaggcttttattgtatgggtatggggaaccaacttaataatgggcatctctactatatagaaggcggcttggaatacgggggaaaacaactagggctataggaaaacatatgcaaactagcttcatggtctctagactaggtccttcttatggatctcacgtcatcacaaagcagcaccagcagctcctagaaaaagggagaaacagtaaagtccggcaaggaagctataattagggtagaaccatacatcccgctaatccggcaattttcctacaatcattttcc

SEQ ID NO: 599733 - DNA, 186 bp, Homo sapiens
caaaaaaaaaaaaccaaaaaaaaaaacgaaaccagaattctgtttgtttggatgccctgttatacttatttttgatcttgctgaaataagcaaattttaggaatcttagtctccagtttctgccagttttttttgttgttgttgtttgcccaattagaactaaataaaaagaacgtgattttccca

SEQ ID NO: 599734 - DNA, 378 bp, Homo sapiens
tgtctatcaatatgaatataataaataggggtccgaggtaaatagcatacatgaaagtggtggaacataaatcttcactgtgggataagatacacttggagcttatgtccttctaattgcacaaaagctcttgaccaaacatgacgaggtatgaccttttacagcacatgcatacaagaattcccagactttcaaagaatacgttggccattaagattaactttaaagcaacaaaggccgataccatcactatagatatcaatagtaagagaaaattgatgctaattagaacgaatgagactctgtggggtaataacaaggaagtaacttcttaagcagaggacagtcacattttacatgcgaatctacaatactaag

SEQ ID NO: 599735 - DNA, 758 bp, Homo sapiens
agcgggctgcctcctgcgcggtggtgccgggccgggccgaggccccgggcgctgtggcgacgcctggatcctggctccgccaggccggctgccgtggtgccccgaggaggctgctgatgccccaggccatggtcccctctcgcaggacgtggtaacctgggagccacgtcccatcgcgtgcggggcctgtggagagtgggccggggctcctcggagcccagagccggggatggcgtcgcccgcggccgcgagactcctagacaaagcaaccgggccttgaccggacctttctacgagaaaacaggcctcggggaggttgaggaacatgggcggtggagaaaagataatccccaagttgcggtagcaggtgatcgtagtgaactacgcgaggttggcacctgaaggttgcaagacttcgcaccagacgctcgtaagctcagtgcacagaagcgccgttaggcagttggagctggagactgtgaacctccggaaaggaccccgccccattgggaccctcatactcgtagaacagcaccttggacaagggttacgaacagcaatcccgtgcacaggcggacgtagacggccatactcttgtaagaacacgaagggggccacaaggggacgatgtggacagcccggaagactggcaggaagataccatggacggctagcgagacgggggcagcacaggacctttgaggcacgaagaagcgaacaccgggggaccatggcttgcagtgaggtggaagaaaatg

SEQ ID NO: 599736 - DNA, 1024 bp, Homo sapiens
tacagagctctatgatcaaatacaggttcctgatatatataagttctcatagatgcttcagactaacatcgagtcatagtgatgaagtggcttgatgaatgtttcaaatccgcatccagtatgggacacgaaagtgcctcgaaacgcattgacagaattgccttccatggaccgaaactctcacactctgttggcgcgaacatcttccaaacacatacgtagatctaacgaaagatccagtcactgaaaccaaaaacttgggggaatacatcagaagtaacagttttacatattcgatcagtgtgggcatgttctggaggcaatcttaaatcagagtgctcaaagtattagacaattctttgctaggctgatcactgtaggtgctcttattgatttgacacaagatgcttcaagtgaggctaaaagtgaaggtaatcatcctggcattagcctgtggaagacctcgcggatgtgcgggctgatacaggctacgatgaagataattgtaccggaagtccccacgtgcacccgtggcataacaggccctttaaaatgcattgtctgaggaaacctatatcgacttgaccacagaatctcccagttcatgtgaagtaaaaacgagatgagttcagaatccatgagcccggatccaccttgtgattaactccgaatttggcctgcggaactttgcacctaattctccaccacaaagaggaatgaagcatttctgatctaaaattcatccctcattaaaaaactacacgaaagcgtacaagcagagctttcatcgtacataacggccgcagagccaagaaaagctaaccaagaattcttgtgcagaaatacatgatgaggtcgaccctgtatgataaggccctctggaaaaaggtccctcctgtgaacatataagagtcccctcataatttaaaggggagccctggggttacggatacatacagggggctgtcgcttctacacagactttcttcgccaacacggtctttccagcgcggggcaatatcac

SEQ ID NO: 599737 - DNA, 355 bp, Homo sapiens
gcaggaattcggcacgagatggaatactatgcagccataaaaaatgatgagttcatgtcctttgcagggacatggatgaagatggaaaccattactctcggcaaactaacacaggaacagaaaaccaaacactgcgttttctctctcataagtgggagctgaacaatgagaacacatggacacagggaggggaacatcacacactggggcctgttgggagtggggggctaggggagggatagcttaggagaaatacctaatgtagatgatgggttggtggatgcagcaaaccaccatggcatgtgtatacctatgtaacaaacctgcaatttcctcacatgtataccaagactta

SEQ ID NO: 599738 - DNA, 275 bp, Homo sapiens
taggctggtcttgaaagcacgaagcagatgatttagctggatacttgatccatatttttaagcagcattagaaagcaaatagtctccttgggcataatgtaatatttattggcaggaattaaaaagcagtgtcctttaattttctttctttctttttttttttttagttttgggagagggagtgcactctggccggcccaggctgggatgtgaatggggccgatggggttccatggcaagctccggcctcccggggttctctggcgatcatcggg

SEQ ID NO: 599739 - DNA, 427 bp, Homo sapiens
cgtactgcactacgggtgttcactatgttgtcaagctggtctcgaactcctggactgaagggattctcctgaccttagactgataaagtgttgagattataggcatgggccactgtgcctggctcaatgtagctttttttttttttggacataaaatctcgttcggtggcccaggtgggagtgcaggggcacaatctgggctcactacaattcccacctccggggttcaagcaatcctccggcctcacccgcccaagtagtggggaccacgagcactggccaccagcgcgggagctaattttggcttttttaagggagagcggggtttccaccatgtgggccaggcgtgtctcaaactccgtgaccccgaggtattctgaccacctcggcgctcccaaagtgctaggattatgggtgtgaaacactg

SEQ ID NO: 599740 - DNA, 647 bp, Homo sapiens
ggagagaactagtctcgagttttctaggtaatttgttcaaaaactgatgtttattttccatcaaccatttttccatggctgttaaaaagcctatggaagaagcgttaaaaccagccagtggtggcgccctacccattcaggggcctgaccagtggggagcctgctagaaccagttcttctcctggtgggcaggcttgagaggccccagatctttcgagaacgggaaatggcttggaataggccacaggagggcccctgtgtgtacaccttttcaagaaccatgctttgtgcaaacctttcgggggtgcagtacgcgagttggacaccttagggagcgggggagcgaaggtcccattttcaaccccgtgagaaaattcgcctccctgttggggtctaccaactgggcgcagtttactttcagagccgagatggagcctgtggctctcttttctttatgtctgacgaggatctgtctctctcagggggggaatacctctgtggtgagaaagagctttgcgaaagtatcagagggcagattgaacctttcctgcagagagagggggtgttttcccacggggacaaaatagtggggttggccccacgggaatattgccgcgaagaaaattttccccggaaacccgagggat

SEQ ID NO: 599741 - DNA, 261 bp, Homo sapiens
  misc_feature (261)..(261): n is a, c, g, or t
gcttcttgctcaccccatctgctctcccgtgctccccctccagccctgttggccactagggaaatagaaggaacagcttgatcaagggttttcctagaaaaggctttccatgggcccattatgggaaacggagctgtttttgttttccttgattaatcacagtggtcttgtgttccctaagcgaaatgtgtgcctctggctctctcccagagagccacagagctgtgctcgtgtcagagagggctgtcagccgccctctgn

SEQ ID NO: 599742 - DNA, 265 bp, Homo sapiens
tcctgggtgacagagtgagactctgtctcgaaaaaaaaaaaaaaaaaaaaaaaaaaaaaaaaggctttttttgggtttttggaagcgggatttaaaaaaaggccggggaaaaatttggggggggaaaatcccccctttaaagaggcccccccttttttttgtaaaaatttggaaaccccaaaaaaagagggctttttttttttttggccccccaaaggggggcgaacaaatgtgggggggtttttcccctgggggaggaaggggg

SEQ ID NO: 599743 - DNA, 647 bp, Homo sapiens
ggcatataaagtatgttagtctccctaaagaggattggttcattgtgtttttcctttattctttgtttcgttctgagacaggttctcactctgtcacccaggcggagtgcaggttatgatcacagctcacgcagcctcgatctcctgggctcaggtgatcctttcacctcagcctctcaagtagctaggactacagcatgtgccttcatgcccagctaattttttaaattttttgtggagatgaggtcttgttatgttgccctggctggtcttgaactcctgggctcatttgatccttccactttgacctcccaaagtgtagggattgcaggtgtcagcctgtgctctagggctgttttccttttttcttaattttttactgaaattttatttaatagaattttatttctattaaagttttacacacacgtatttgaaagaggcaagtaattttataagtcgtcacaacagatagctcttctgcttacctcttctacccaattttctcttccccaaagataacctcttttacttccttaactgattctttttggttttaccctcatatctttaagcaacatgcatacatttcttcttaattttcagtacttttgcatcatatatgtggctcccgggggatcctctag

SEQ ID NO: 599744 - DNA, 105 bp, Homo sapiens
ctatttcagtgacatgggctcacactgggagatgggagagagaaggcttgaacggctgtcctacctgtgctcagacactgcctgtgctgttccccagaggcttga

SEQ ID NO: 599745 - DNA, 799 bp, Homo sapiens
  misc_feature (236)..(236): n is a, c, g, or t
ttggtcgccccccccccgcgtgtccagtggttgaaaggggtctggattttgtggccccccgcttgttgagggatgcaccgcttgtcagaactcacactcctggtcagcacgcaccttccacattggcgaataccaaggtcggtaatcttgcacccacaaggttcctctctttctcgggacggtgcggcctgtatcgcatcatcatccgacagagattaatcaggtgcgggttcccncgctcgtctcgctcgcgcagacagatgtgctcgagaagataatgtggctgtttctcacacaaagatgtcacgtgcgagatgagcacatttcgtatactattctcttctttctgtcgcgcgcccccgctcactcatagcagtgggttattatctcactcgccttctctctttggctctccctcgccttctgtaggggcgttggtgtctctcgccggctagatacacagctcgttctcgtgtagatataggccacgcgctagtgacgctccctctgtgtaacagagactggatatggggccgccaggatagagagagatgatgacgcgcgcggtgtacatatctgtttgtatacagatacgtgttcgagaaatatagttatttccatcccctcttggccacattagaatcgacccactatgatagcagactacccgagttttatctccactgctgtagataatacttcttattagaaaacactacacctctttgttcatatatatgcggaggaaaaacatataataacatttaccttgtcgaacgaaacaatagatacaaaaaac

SEQ ID NO: 599746 - DNA, 673 bp, Homo sapiens
  misc_feature (54)..(54): n is a, c, g, or t
  misc_feature (62)..(62): n is a, c, g, or t
  misc_feature (129)..(129): n is a, c, g, or t
  misc_feature (173)..(173): n is a, c, g, or t
  misc_feature (179)..(179): n is a, c, g, or t
  misc_feature (182)..(182): n is a, c, g, or t
  misc_feature (235)..(235): n is a, c, g, or t
  misc_feature (251)..(251): n is a, c, g, or t
  misc_feature (254)..(254): n is a, c, g, or t
  misc_feature (266)..(266): n is a, c, g, or t
  misc_feature (269)..(270): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (315)..(315): n is a, c, g, or t
  misc_feature (324)..(324): n is a, c, g, or t
  misc_feature (332)..(332): n is a, c, g, or t
  misc_feature (351)..(351): n is a, c, g, or t
  misc_feature (365)..(365): n is a, c, g, or t
  misc_feature (369)..(369): n is a, c, g, or t
  misc_feature (385)..(385): n is a, c, g, or t
  misc_feature (389)..(389): n is a, c, g, or t
  misc_feature (395)..(395): n is a, c, g, or t
  misc_feature (401)..(401): n is a, c, g, or t
  misc_feature (420)..(420): n is a, c, g, or t
  misc_feature (429)..(429): n is a, c, g, or t
  misc_feature (469)..(469): n is a, c, g, or t
  misc_feature (472)..(473): n is a, c, g, or t
  misc_feature (509)..(509): n is a, c, g, or t
  misc_feature (557)..(557): n is a, c, g, or t
  misc_feature (619)..(619): n is a, c, g, or t
gctcggcgtctgagaccattcggtgtccagagatttctgtacacagggcgccancagggccntgaggaagcagcggaattccaggcagagtttgtgtctacccctgagctggctgcccaatctgatttnatcgtcgtggcctgctccttaacacctgcacccgagggactctncaacanggncttcttccagaggatgagggacacagctgtgttcatcaacatcagcaggggcnacgtcgtaaaccaggncgncctgtaccaggnctnngccagtgtaagattncngctnctggactggatgtgacgagccagnaccactgcntacgaacnaccctctcctgagcctgangagctgtgtgattntgcnccacattggcagtgcnaccnacagancccgcnacaccatgtgcttgttggnagctaagancttgctggctggcctgagaggggagcggatgcctagtganctnnagctgtagcgaaagagtagagatggagggcgcgggnagcaaaccgtgccctggtattgtcagacacacccaggcttgatttggntccacaggcagagccaagggaaggtgtgattctctgaggaaagagtgattctgatatatgtncttgtcacattggtgttggacacatttgcgccaaaagtatggtaattctattat

SEQ ID NO: 599747 - DNA, 979 bp, Homo sapiens
gtcttgtctcctgaatcacctcggttgtaaatgtccagttcgtggctcttcctctattgctcttcttgtttgatcctgtggcggacttatgcacagagtgtaccgatgtagattacggtaaaagtgttagtttgttcataaccacactcacgagaaggtcgcttttgattctttgcaaactctagtccaagtaaatctcgacaatgcgacggttttgcattcgatgaagatgctgatgggattatgactactggcaggcaggtgatcccccgttgagaagtagccgcatatagttccctcaagtgctggacatcatatggaacatgggacgtacttgtgtaggtggaccattacttggatttctgaaactgagagtcagagttcctggaagagtgcggtaagcggcatggcttaaggacacagactaatgcactaaaaggctattagtccgttttggcaacttgggttcatacatctgattgagaaaggacattggaagccttctctacattgcatctgttgaagtgagcgtctccttgtggacccctggtgggtgctagaatgtaaaagtttgacgataatgtcgctcttgtagacaattacggtctggtgatcacgacttttacttgggcaaaatcagtgtggtattcttagattgttcacccgtatgttgtgtgatctgttgaattgttctgaccactttatggtatcttaatgtaggattcactataatgcgttgtggggaactctaacggattaggtgtctaggtcatggcagaattagtatgcgttgtgtttgttacagttgtggtccgggattgttgaatgtgactggggcaattcactgggggtggagttgggagggccataggggcgcaaatttttacaggcggaaggtgggggcaatattttttataaacacaaaaaaagtggggggggagagaaaattgcggcgaataagagatttatgctcggtaaa

SEQ ID NO: 599748 - DNA, 492 bp, Homo sapiens
tggggcagagaattaagaatcgtcgcctatcttctgcgtggcgtggcctcaacagtggagggactcccaagtttggaaagaaaagagcagtggtgagaccccagaacgagggcgagggagaggtggagggcccggcgaggcccccaagtcccaccaccaagccctgtgattgtgcgccgcagaggtggtctcccctcggattctctcctccattggagtatgcatatatcggactcttcttcggcacaataataaataaccaagacacgcacccacaaaaacatgaaaacacaaatggtgaaataaaaaaaaaacattatttcacccacagagtgcgacactacaagagttccccccttccctatctcgcgaatatcccatcggggacccccgtggcgcgcgagcgggcgcaacaagcactacggtccactggggcccccaccatgcgagcgcgatacggcacaacgggctgtgtcaataccatagaggggc

SEQ ID NO: 599749 - DNA, 518 bp, Homo sapiens
tctaatctgccattaagtcataaatgtatttttcatctcagacattatagtttccatctccgaaaggtcagttggagtttttttataccttccatgtctctatttaacatgttcagtcttggccaggcgcggtggctcatcacgcctgtaatcccagcactttgggaggccgaggagggtggatcacaaggtcaggagatcgagaccatcctggccaacacagtgaaaccctgtctctactaaaaatacaaaaatcagctgggcatggtggtgggcacctgtaatccctgctgctcgggaagcagaggcacaagaatcgcttgaacccatgaggcagaggttgcagtgagccgagatcagccattgcactccagcctgggtgacagagtgaagactctgtctcaaaaaaatggaaagaaaacaggaaagcggagggctgggcaagccttggtgagacttgtttcccaagagtggagggagcaagcctggggcaagcaggaaatacgtgaaaaggaata

SEQ ID NO: 599750 - DNA, 1905 bp, Homo sapiens
ataggcttaggtatgaggcctggtatttaatttggcagaagggagagagagagagagattgagagagagagagagagagagagagagagagagagagagatgagagagagatataactgctggtgagagagtagagttgtgttgtggtatgtgtgtgcttctgtgtcggtgttctgctcgacgaagagagtagagatgacgacacgtgaggcggcgtgcgacgtcgtcgctgtgcggtcgtgtcgtcggggacgctcgtctcatccgcgcgcgctgcttctgctgcttgctgctcttgctgctcgtagcggtgccgctcgctcctcgctcgtagctagctgtttgtcagactgactggacggcgtgcccgccagtctggtcgttgtacgattccgtcgaagggagagaatagaatatgacgcgccgcgggctgtccgttcttactgcctcctaatcgtagtttgatcttgcagactggacagcatggaggaacgcaagcatacgctactagttaggaccacaccacctagcggtgcatgccgtccgcgaaggtccgtggccagaactacacttctcactagcttcactgccagttcctagcacccccgcacacaaagagtgcttaaattatcgaccccggtccacgcagcagttcctcgatcgaacgaacggggcgcgccatgccctcagagactttccgaagcggaagaataagcagagaaatgggactgtccggccctggcctgtttgtcgtgcctcaccgcgccgtcacacgagaacgggggtgaacgaatccaattcaaagtaaaacctaggtgcgcgaccgaaggatctgagaaccatagaacacgcacacaatcaaaatcacggcgcacgccgggcaggagagcgaacgcgaacaggcaggaaagaagaatagaacagacacagccgtcatgaacacacgaaaagcttgcgcaggcgagccagctcgcgcagcgccccccctgcaccacagcccaggacaacaatataactagaaccagccgagccaaaaataaaaatatacattacacccgccagcaagctaacattctcttccatcaccacccttcacattactttaataggagtgagaacgaccatctacggtaagcaacggcatcgagttgataaacaacaaaataaataaagaaacagatatacataggtgtacaatacccgcacaactataggatactgtttagcagtcaatcctacgacacaacaacaccaactggcacgagcgtgagagaatagcatcggcagctactaaaccgctacctatccactcttatgacacagaacctcaacgaatagcataacataggcgcacaacggcagcccgagctggcaactaggcatcaacgagcaacacacaatgagctcgtactcactgcagcacaacagaaacaccggcgcacccaggtacgtagacgaacacaccatagcacacccgtacggagttaaaacaagaataaagttagagcgcggcttctccaatcgcgatacgctatactatatacggcaccacccacggaacacacagacgaataatacaccgacatgagcagccagacatcgcaatgcgccaacgaagacagacgaacaacccaggagcacccgcccgtgaacaactacaacaaacagaaaaaaccaacagacaatagcctaagtctgaggataacaggaagacaatcgtccatattacacgcacacacacgaccgacccatagcgacggccaccgagcgacaattcgagtagcgaacgtccacagctcctacgcacgcactcagtgaggcgagcgactgaattaatcattgcatatgggagcagctgatatttttagagagtgcaaagaatacatgatgaccgcgtccgaccac

SEQ ID NO: 599751 - DNA, 898 bp, Homo sapiens
  misc_feature (47)..(47): n is a, c, g, or t
  misc_feature (95)..(96): n is a, c, g, or t
  misc_feature (100)..(101): n is a, c, g, or t
  misc_feature (167)..(167): n is a, c, g, or t
  misc_feature (172)..(172): n is a, c, g, or t
  misc_feature (180)..(180): n is a, c, g, or t
  misc_feature (190)..(190): n is a, c, g, or t
  misc_feature (192)..(192): n is a, c, g, or t
  misc_feature (252)..(252): n is a, c, g, or t
  misc_feature (256)..(256): n is a, c, g, or t
  misc_feature (366)..(366): n is a, c, g, or t
  misc_feature (369)..(369): n is a, c, g, or t
  misc_feature (478)..(479): n is a, c, g, or t
  misc_feature (509)..(509): n is a, c, g, or t
  misc_feature (521)..(521): n is a, c, g, or t
  misc_feature (539)..(539): n is a, c, g, or t
  misc_feature (588)..(588): n is a, c, g, or t
  misc_feature (699)..(699): n is a, c, g, or t
  misc_feature (710)..(711): n is a, c, g, or t
  misc_feature (713)..(713): n is a, c, g, or t
  misc_feature (718)..(718): n is a, c, g, or t
  misc_feature (734)..(734): n is a, c, g, or t
  misc_feature (736)..(736): n is a, c, g, or t
  misc_feature (747)..(747): n is a, c, g, or t
  misc_feature (749)..(749): n is a, c, g, or t
  misc_feature (769)..(769): n is a, c, g, or t
  misc_feature (780)..(780): n is a, c, g, or t
  misc_feature (788)..(788): n is a, c, g, or t
  misc_feature (816)..(816): n is a, c, g, or t
  misc_feature (828)..(828): n is a, c, g, or t
  misc_feature (830)..(830): n is a, c, g, or t
  misc_feature (832)..(832): n is a, c, g, or t
  misc_feature (895)..(895): n is a, c, g, or t
cagtagtacaaattagcgttcaagttacacatagctgaacaaaagangttgagcgagtcgaaggaggggtatggagtgaggggaaggaggtaggnngagnnggaagtgatgaagaaacaaaagaattgaacaggcatgcgaggcttttgcgcataccaccttcatangctancctgcttnagtgggagantnaagtaggcaagaatgagcagccagcggattgttgtactgttgaccagcaccatgcttttnagcnacatttcagcggagttgtgataagcatttttatacatggcaaaaccattacaacgaagtcgcctgcccgcaaacgcaccgtgttaatcgcatctcaagctaacactccanttncttgcaaacactggtataaaacacagtttaaacgaatgtaggaaaatgaatagactggtagccacttatgcctctatagtgtgattaacctcttttttagatgcttgcnncccctgtcagtctaatggctttcaaatgtnatttccatttgntaatggtgatcttgccanatctggcacggagacgacacagtaatgctgtaaaagcctctatgtagtnctgtcagtgtcttaaagaacctaaaagctgggaccagtaaaatccacagaaattcactcttgcctttaagaacttttgaaaactgtttaaaaaaaaaaaaaaaaaccaacngggaacggggnngnttctnaaacaaatgtaaaatnanatttggtggtntnagtaacaatggggagtttcnaagggtggganggggaggnggggtggtcagagatggtttctcttgtnggcttatgtttnantnattttcgtcttccacgtcctgcagcgcttctttattctgctcttcaccgtcaccctgcatgtntga

SEQ ID NO: 599752 - DNA, 1750 bp, Homo sapiens
  misc_feature (260)..(260): n is a, c, g, or t
  misc_feature (511)..(511): n is a, c, g, or t
  misc_feature (1750)..(1750): n is a, c, g, or t
gattagatggggtgaaggaagaagccccatgaattatacttgtgccttcagagagaccaagatgattcatggacgaactacaacgtagccatcctgatactttcgagggagcctgtcctgggacatcatcttcgatcaaatatcgtgtgctcagcctctctatcgggatcatagggataggtggtacaagatggccagtggggctcatgctgttcccagtgctagtgcccacacgtcaacacggttgtcttataccgcgncattacgagtcgattgaccgagatggcatgtgagtctaggcacacgcgcgcgtggcgtgacgtgtgctgaggcctgaccatgtgtgtcgacccgtgcggttctgatggctcggggtagagcaccccaagtaactggatagccgtcaagtggaccagtgtcccgctaggtgtactatgtgttaatcgaatcatagggagagctaaacaccgagttcaaagatcgctttggagaccattgcacacaggcgctntctaccgactaagatgattactcttgcttacatgtggcgtcccttgtgtgcctagtacacttcggtacacaaggacgctcgcctattcgttgacgtcgattcgcttgagaagggaatcgcttccacagtcgtggggacccaactaattgcagaggaccatactttgtggagctcctcttaccagtcacaaaccccccaataacgcgaggtgggaacagcataacataacacgcaatagtcggccatccgggttctgtaccaaacgtggccactatccataatgaacggagcctggccaccacaaagcggcacttttcacaggatgctggcgcagcaatcctcccaccatatgcgaacagacgaccattagaggtagggccgcaaagttatgttggctcggaagcagaaagactgtatacaaaggaggccatcactatcctttatcacaccaccgaagacaatttaggcaccacgtgaattggcccctataacaatctcattttttcggggagcaagggtgtgaacttacatttggcaatttgcgcaaaattggtcatttccagaaataactccaaaaaaggtaacaatgggtttcggggactatatgggcgcattcaccccttatggatacattctatcaaccgtatacgatcgccggtagatgttaccgccccaaacttacctttacactgggttttaaagcaccttggagtacatattacgggtaagattggaaacgaaacgcaccaacgacgagatacgcgcgagataacaccaagggggaccccccttaccgggtgcacaggttggaacttcccacattgtggttcccccttaatttccgaaagccctttacaattaaagccgttaaacgccaacctggtttggcgcagaccctacaccccacttagaaaaggtccagatcctttggatagatcacgattgcgtgaacacaacttaaaggccccctcgctttcataccattaaccaaatattcccattacactattgttataaaaacacacctcctttcaaggaagtgtacacactcatgtgcagcttcccaatgtgtactacccaatggtgttatataccgacctctgcgggaagatctccttcccaacgagcccagagggcccacagtgaggtgcgaatacaaagacgatgattattaaaggcgcccacgagaagtatctgtaaacaactgacaggcggccacagtgattctatcaacaacan

SEQ ID NO: 599753 - DNA, 442 bp, Homo sapiens
  misc_feature (14)..(14): n is a, c, g, or t
  misc_feature (43)..(43): n is a, c, g, or t
  misc_feature (58)..(58): n is a, c, g, or t
  misc_feature (95)..(95): n is a, c, g, or t
  misc_feature (261)..(261): n is a, c, g, or t
ggaatgttccttgncccttcccctccctgtgcggccaggaagntccctgtgtccatcnacctcacctctggcagcttctctcccatcccagcagnctgcggcccactccctggctcccaaggaggtcctgaaactcagcctgagtgggtaggagcctcttacaagagttccttttcctgctgggcatggtggctcatgcctgtaatcccagcactttgggaggctgaggtgggtggatcacctgaggttgggagttcgagnccaggctgaccaacatggagaaaccttttctctactaaaaatgcaaaattagtgggatatggtggtgcatgcctgtaatcccagctacttgggaggctgaggcaggagaattgcttgaacccgggaggtggaggttgtggtgagccgagattgcaccattgcactccagcctgggcaacaa

SEQ ID NO: 599754 - DNA, 119 bp, Homo sapiens
ctggcatatcggtaatacatagactagatgagagcaacgtccaggaagccaggaagtacctatactaactactagcatgctacctatactacatagtacactactagctagtatatagg

SEQ ID NO: 599755 - DNA, 82 bp, Homo sapiens
ccccttttttggggccaagagaattttaaggaaaagccattttttggtccccggctaaaaaaggactcctgaatttttttca

SEQ ID NO: 599756 - DNA, 4665 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggcgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgca

SEQ ID NO: 599757 - DNA, 177 bp, Homo sapiens
tatctgctaccataaatttccatgtaccagcaagcagcatggtcatattgcagtctcctgctagaccgcttggactctggcagctctgcccctttcagggcattccacacagcatcgcgtcagaacaagaaatccatctgaggctggctgcggtggctcacgcctgtaatcccagca

SEQ ID NO: 599758 - DNA, 110 bp, Homo sapiens
cacgaggtggctgtctagaggctacggggacaaccacatgaccctgtcctgatactccctggctatgtctctgcacaatgagggtcaccatcaactgccagtccatccag

SEQ ID NO: 599759 - DNA, 5138 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggatgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggcgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgca

SEQ ID NO: 599760 - DNA, 5028 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggatgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggcgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgca

SEQ ID NO: 599761 - DNA, 312 bp, Homo sapiens
  misc_feature (277)..(277): n is a, c, g, or t
cgcgctcatagcctccagattcaatccatttgttccttcagatgtgaccaaagctgccctctgtgcctagccatgggctgggtgctggagacacgagatcaggcaggccctgcccctggggctcattctagggtctgcggcagacagggagacagagggagctgtgagagccctgaggctgagtggctttctggggaagcaccatccctagggacctccgcgttgagacaccaaggcgagctgattgcttgagcccaggagtttaagaccagcctgngcaacatggcaaaaccctgtctctacaaaaaaata

SEQ ID NO: 599762 - DNA, 1632 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtcgaagcgaacatgcggccaaaaaaataaaaaatttttaaaaaaagtatgtaaaacactttgaaaatgagtagtgtccctaaatatgtgctgaataaaaaaacaattcatctggactcgggtcaagaaaaaggaacagcagcaacatttccagcacgccggatg

SEQ ID NO: 599763 - DNA, 4838 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggcgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgca

SEQ ID NO: 599764 - DNA, 4728 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggcgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgca

SEQ ID NO: 599765 - DNA, 980 bp, Homo sapiens
accttgctaattagcagcttaatattgcaatgtatccggtggtatataacatctttaagagcgtgatcatgagagagctattattgaaacgcaccccccccatgtttattactatatagaggcttgaggataagtggtttgaacttcatgctgcttactgtcctgtgatttgtttcccataacgagtgacattgcacccgagtactaatgtgcgctagtgaaaaagacgctctagttcggaaagctcaatagggtagtatcgcagagagggtgggataaatttcatcgttgtgagtaatgttatctgaggaagaaatgcctgtagaatacccgcggtgtcctgtgtcttcaagtgcctaagattgacatcgtagtcttctcatcgtatggtcccatgcccttattactggcgggtccctcaaattccacattatgttacttgtgatgtttatacggacccgtgtgctttaatcctctgtccatctctcttgtcctgtgatgtatttatgcatggaatattcgtctgattaatcctgcttattatatggccgctttacttataggacggaacttttctgtgcatgtcaatggttatatctgttttggtaacttttttacacgtttcacaattagtaccatgagttttctggtcgtgtcccgctcaggggtgtaacacctaatattaccgtcaagtatagtaggtgctattttgtggttgggatctctcttagcgctactgctgagcggcggcggcgtatgctggtgggttaccagtgggttctcgataccagatcaatgcctttgtgtacttgggaacctggaatccaaggtgcccattgggtgggctcacaaaccacgctggggtcctctttttttgcccttgtaaattccgccgcgggcggggcaaatctttgttgcttgcaaccatattttctcggcaggccatctgggggcacaacatttgggcggcgcatccggcc

SEQ ID NO: 599766 - DNA, 315 bp, Homo sapiens
atgaggacccccaagcagttatacagactcatgtcgctttaggtcagctgggctggtattactctctggatgtggtgtgacgtgacccagagagagctgggtggatccccagcccaagtctctggtgcctccttctccagcctcaggcacaacgcgtggaaggcaccttcagcatctcctcctctctcaccgcagaacctggctctgcaggtcgacacttaacacctgccaggtcacacacatctctctggagaagccccttgtggcacagcacccagggatgcccacacagagctgagaacagcctatggaagt

SEQ ID NO: 599767 - DNA, 4003 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgagcaccgggggtggacgcggcgctttgcaaaaccaaaaagacacagtgctgccgcgacgcgctattgagagggagggtgcaggcgcgcaccgcccaacccccacctcccggtgtatgcagtggtgatgcctaaaggaatgtcacgca

SEQ ID NO: 599768 - DNA, 658 bp, Homo sapiens
gtagatcttcttttaacagtctaagtacgccctcttgtgggtcaagctagaatcacatctgctctccagcatcttctgtttcctggcaagagtttcctgctactttggattggccacgatgggctggagctgtcttgagacacgagtattagggcttggtgctcagaggatcagccgcctgttgctgaaagacaaggaactgaaggacatcagggccttggacaaggccttcataccagaattgagagaggaattttctaagctccagaacaggaccaagctgactgtgcttgaaggagacattctggatgagccattcctgaaaagagcctgccaggacgtctcggtcggcatccacaccgactggatattgagtgctttgggggcactcacagagagtccctttgattgtcatgtgaaagagccccagtttctgttggaggtctttaggcaaaaccagggggccactctttataacaaccagaccaataaaagaaacggggccctatttcctcaagacgtggccgaggcgaggacttaagacttgattattgagagggtccctgccgctcccacccagattttttctttgttgtttttttaacgcgctgtcttcatctcggaatcgatataatgattgcccccgcttctcatcatc

SEQ ID NO: 599769 - DNA, 4007 bp, Homo sapiens
ggtaaggctctggaaaagggggcgctgggagcgcattgcgagggggctggagagggagagaggagcggaagctgagggtgtgaaacggctggccccgaacacacctcgcggcgctccagtgattcctggtgtccgacctcagccccagtcagtgcgggtccagtttccaggctctcgcggaaggcctggctgagcacatgcggcagccacggtcgccctccctattcctcttagcccgaggaggggggtcccaagttacatggccacgcagatggggcctctccctcatttctgaaccttgtggggaggggaaccttgaagggagcgccccccagagccatggcttagggcctcccccacccctctggagctccagtctgcaagagtcaggagccgaaatatcgctgactgtgggtgacgactcttgcgcgcacacacacatacaagcgggcacgacgcgttcggtcctattaaaaggcacgcaagggtgcggctgcacgcggtgacacggacccctctaacgtttccaaactgagctccctgcaggtccccgacagcacaggcccctgtcccaggacccctccaggcacgcgctcacacgcacacgcgcgctccccggctcacgcgcgctccgacacacacgctcacgcgaacgcaggcgcacgctctggcgcgggaggcgccccttcgcctccgtgttgggaagcgggggcggcgggaggggcaggagacgttggccccgctcgcgtttctgcagctgctgcagtcgccgcagcgtccggaccggaaccagcgccgtccgcggagccgccgccgccgccgccgggccctttccaagccgggcgctcggagctgtgcccggccccgcttcagcaccgcggacagcgccggccgcgtggggctgagccgagcccccgcgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggctctgtcggtgtgcgaggacctcatctccagccaggtctacgccatcctagttagccatccacctacccccaacgaccacttcactcccacccctgtctcctacacagccggcttctaccgcatacccgtgctggggctgaccacccgcatgtccatctactcggacaagagcatccacctgagcttcctgcgcaccgtgccgccctactcccaccagtccagcgtgtggtttgagatgatgcgtgtctacagctggaaccacatcatcctgctggtcagcgacgaccacgagggccgggcggctcagaaacgcctggagacgctgctggaggagcgtgagtccaagagtaaaaaaaggaactatgaaaacctcgaccaactgtcctatgacaacaagcgcggacccaaggcagagaaggtgctgcagtttgacccagggaccaagaacgtgacggccctgctgatggaggcgaaagagctggaggcccgggtcatcatcctttctgccagcgaggacgatgctgccactgtataccgcgcagccgcgatgctgaacatgacgggctccgggtacgtgtggctggtcggcgagcgcgagatctcggggaacgccctgcgctacgccccagacggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtcatccctaatgacaggaagatcatctggccaggcggagagacagagaagcctcgagggtaccagatgtccaccagactgaagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggagattccccggagcacgctggactcgttcatgcagccgttccagagcacactgtggctgctggtggggctgtcggtgcacgtggtggccgtgatgctgtacctgctggaccgcttcagccccttcggccggttcaaggtgaacagcgaggaggaggaggaggacgcactgaccctgtcctcggccatgtggttctcctggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggtagggcaggccaccctccgaggcctgggtgccagggccctggctggccacggccctcctccatcccctgaaggccgtggccactgggactctgggctctggtggggcagggaactggagatagcgagccaatggccaggggcagtggcagagtggctcccaagggcacgggggacgaaaccgaatgaggggcatagcatgaaggtggatagcccactgcaaaagccggggaccgaagggaaggccaggcaccatgaaacaa

SEQ ID NO: 599770 - DNA, 119 bp, Homo sapiens
tgtctactgtgggcaggtgtatgagaagtcccccctgcgtggtgaagaacttcgggtatctggctgcgctatgactacccggtagcggcacccacaacatgtacctgggaatacctggg

SEQ ID NO: 599771 - DNA, 1949 bp, Homo sapiens
  misc_feature (31)..(31): n is a, c, g, or t
  misc_feature (43)..(43): n is a, c, g, or t
  misc_feature (48)..(48): n is a, c, g, or t
  misc_feature (62)..(62): n is a, c, g, or t
aactcaggggcgagctgagctcatgtgcganctgtaactcagngtcgngctgctaactcagnggcgagctgctaactcaggggcgagctgctaactcaggggcgtcctgctcaactccggcatcggggaaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcggctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaacaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggcgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgca

SEQ ID NO: 599772 - DNA, 1607 bp, Homo sapiens
  misc_feature (31)..(31): n is a, c, g, or t
  misc_feature (43)..(43): n is a, c, g, or t
  misc_feature (48)..(48): n is a, c, g, or t
  misc_feature (62)..(62): n is a, c, g, or t
aactcaggggcgagctgagctcatgtgcganctgtaactcagngtcgngctgctaactcagnggcgagctgctaactcaggggcgagctgctaactcaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtcccacgagaatggcttcatggaagacctggacaagacgtgggttcggtatcaggaatgtgactcgcgcagcaacgcccctgcgacccttacttttgagaacatggccggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggatagaaagagtggtagagcagagcctgaccctaaaaagaaagccacatttagggctatcacctccaccctggcttccagcttcaagaggcgtaggtcctccaaagacacgcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggcgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctccaccctcccctcttcttgcggcaccgcccacccacaccccgtctgccccttgaccccacacgccggggctggccctgccctcccccacggccgtccctgacttcccagctggcagcgcctcccgccgcctcgggccgcctcctccagactcgagagggctgagcccctcctctcctcgtccggcctgcagcccagaacgggcctccccgggggtccccggacgctggctcgggactgtcttcaaccctgccctgcaccttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcacgca

SEQ ID NO: 599773 - DNA, 1100 bp, Homo sapiens
cataattatttgccctgaggtctatgctgttttctacaaaatgccaagacgttattttgagggtgtgtgggtgtgtgtgatgtgtgtggaggaggccgaagacccaatagaatcacctgtctggagactcgacgatacaggaaccaacaacgaaaggacgcccccacacagacacacgaaggcacaagaagagaacacacagcacaccatagaaaaggagaggacccaatgccaaacgcaactacacactacaagaacaagcaaatcagacacgtaaccagaacagatcagaacagcgcagccccgatgctcacaccagcacagctacaaccaaacaataacagacgcccaaggaccacgcaacacaaacaaccgcgccaccacgggaagacagagacacacacaacaacccggcaccgcaagaccaacagaaccaacaagccgcaacagaacgccccccccaggcgaacccacccacgccacaaccacgcaccacaaacacaacacgcaccacacccactaggaacaacaacacacggaagcaaaacacacaagcaacagacgcaccaaaggagaaacaaaggcaagcaccggaacacgaaagacacgcagacgaccgaagacccgaagccgagccaaaaagccgaagacatcacgcaaacaacacaccgggcgcggacgaaaacagccagcgaggcaaccgctggagcaagacacacaacacagcacaccaaacaacacgcacgcgaacacacccagacagagcagccgaccaatcaacacaaggaagtaaacaggcgggactaagaggacgaagtagaggcgcagggagcacggagcgaagaaacaggaccagcagagcacaaacgagatgaataaagagatgcggaaacagaaacactacgacagggacgccaggaaggaagagctgctgagcgtcgagggagcggagggagcgaagcagcggacgtagcaccgacgagcgcgcttctgcaacgagggtgtgtaggagctagtagctaagagctgcgatcagccactcagagcgaggcagacggcgaccaggacgcagcgcgatgctagacgtgataggaaccgtt

SEQ ID NO: 599774 - DNA, 260 bp, Homo sapiens
  misc_feature (217)..(217): n is a, c, g, or t
cttctgaatcactcgagctatgcaccacaaacaaacgagagacagagaaagacagtcagccagacacattaaaaaaaaaaaaagaaaagtaaaatctgagttgttactaagcctaattctctggttaaagtttggggtcaatgttttctttttgggtcttctatttcagggaattggaattggagcctgtgtaaaattcctctaggtctaaaactgngaatctcatggcaccgttctcttttcccgtcttcattttctct

SEQ ID NO: 599775 - DNA, 1129 bp, Homo sapiens
gccaaggttcaagattaataagaaaattccccggggaccaccttctcctcctgcgcctgtcatgcattctcctagccgaaagatgactgtaaagggaacaacaagagtggaagattcctccttgtatttctaactggaaaaatgcaaagggttatacaattccattagacaaacaaggaggaatctaccaccttctcctcctgcgcctgtcatgcattctcctagccgaaagatgactgtaaaggaacaacaagagtggaagattcctccttgtatttctaactggaacaaatgcaaagggttatacaattccattagacaaacgtctggctgctgatggacagaggactacagacagtacacactaaatgaaaatttcgccaaatcggcagaagacctctacattgctgatcgcgaaggctcgtgaagctgcggaaatgcgtgcccaagtagagagaaacactgggtcagaaagaaaaggaaaacgcatgcacagagaaacctcacagaacccggcccaagaaaagccaggcagagcacgacctggggaccacacacctcccaggtggcacccaccgagcgacacggggacgccacacggcagaacggcactgcaaacacggccatggaacgcggcggaccagacgagaccacctgcaccggccaacccgaccagcagcaacaccccgaccacaacgagcacacacccaaccaagagaaaaacggcgcaaccaaagctggaacatactaggaacccggcgagacataaccccaaagacgtccaaaggcacacacacagacacccccacgcaaacacaacacacacacgggacaccagcacacggctcaagagagccacagaccaaacgaccacgcataagacacacggacacgagcaaaggacgggacacgacaccacgagaccagcaacgtgaaaaggctaggacgaaggcagccccacgcgaagacaagaggacaggcacggccagcacacggaagccaaggacaggtacaagaccgaggacgcaatacaagaaagagacaacaagagcagacagaacgatcgctcgcagcccacagagagcagataaacacgaagacacgacgatgcgagaaagcaaccacaacc

SEQ ID NO: 599776 - DNA, 228 bp, Homo sapiens
actggctgcccatgtgctatgcactgttatctgttgtgtatccgtcaaccccaggaagttttcccagatacccatgtggacctgccatgctcttcacgttctgagccaggatcagaagtgagggaagccagacctgtgttgtcatggccgattcttgactttccacatgatctcccagtgtccagtggtctccacttgtgaaggatttcaactgcactggtaagcacc

SEQ ID NO: 599777 - DNA, 718 bp, Homo sapiens
tgatgcggagtcttgctctgttgtccagcctggagtgcagtggcatgatctcggctcactgcaacctctgcctcccaggttcaagcgattctcctgcctcagcctcctaagtggctggtattacaggagtgtgccattagcctggctaattttggtattttagtagagatggattttcatggtgtgggccatgctggtcttgaactcctgacctcaagtgatcctcctgcctgtggcctcccaaagtactgtgattactatcatgagccaccacaccgtggcctaaaagatcatggattagtttggagtaagatttaagtgattaaattatggtatcgtgtgtctggaatatctgatataggggttatcttaatcatctttttataacacggtttctggaataatgcttaattgggggatatgttggtttaccaaacaatataagggaaataatagggagtggtccccatttacgtttttaaaatataaacagcggtgtctataacacggggggcagggtggcgctcaaccccctgtgataaccccagcacctggtgggaaaggcctgaaggctgtgtaaaatccggccgtgaggtcccaggagtattgggacgaccccgcccgggcgcaacaagggtgaacaccccggctgtcacttcacacacaccaaccaaaaacacaaacaacacaaaagcgggcggcgcctagaaatacccgc

SEQ ID NO: 599778 - DNA, 1089 bp, Homo sapiens
atgaccggcgagcgtcatgcattactaatggtctgtggcagatcttagaatctgcaatctctaggaaccatgcatgctgagtgcgtccatgaacattgttatctgtcggctcgtgggtgatcccccctctggggccttttcttgagaacttggctatcaacatgactctgcctctgacatgagtactgatcttctgatgaatgtgtactaagtgtgtccttactcgtcgtcatggagaggccaggattgactcaatcatacctcgatacattcagtgtctcaccgtaccacgtacccccgagaaggcatcatccgacattctattggcagaaatgccctttgtagaaggtcgtcttgggccatcatcatggtgtcctgcctgatttcgtcatacctccatggcaagacttggcattcgttgcgaacaggaaacagttgggtcctcatggtctttagcttgcactctctggacataccagtcccttcggcagactggagttggatcctttatctacctcgcaccatgtcaacagctagaatgtgagtgacgcgatgatcgtgatatctagcaaggtccagatgcatgaatccgcttaaaagattgtggggacccgtgtggcgcaagaatagaattttgctatgggctccctgatggacgactacttggggcttgtaagcgtgagcctggtggcctctacccttggatcctactctaggaagtgtgattgtcaccacttatcgatgtgaccaggaggtccagctgacttggtgtagtgacacggtaatggaagggcaagtcatccccagagggcatctgactgctcctggtagctagctactggctccctcataactccggatgtgttctaaggtgttaacccgtgctgcgttctctaggcaacatacaattgcctaccgcattgcgttcgaacatttcacccaaaggacatacccaccccacaccaccaaccgggcgcaaaaccccaccacaaccccacattacacgacaccagacaccacaccacgccaacacacggagaacacgcgacgctcacgtgtcaaaccaacaacaaatactgctcgcggaaa

SEQ ID NO: 599779 - DNA, 426 bp, Homo sapiens
agttttgataaatgtaccaaggttatatgtaagctgttaacattaggggaacctgggtgaaaggtgtatgaaactcttctgtgaatctgggcacggtggctcacgcctataatctcaacactttgggaggccgaggcaggaggatcgcttgagcctaggagttcgagactaccccaggcaacataatgagaccctatctctacaaaaaaaaattaaaagtattagctgggtgtggtggtgcctacctgtagtccctactactcaggaggctgaggtggcaggatggcctgaaccagggaggtcgaggctgcagcaagccgtgatcacaccactgcactccagtctgggcgacagagcaagatcttgtctcaataataataataataataataataataataaataaataaaaaattgaaaactctg

SEQ ID NO: 599780 - DNA, 388 bp, Homo sapiens
ctccctgcatcagcagacacatgccctccatccccgcatctccacatagatagatggaagaacaaatcatccatgttcctattacagtcgtcctgtgagcacggcgagatggggctttgcttgagaggggatcactcaggccagtgcctcccacatcttactggacagatggcgcgaaactagcatgtgatttgtctcttgcacagtgggtggccggaagggaagtgacaactcttctggctggggcctccagggataggtcagagcagaaccttccaaagggcacccatggtgccggccccagtaacctacaattcccttgtggtcaaccagcttctccagaaccaagaacccactggctcctgggtggccaagagcaatctgacca

SEQ ID NO: 599781 - DNA, 290 bp, Homo sapiens
actggtgttattcagtcagaattggggcttcacaattactagccaatatctatctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaataagaaaaagatccaaatctaaaatgcatagaaaatatctg

SEQ ID NO: 599782 - DNA, 230 bp, Homo sapiens
  misc_feature (192)..(192): n is a, c, g, or t
gctcacccgacggggtgggtgtgaagagcagagtttcactctgtgtgccaggctgagtgcaatcatggctccatcttccaggtaatactcccacctgtctcctgaatagctgggactacaggcgtacgccaccatgcttggctaatttttgtaattttttgtagagaaagggttttgccatgttacccaggnctggtctcaaattccttgggctgaagcaatcctccgtg

SEQ ID NO: 599783 - DNA, 869 bp, Homo sapiens
gacaaatgtgggaaaacttactcattcaataattcaataaacatttgttgagtagatatagttggtcaaattctggataactgccatgaacccaaagggatgcacataagctttgtccccgtcggtctggtggagcccacagattcactattgggtggaaggaggagaatatacacatgatagttatatatacaatgtgacaacgtgtaataagtatttcagtgagaatgccttgggcagtaaaggaagtaatctctgatctgtgctattgaagggtacataggaacttgacaagcagagagctatgaccgaagtaatactggatgtacaaagcgcgaagtgaggtataatcattcaatggtcttattatttggccatagaaaggaatgataggccaggtgctacgctgtgactcgcgacctgtaatcaccctaagcacttttggggaggcccggagaactggtgtggatcaccctagagtttcagagtaggattatgaatgaccaggcctagtgcaacgactgtgtgagggactcgtcatctggctaacaatatacaaacctttagactggaactttgtttgacaatatgcctgtatgcccagactgtctagggggagcgctgaaggccaagagtaatcggcttgtgacccggggtgattggaggtcgcagtgagcccatgatcgcgccacagggactccaaccttggggaccagaagcaagaatctatcgccgggacaactgatttggtaaacaataacatttttgtggcgctggccctaaagaagtttaacccatctgtgcgcgcggcccaagaaaacaacatggccaaggccccaagaactcgggaggacaggggggccacaaaa

SEQ ID NO: 599784 - DNA, 113 bp, Homo sapiens
ctggcaagattatgcatgcgtgtatacgactcaaggctgctggtcagcgctcccaggatgggaagctcatcatatagggacagctacaccaccaacagtgtacctggctccca

SEQ ID NO: 599785 - DNA, 246 bp, Homo sapiens
cccgccacagccggctaattttgtatttttagtagagatggggtttcagcatcttggcagacgggtcttaaactcctgacttcatgatccacccagctcggctcccaaagtgctgggaatacaggccaccatgcccagcatcggctcatttttggtagagaacaggtttcatcacgttgcccaggccggtctggaattcctggactccagcgatccacctgcctcagcctcccagcaaatgtcagc

SEQ ID NO: 599786 - DNA, 214 bp, Homo sapiens
  misc_feature (31)..(31): n is a, c, g, or t
  misc_feature (35)..(35): n is a, c, g, or t
  misc_feature (37)..(37): n is a, c, g, or t
  misc_feature (42)..(42): n is a, c, g, or t
  misc_feature (62)..(62): n is a, c, g, or t
  misc_feature (80)..(80): n is a, c, g, or t
  misc_feature (86)..(86): n is a, c, g, or t
  misc_feature (91)..(91): n is a, c, g, or t
  misc_feature (93)..(94): n is a, c, g, or t
  misc_feature (103)..(103): n is a, c, g, or t
  misc_feature (123)..(124): n is a, c, g, or t
  misc_feature (136)..(136): n is a, c, g, or t
  misc_feature (181)..(181): n is a, c, g, or t
  misc_feature (194)..(194): n is a, c, g, or t
gcaattgggatggcagagtttttggataagnatgntnacctntgaacaggagtcggacaagntactgccactatgattgnctgggnctggntnnggaattggncctttcccgtcttttctcannctccagagtttngaagaccccttagttggtgaagatacagaacgtgccaactctatnggcctgtttctgnagaaaacaaacatcatccgt

SEQ ID NO: 599787 - DNA, 1537 bp, Homo sapiens
gtgctggctggagtcacctccctccctgcagcccgcaatggggaatggagtaaaggggagacccgtcgatctggccactgagggatcacgcgattgtgaagttaaaagcaagtctttgtccagaccactctggcataaggccgaagaatgcctgcgtgagtgcgctattggggctggtggatggacgacctggcttgtgatagacacggtatacgacctggaggaagaacaatgcagctgtgacaatcatctccatggctgtgatgagcgaccatgagtagcacagagggaggaattgatgcgtggatgagtggcagagaccacgttcagcgtcctccgagagaagggtcataggttccgaccgtggcagttctgagacctcacgggttcaatgcatgatgcaagtcttatgcacaaaatagtcgttaccgtatcttcatgaacgcccttcaggttgagccgttctactcattgtataatggtaggacgcaatggcaagtcctaggatattcttctggcaaggtgggtggaatcaaattgaacgtgacggataaccacagagggaattcaaaaggcggtctttgccaagggtagggtccaagggcccgaagattgacccttggctaaacgcgaagagaatgggattggaccttttccccaagcttactaggccacatggaactattcactggggacctttggagaagcacggggatgctaggcacgaaacttatgggaccgcccaattcctcacgcaatacactcgactctttagaccataaacttgcaagaaacgccgcagaagagggatgatcctacattcccgagacagaatcccaccacacactgggctgcccgacacgaagcaaccttcctgggtgggcacgatagcggggagggtcggagcgggcccaaggagaggccagacagagcccacggaagcgtggatggatactgcagaaatcagtgcacccgcctgcacacagcaccgactcccaccaggccgcacccgcacgcacgacgacgtaaaaaaaaaccaataccaaaaggacaggaataacccgatttcgcaacaccttatcaaataaacccacaacgctctgccatcaccacccaacagtaaacataaaaccacccaaaatatatgcatataacaatcacactacacaaaaatcaaaaaatcaactaatacaatatatatcactctttttatctctaaatcacacagcgcgcagcgcggcagccgatagcgcgagacaacggcgactaggcatatgacgaagcaagaaagacgaaaggagcacacgcaacaccaataaacgaccaaaggcaaccaactgacaagaacgcgagaaacgcgagtacggcaggaggatgcacgaaatagagcaagaacggagagtagcagagacacagcgcaagagacagcacgaacgcggcgcgcacggcagacagcaagagtgcggagaagaagcaagaatagtgacacgcactagagagcaagacccgaacggcgaggacatcgccgggaacagaa

SEQ ID NO: 599788 - DNA, 108 bp, Homo sapiens
tacaggttttttgtgtgtttttgcttatagcttgcttgggagaacaaatctcattttggtggactgtagatatcagctttgaaactggaagttctaaaaggcttgcca

SEQ ID NO: 599789 - DNA, 433 bp, Homo sapiens
cacagggtccccgggacgggtgggtgcttataacatgtaccgcattaggaaggggacaaaccaggctccgcacaaggatcacacactaacatgctcacgcatctgtgatgcttagcacagggtggccagtgcaaatggagcccaaggccccctcggcattctgggcaacttggggtacacaggatactgagggtgccgctcctcactcaaccccaggctaagggtacacctgacccagctggcctcggtcccgggcaccttcgactggtcatgtggggccctgcacggtggcccagtggtggcaggggttgctcctgtctgtggttgtgcgcccggcgcttagaaacggccggtcacgctcctgtgggcccgagtgtgttgcatgtccacgcaccacccgttcagggccctgaattaaccgttggcatcagca

SEQ ID NO: 599790 - DNA, 105 bp, Homo sapiens
agtagcctaagcatcctgagcaaaaagaacaaggttgcatggcagcataccacctcacttcaaaatctattacagtgactatagtggtgggtcagaacataatgt

SEQ ID NO: 599791 - DNA, 317 bp, Homo sapiens
  misc_feature (222)..(222): n is a, c, g, or t
  misc_feature (230)..(230): n is a, c, g, or t
tatatatatagtttaagaagctcccattgcatcgtttaatttatatgttatgtctaagacactctctctcctatttcatcctgaagcaactcaaaatatttaaaataaagttacattgtagttatttcaaactttcttataagattagaatattgacttgctccgtattaaagctctgttattttgttccgtttgatttttgggagggagactgtgtttatntgaatatnagctgagctccggtctggaacacacaagagttgttgaagttacaagcagctcgcatgctctgatctttgtatcattcttagaatcgc

SEQ ID NO: 599792 - DNA, 823 bp, Homo sapiens
ttacgctcttgggcggcttgttctctgcgagcagtcgttcttgtgatctaccatgcgcggcttctcgtgcgtacctaagtgcgtgtcggacacccgaggggaagatacgatggatatggtacatgagccacccgtcaggaccgcagaagcgtagtctgtgttcgggttggtgaagcgtaaaggccgagcaaaggagtatagtcagcttgtaacggctggcgtatctgagtgataactgagactgccagattaatcgtattagagaaacggtcaggtttacggggctggtgacacaagagatgagttgtcacatagttgaacgcagatgagcaagtagaattatcgaaggcagtccaactgaaagtaacacatggcgcacttagaaaatgtctagtacaggtccaacggatttcccattgaggcggcttgggaatataacacccgaaccgagatggatcttaaggttgaagtgtggttcagggacctagtgcggattataatctggacatgcgacattagtagactgtggaggaagatgcagagtctgaagatgaagaggaggaggatgtgaaactcttaagtatatctggaaagcggtatgtgcctggatggtggtaagcaatggttctcaacagaaaaatagtaaagacttgtatgttgatttgcaacgttgatgagcgatgtactgatgaacgaggaatggatggatgtaccatgtagtgcacgatgaatgactttgtggctgaattatagcagttgcacctgcactgtggcctgtgcggacactccctacgacatactccccggcaatgcccaacatgac

SEQ ID NO: 599793 - DNA, 450 bp, Homo sapiens
  misc_feature (92)..(92): n is a, c, g, or t
agcttcccacaaatcagagaggtaattattttttaagaatgttagctctgagtatatcatgccaagattgattaccctatgcaactagtttntgtcagacttctcccatttatatttggcttagcatgtttttattttgatatctaggtggcctacagaatttcttgagacagctgcctctaacagtaagagaatacacagtgatggataatagccaaatccactaaagcagcctgtgagcaatgctaaagactggggataggaagaatatggattttgttttcctgctgttaaatttttacatctgagcagggatgagctaaaatccctgaccacactccttcagaaattatatttgccattggtttcctgccgatggatattgatagaacagagtgttaaactagctgtctagtggctagctttttacttccttttctccactgatct

SEQ ID NO: 599794 - DNA, 398 bp, Homo sapiens
ttcattattaatctaaatgttaaagatatttttgtctgttacctgaagttctaagaatccatagataaaacttaaggactagtgtagcttcaaaatggaattaagctgaaaatgcattttagtctgaaaatatgaaagccatgggatatgattaaagtctttatgaataattttcttttaccatcttcctttcctggtcaatcatgaataatttaaacagaacaaatgtggatctacttggatgtggacagtaacagacctggaaggtactcttcaataagtactagtgttaccagaaagaggtctggcccagattccaggagagggttcttggatctctcatgagaaagaattagaagcaaatccatagagtaaagtgaaagcaaggttataaaaaa

SEQ ID NO: 599795 - DNA, 1792 bp, Homo sapiens
  misc_feature (983)..(983): n is a, c, g, or t
aaagtggctaggaccgagttcggctgtgcccgctttccggccaggtacccctaatggtgagagcagctgtggcgagaacgctgaaatgccatatgtcggaatgtccctacctccatagagatatttgcatggagcttcctgagctcaaatggaacatgactgcggcgggcgcacacagctgacgcagttcgtgagatgagacttctctcaattggctggcctacgatgtgtcactgatcctgaagttgaatcgaataagcgcatctacacagggaagcgtcgcatccttgaagttctagcgtggaacaatgatcgcgggggagattaacactgaagattcaacatcggatgtactttttcctgcacatgcctttgttgccttaatctgggtaattgactgccatggatgtggccggagaacagcagctggatgtggaacacaacctgttcaagcaacgactagatcacacgatggcatccccgtgagctcagaggctgagcggcatgagcttggggaaagtcgaggtgacgggtgtttggagccctgaactcccttggaaccctgatccgctgtgaagacgctggctatgggtgctgaggcacgacgatatccagtgcttgtaccacctgtgaaagatgtgcgggaggcattatcggcgcagagggctgggctttaagaaaccagaatactatttgagcattggcgggaaacggcttcaagccagaagatcgcaggagcagaagaatgacgggtgcagggtgagaggctcttggaagcaacaaggtggcgggaaacttcactttgcactgtgaaacacttcagcagccatgtgtacgtcatgactgcgagcttggctacaataactcagccacactcagcgctcgagcaaacaccgttagactcagccaatattcccacatcatctattgtcgcgctcatacggtagttcttgcttcgctcctccctccctcctcactctctnaaatcagagaacaacaaataataacacaaccaaacacaacgaaccaacacaacaacactcacacaaacaacacacacacaaaacacaaaagacaccacaacaaactacagacaaactatgatcaacaagccatacaaccataacacataacaaccaacaaatcaaacacaaacacaaacactaaacaaaaatccaaaaccagaaacataacacagactctacactacaatacaatcagacaaccagtacaggcgagagagaagcgacagagaagacagagagagaatgacggggacaacgggagaagaagcgaaagaaagagagacaaggagcagagaagagaggtacagagactggacatgagaacaccagggacgacagaatgaccacaaggcggagaatggagaagagataccaaggagagcgagaacaggccgacgcaggacaacactaacagaagagccataacacaggagaacaacacggagcaccataacgccgacagacacgggaacgagagaaaatcgaagcacagaaggcaaccagactgcaccagagccactacaacggacgcagagatagacccacagcgagagagggaggctatagggcagcgagtcccagcgcacagcgccaggacaccacgacagagcgacagacacgcgctagaacacggaaacgaccgacgcggagggagcaggcgaagaaacgagacagaaaagcgagcgggatagaaccacacacgagaacagcagagcgcaggcagagaggcaggcgaatgaggacaagtaacaaactcaagcgcagac

SEQ ID NO: 599796 - DNA, 125 bp, Homo sapiens
tcctttgatttacgagctgttttgatatggctatcgtacctgattgtggttcatatactgaggtggttcctcttcatgcaacaaggaattgggactggttatatcttaaagctgggggtctataa

SEQ ID NO: 599797 - DNA, 1027 bp, Homo sapiens
  misc_feature (325)..(325): n is a, c, g, or t
actatgttggagatactcaactgggcgtgtgtaacactgtcagccggatcactgtataacactagacagagacgtaagcggtcctgctcgatcagatgactcgagaaggaggaagctcccggtccactagaatgaacgtcggactggagcttcaagtatacgcgcacaggagactactgtgacgcgtagcacatatctattgagcaagatatattgtgcctgtcactgttacctgtgtccagtatcgatgagcgagtagtcctctcgtggtcgttgggagaacacagagtgaattgagtgctaagatgagtagcaatggtcatcncgaccgtgaggtatactgtactcacataccgcagagtacaaccggttgttcgcagatagcgcctcgacgaatgaagcagtgtctcgtactactcctgttggccccctgcttcatcaatggcatcggtctcgatgactcggtcgacagtcgtctccatgtggccagagtgcacaggacgcgtctgatgcaaagatgacgtgcggcttccaagtgtggcgtcgaaagtgcctagcagatggtggcaggggcttccaaatgaagcgagtgaccaagaagttctgaggcgggaacactccgtgcccgttggctcgcaatgacataatggttgttcctcgattgcgggcatctaataaagcaggtttctagagcctacatttctggcgggctttcccactacaaacggttggttcctcaactgtgtgagccaggcgcccgttccgggctgcaagggtggacgtggcctgggtgtaaaagatggggcagttgatgttgaagtttgccaaaccaactgcgcggccccgggtggacaaggcccgggagggagaggcaccccggttgtcgaagggcaagggttcttcccccgagaggatagttaaggtttgtcaacagaactcctgccgcttttttatatccacaactgtggcgaataaataaggggcatacatagcctttgcgaacggtcgcgctgctctgaccgcgcgg

SEQ ID NO: 599798 - DNA, 220 bp, Homo sapiens
aatcctaaatcaccacccaatgacttaactttaccagtggcatcatttaagacggctgtggctcgggttcttatagtatcgaccactattttcatagatagccccaacgtgcttgatattctcataggcttcacgcataacactgtgattgatgcacactgcttcaagtgttgacttgtcagctactgtgatataacccatttattcaagcagggctaag

SEQ ID NO: 599799 - DNA, 113 bp, Homo sapiens
cggatcgcccttttttttggcagctgaattaacattaagatcttgcttggcaatttcattcccctttgtaatctgacgtccactagcaatggtctatcagaacagatgtgctc

SEQ ID NO: 599800 - DNA, 1637 bp, Homo sapiens
cgagggggaggtacgagggtaatcatctcggacctcgctgttgacgacccctggttcggccggggtgtgaacccatgacgaaagtcatgacaacagcctctatgaatccatcgatgctatcggcatcacgtgaccctgatcgagaacgtgcttgaatgctatcccctgggaccgataggatctatcccatgagctacctttggatactcgcggacaggcactcatgtacctgcagggtccactgacgactgagcttggcacacctaggaacgtacttgatgagaattggcgccccttgccggaggagagaactgtgtggcgttggaggtgggcccggctgggggggtggttcgtacggagaatatatcttaatctcgtgaggcgatattctcagagagtcgttggaagaggggatcgtggaggcggaaggaacgttcgcgttttcttaagaggtagacaaataggaaaaaaaaatagaatagccaagactgcatctagcggaataggtaaaataatgggataattccaatgggtgggcgagaaggtcatgttttccctagtaaatgggcataaattaaagcgggtgaactcccacaaggcccaggaattgtaaaggaatcaccttcattctactcaataataatctcctccatttctcccttgttcgcctactcgtattggaggggtggcactcatccttgttagacaactggggtatctcagggtggggagaaatcaagaggttccttctgtggggaacaacccctggggggtgccggtcaaaaaccatcttggggcggcactcataaagccccgcatggaaaaatagcatggtaatagggggccccttggccgtgtgggatactaatcacctgttcaaaggagggcggcgccccaattaagaaaaaaaatatccgtagttgcggccccttgtgagcttctggcaccagttgggggcacctctttctttttaaacccactaaaacattacgtaaccaacggtggggtccccactctaaagcacaaagggtgggcaactttggaccccagtatcttttccgggtttgccctataatgtttgtccttgtgggacggcactctgtgtggaattttggccactgaaagagggcccacggtgtctcccaaaaaaatattactccaaagggtctttgaccttcaagtagagcaaatcagattttccacgtggtggagggaaataaccatttacaaactgggtttacccccattttatatgtgggtcaggcactttataagaggcccgaaaagaagctcccctagaggagatattgagcttctgtagatgggtgtccgccccccatatgagtgaaaacggttatcacaccgctactggtgtgaacccggggggttacacaagaaaatgcgggccacaggactcagtggagcgaagtcccccctgcgaagacaagggggagggtacaacggagacccacgggacctaattagacgacgctagctgggggcagataccacggggcgaccaacgcggggaactaagacgagcagaaaaacaagcgaatatgggagaagaagctggggacccgtgaagacaacaaatccggcagagacaaacagagagagcaaacacacacagacaa

SEQ ID NO: 599801 - DNA, 312 bp, Homo sapiens
gggatgtggggcacagagaaacaaggactgctgctgctgctctgccctgaaggagccaagtggcatatcgtaaacggggtgccttgtgggccttcttgctgtccacaggtaaatttgaggagtgcttagaatacgtcatgtccgccgggcgtgttggctaatgcttgtatccctgcacttcgggaggctgaggcggacggatcacgaggtcagcagatcgagaccatcctggctaacacggtgaaacctcatctctactaaaaatacaaaaaattagccgggcgtggtggtgggcgcctgtaatcccaacta

SEQ ID NO: 599802 - DNA, 340 bp, Homo sapiens
  misc_feature (27)..(27): n is a, c, g, or t
  misc_feature (62)..(62): n is a, c, g, or t
  misc_feature (74)..(74): n is a, c, g, or t
  misc_feature (76)..(77): n is a, c, g, or t
  misc_feature (100)..(100): n is a, c, g, or t
  misc_feature (113)..(113): n is a, c, g, or t
  misc_feature (127)..(127): n is a, c, g, or t
  misc_feature (149)..(149): n is a, c, g, or t
  misc_feature (166)..(166): n is a, c, g, or t
  misc_feature (178)..(178): n is a, c, g, or t
  misc_feature (182)..(182): n is a, c, g, or t
  misc_feature (193)..(193): n is a, c, g, or t
  misc_feature (201)..(203): n is a, c, g, or t
  misc_feature (206)..(206): n is a, c, g, or t
  misc_feature (211)..(213): n is a, c, g, or t
  misc_feature (216)..(216): n is a, c, g, or t
  misc_feature (237)..(237): n is a, c, g, or t
  misc_feature (240)..(240): n is a, c, g, or t
  misc_feature (244)..(245): n is a, c, g, or t
  misc_feature (338)..(338): n is a, c, g, or t
ggaggaagggggaggaaggggggagangacctacaaatggaatttcatcttgtttccatgcngagtagtgaaananngaaaaagctaatcataataaccnacatcaaaagggnactaagctaacacngctcactttctttttaacaggnaaaatataaatatatgnactctataattncacnattttttattncagtaaannnttnaaatnnnatntttaacatcctattacatagnacnggcnnatatatgatatataatattatgtatttattttatattcaactttttcttttatggtttgcagtatgaaagaaaatattgaagaaatgattaanga

SEQ ID NO: 599803 - DNA, 292 bp, Homo sapiens
  misc_feature (9)..(9): n is a, c, g, or t
  misc_feature (54)..(54): n is a, c, g, or t
  misc_feature (57)..(57): n is a, c, g, or t
  misc_feature (64)..(64): n is a, c, g, or t
  misc_feature (86)..(87): n is a, c, g, or t
  misc_feature (212)..(212): n is a, c, g, or t
  misc_feature (248)..(248): n is a, c, g, or t
gtcccggcntgcgggatagaccgagggccatggcgccatctcccggacccgccngcnttggcgnccggaggcagtctacggctccnntctttcgggcttcgctcggactcgggactggagatcaaaactcgctcggtggagcagacgctactcccgctggtttctcagatcaccacgcttattaatcataaagataataccaaaaagtcttnattaaaactcttgcaagcaattcagcgtgtaggggncaagctgttcaatttgggcagttgggaaggtttttttaaagtag

SEQ ID NO: 599804 - DNA, 902 bp, Homo sapiens
gtacctgagtctcctgagcagttgctggcccaccgggcggctgcgctcgatttctcgctgggccttggctgccttcccacggggcagggctcgggaccttgcagcccgccatgcctgagcctcctacccaatccatgggctcctgtgcggcctgagcctccccgagcgagcaccacctcctgctccacggcgcccagtcccatcgaccacgcaagggctgaggaatgcgagcgcccggcacaggactggcaggcagctccacctgcagccccagtgcaggatccactaggtgaagccagctgggctcctgagtctggtggggacgtggagagtctttatatctagctcagggattgtaaatacaccaatcagcaccctgtgtttagctcaaggtttgtcgacgtgcaccagtcaacactctgtatctagctgcctcctggtgagggacgtggaagagtcttaaatgtctagcgtcaaggaacttgtaaatacaccaatcagcactgctgtgtcaagctcaaggattcgtaaagacagcgcaatcgggcactcgtggtaatctagcttcaaggttcgtaaacacaccaatacagcagccctagtgatttagtctcaaggtcttgtcgagtgcacacagtcagacaactctgtatctagctgccctgatggggaacgtggagaaccttatgtatgtagctcaagggagttgtaaacgcaccaatcagcgacctgacgaaacaggccagctcggctcgtaccaagtcagcaggactgtaggtggggccagataagagaataaaagcgggctgcccgagccagcacatggcaacaacgactcgggtccccttccacacgtggaatacgcttctgtgctctgcaaaatcgttgcttctcgccccccc

SEQ ID NO: 599805 - DNA, 224 bp, Homo sapiens
cggtgggatgtggtcctctgtaatgtggcatcgagtgtgtgccttggaggtgtgacgtgactgtctgtcatggctgtcgactgcgtgccctggacatgggaggtgactgtctgtaatggccatcaactgttgtccccagggggtgggaggtgactgtcttgtgatcgtcattcctcagaggcagggaaagatgaggtgtccctctaacagggctccaaggtgag

SEQ ID NO: 599806 - DNA, 574 bp, Homo sapiens
  misc_feature (164)..(164): n is a, c, g, or t
  misc_feature (166)..(168): n is a, c, g, or t
  misc_feature (170)..(175): n is a, c, g, or t
  misc_feature (178)..(178): n is a, c, g, or t
atggctgagttgggctctggtggggagatcatgggaggtagtttccatagaactcatcactgcttgctctccttcccaacctaacttcacatgagatcttgaaagcagggaactttctctctgagtcagacctgtcgagcagaagaagttagagagatttgagngnnngnnnnnncangtactgttgtcagagggagtaatatagaaagcatgagaaaaaaccagaagcctccaggagcaaagcccagctcccagctgacaacctcaagaaaatgaggacctcagttctacaactgcaaggaactgaatttggccaacaacctaaaggagctcagaaacattctttcccaggacctccaggaaggaatgcagccccgcccgcaccgtgatttcagcatcctgaaacccttactggaggagctggtggagctcatccagacttctgacctacagaaactgagataacaaatgtgtattgttttaagttgctaagtttatggtgattggttatataacaatagaaaagtaatacaatcaccatcacactaccatcaccactaccaccaaattatta

SEQ ID NO: 599807 - DNA, 170 bp, Homo sapiens
  misc_feature (1)..(1): n is a, c, g, or t
ngttctatcttctttcttctctcttctccttcttaacacataatcccatatatcttggaggctttgtatacttctttatcattctttaaactctcatcttgtctacacactgtatatcattacattgatcttcattctctgatagcctttcctacgctggaatggaattg

SEQ ID NO: 599808 - DNA, 231 bp, Homo sapiens
attggtaagtagaagatcaggacgatgatgagtagtacagagagaggagagctattcagttggatggattaatgcatcacaaataagagacttagagagaagtcggaaagtttaccttccagccgaagttaacagaatgatgaacttatcatcaatcattgtataacaataaagagattttcctgagagacctgatttcaaatgcttctgatgctttagataagataaggc

SEQ ID NO: 599809 - DNA, 188 bp, Homo sapiens
agtatttcaccggcaggatgacacagtaccacttcccaggcagcacgtggcatgccttggaatattgccaacgcttccagctgcctcttctcttaaagcattcctaggaaatattttccccgcccaatgctggcgcgtacacccttagtccaacgggcacaatatcctacgagggtataaagatcatc

SEQ ID NO: 599810 - DNA, 198 bp, Homo sapiens
acacacatccatgttcatccagcaccagcccacagcacagggtgcagcagcttcacatttcccatgtatgccttttccccgccgccctcactcccttcgtcttccttctcttcctcctggctttctcattccgtctttcgttttggtttgttttcagtccttctcgggtcccgcagctcgcaacttcgaactactggt

SEQ ID NO: 599811 - DNA, 307 bp, Homo sapiens
tgggggcaaaggtttgaaaacacagcctcccccgccagccccaagttgggccgaggggggtttgggtatatttgcctcccctgtttgtaaggagcagggggaacggagtttgggagcccccccagtgaaggggggggggctgccggatttgggctgtggggcccttgggccccgcttttgaggaagcccagggtcgggggcccctggaaaacagaggggtttgagactgaaattgttttccccgcccccaggggggacttcagggggggtatttgggtaaatgagtaaaacattttattttttttta

SEQ ID NO: 599812 - DNA, 452 bp, Homo sapiens
  misc_feature (10)..(10): n is a, c, g, or t
  misc_feature (32)..(32): n is a, c, g, or t
  misc_feature (94)..(94): n is a, c, g, or t
  misc_feature (214)..(214): n is a, c, g, or t
  misc_feature (403)..(403): n is a, c, g, or t
  misc_feature (422)..(422): n is a, c, g, or t
gccggcattngtatgggggttgccaatgaccnccccaagggccaaaagggttaaagggccccgactgggatttcttctggagactgtggtgaanctccttccccaaggctgagggggtcagtaggtgctctggagggactcggcaccacttgatattcaacagccacttgagccaaatataaaattgtatttacagctgatggactcaatttgngccttcaaacttgtagttatcctattatattgtaaactaatacattgtctagcattgatttggttcctgtgcatatgtatttacagctgatggactcaatttgagccttcaaacttgtagttatcctattatattgtaaactaatacattgtctagcattgatttggttcctgtgcatatgtattttcnctatgtgctcccctccccngatcttaattaaaccagattttgcaattca

SEQ ID NO: 599813 - DNA, 499 bp, Homo sapiens
tgtacatagatgggtacataattattgtctgatcattgtatgtatattgagggaggcgtcagtattaacatccctcttgtaattgccgattgtgatgatctgaatcgtctctacttatacaatatttcatatttgaagacaactgtacggaataggaaagagataaaagacttcaaatgaagaccctaagatagctatcctaaagactgagctttgtaaccgtatcaggtatcatggtaaaacactgaaaagtttgcactttgttgtcatttcttaatcgaacatacataataagtattacaaactataatctacaatacagacataccttgttttatcataatttgctttatagcacttcaaacaatttgcgttttcttttttttttttttttttttttggggcagggtttggtcctgccccaggtcctggtgtgcccccgtgcagccttggcccagggaggccccaattccccgggcccaagcaatccccggctccg

SEQ ID NO: 599814 - DNA, 930 bp, Homo sapiens
cacgggggcgccgtgggcacaaagaggtgtgtgaccttcctcgtgagaggaatcacctttgggtgggataaccccgccgggtttgggtagcgcccttccgccgttcctcacaaagtggatggggtgcacgaaggcgcccgccgcccttgtgttggcgggaaatagagatgtggcgcgcaatacctcgccctttgtggccgctgttccctgtgggcggtgtacgcacccacaggtgtgcgcgcccgcgccccagtttttgtcgctcgaggagattgttgctggcccgcttcgaacgtacattgcggaggccgctttcgccccccacggggtctctctatacaaacaagtgcgctttctttttcccggaagacagctttttctctttatcccccctctttttcgcacaccacaaaaaatttgctccttctgttattctctcccgcacaagggtgatatctatgtcccacacgagaaaggcgagttctcctcgacacaattgtgttctctctctatccaagcatgcgatagaagtgacgacccaccaccacggcgtctgccactcacaaacacccaagtttttctcccactaatagacaacaattcttctcaagtacccactgaccctaggccgaaccactttcttccatttatatcaaaagcgcgatacttcactattacgccttccctctagatcttttctcttttcccctcctgtaagggtttttatgccctccatgataaaaagttaaaaaaaatagtaatggattataaccatttctattccaataaaaagagtcaataatcccccacccctaaacaagaagaccctctataaaatcgtttttaaaaaaccacatttctttgacatattctttaattttttttaataatttaaaaacccaacaaaacttttatccggcaaccaaaaca

SEQ ID NO: 599815 - DNA, 329 bp, Homo sapiens
gaacgcggcttcgggggatgcggagcactgggccagaccccacaggtgcaggctgcgctgtcagtgatgccaggatatatccagagatggagggccctgagcgagaccagcttgtcatccccgacggacaggaggcggcgcaggcagctgccggggaagggcgaaaccagcagaaactgagaggagaagatgactacgacatggataaaaatgaagcagaatctgagacagacaagcaagcagccctggcagggaatgacagaaacatagatgttatcaatgttgacaatcagacaagagacaccataaatttacttgatcagcggtaa

SEQ ID NO: 599816 - DNA, 175 bp, Homo sapiens
agaggtgtggcgtcgtgattcaagcccgttgttccccacgaggtggtggtgcagagactcttccaggtcaaatggcggcgtgtggtccgtggcaccgaggtaactgtgtcctgggagagcttcaacaatggctgacttggttgatccgtggacttagggtgacaactagtccaac

SEQ ID NO: 599817 - DNA, 387 bp, Homo sapiens
atatgccacgggagacgtttctgtcaagtaatagagctgtccacgcatattctgattcactgcaggccacatacagccaccaggagtctctgtgctcgtgcctcaggtctaaacttgactgtaagtcctacaggcttagagatcaatgtatatcagaacatatccagtttccaaagatattagtggcaccatcaatattaattagttctccagtaatgtcaaagggcacacttagcagtgctgtcagaacaaccagaaaaaccacattcaaaagggaacacagcctaaggcacacaactcatgataaatacctgggaaaagaccagttagctctgcctttagctgttcccaccccaattttcacgattaaaactacaatcgacatac

SEQ ID NO: 599818 - DNA, 1033 bp, Homo sapiens
tccaaaactgcaaagtaaatttatggggtgggtggccggttaaaatgacaaatgatgatctgaatccaatactttaaatggctgataaatattggcaatattccaactggattttactaattggaggcctagcagtgggtatgttgggctacaactgggacacagtttatccaacctcagggttatttggaggcgcaaggaagatcacagaaaaaaaaaaaatttggggtgtatcgcaacacagttaaggtgcccaaaatataatttttcacccacggtgtgagagcaccgagacacaccccaatgcgcactgttgtccactctacccacgtgggtgcgccaggacgtgtccgtggcgtgagatatgcgccctggcgtgtcctggtcccccattcccctgcgtgtggcgcaccgcaccgcccttgaggtccactatatatgttcctcctatgtgttgcgggcagcgtctcctcttttcaaatattgcgccccggagatgtcttccccccaaagtgtgtgtgcgcccatcctccaaagaggagacaacccagcgcaccagtgtgagactgtggtgagtgcgcccatgaaaagaaccccccaccccgggcgcccaaataaaacaaagaggctcttccctcccatgtataatcgaggaagatctttttccctaacacagagaaggggcagacctttccaaaacagtgtaccttaaatccagagaccgccatagaaagacatagattgtctacacaaaaagagtactccctgggacagtgcgcctactctataaggggagaaaagtggtccccaccaggggcttgctcaccattttctccgtgagaacacccctataaagctgttggggagacacaccaaaaattctcgttgcgtttctcaaaggagacaactgttgtgcgccccaacctgtgtggaacaacccccggcggtgttccccaaaacttttctcccaacccaaaataaccagacacagcggtgttacacacccccttggaatgttggacttctccccccc

SEQ ID NO: 599819 - DNA, 690 bp, Homo sapiens
atcagtcttgtgaatatgttcattaagtcacatatttgagagcaaggaagggtaataagatgttgcaaatacaaatattagccaatacacagatgataacatttaaggccttcaaaagtacagggttttatccattgtttctccagacagattattgtcaactctacatagttttttcatacaacatattattatttagtataattgccaaccagtttccagcaacattcatccaccacactattccagaccccattatacacactgtacgtttatcgcatataagcctatcatcacttgcgccaacactaccattggtcatctacacaattcgcaggtgtgctcatacacgacactgcatatatcaggtattctaacacacaatggagttatacaagttgccaaacataacatgcaccggtaggcttaaaatcgcgttccatcatgacgctcacagctttgctcacgtactgggccagacgaacacaaccagccactacggaaaagtaacaaacaattgacagtaacacttatgttacacaaaggcatggccctttcggacttaagacgacataatactgacgtacctgtctacagacaaaacacaaaaaacaaaaagggcgccgacccagacaccaacaaaagattttcccccccacgacggggcgcccacaaacgcccctaacgcag

SEQ ID NO: 599820 - DNA, 835 bp, Homo sapiens
  misc_feature (484)..(484): n is a, c, g, or t
agcggagaagcgggagctgaggggatgagagaggccggtcctggtctggccgctgcggctgctagcccgcaggtctccaaggccgggctgcggctccatcctcgagtctctctgggctagccgttctgtctgaggcatccgccgaccagagtgagaaagccgcgggctggcgaccgccgcatcatgtcagccaatggacgaagcggtgccaatgagtagatcctgaggggcttcaacactaaattggatgaaccattcgggatgctgaggactagggaagatactctgtgcaaggataagcagaagaccgtgtctgtccctggtgtggagcatgaagcccgtgttcccaagaagaatcctcaagtgcataggcatgtgtctcgagaacttaatttttcttcgatcagaatcaaatggaaaaattccgcctggaacaaaaagtttacttcaatagggcaatgcctagaagaatggttcttcgagntttggctttgtgatccctaagctccgacaaatacctggcagtccttgatagaggcagcacccgagtcccagatgatgccagcaagcgtcttaactgggaacgttatcatagaaaacaaagtttcttgaccgacgatcttcttgatagcacatccagatgtgagacttttctatgttttgaaagaagcaatgtgtgtacctttcaacgaatttgggttatggacgggaggcaggaaactgtctacttttttcctccacgacgtttgatttttgacgacatacacccgtaattccctcacatggagaacctaacttgaactaccagggaaccagctctgtgtaccgtaaccga

SEQ ID NO: 599821 - DNA, 199 bp, Homo sapiens
gagggtgtggtggtagtgaaggtgctggtggtggtggtagaggtgatggtagaggtgatggtcatggtggaggtgctggtggtgatgatggtggtcgtgaaagtgatggtggtgatggttgagggtgtggtggtacgtgccggtgctggtggtggtggtggcggtgctggtcgcggtgctggtagtcgtgatggtgatg

SEQ ID NO: 599822 - DNA, 197 bp, Homo sapiens
atatacgaactcgagctggtaccctcgatagggccaataggagtgtttcgccagtgataggaggctcagttcgctgatttcccctatgtcacaggctacaccctagaccaaacctacgccaaaatccatgtcacgtatcatattcatcgggcgtaaatctaactttcttcccacaacactttcttggccttatcgag

SEQ ID NO: 599823 - DNA, 1705 bp, Homo sapiens
aaaaaatcgatggtgacctctgcttatgagtcatgagtgatctgttcgttgtaggtccctgaggacctcactctccactcctgtttcaggcatggggcggctggttctgctgtggggagctgccgtctttctgctgggaggctggatggctttggggcaaggaggagcagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcgggatgcctgtgcagagacaccaacgcctcccaaaccaaagctgtccaaatttattttaatttccagcctggccatccttctgatggtgtctctcctccttctgtctttatggaaattatggagagtgaagaagtttctcattcccagcgtgccagacccgaaatccatcttccccgggctctttgagatacaccaagggaacttccaggagtggatcacagacacccagaacgtggcccacctccacaagatggcaggtgcagagcaagaaagtggccccgaggagcccctggtagtccagttggccaagactgaagccgagtctcccaggatgctggacccacagaccgaggagaaagaggcctctgggggatccctccagcttccccaccagcccctccaaggcggtgatgtggtcacaatcgggggcttcacctttgtgatgaatgaccgctcctacgtggcgttgtgatggacacaccactgtcaaagtcaacgtcaggatccacgttgacatttaaagacagaggggactgtccccgggactccacaccaccatggatgggaagtctccacgccaatgatggtaggactaggagactctgaagacccagcctcaccgcctaatgcggccactgccctgctaactttcccccacatgagtctctgtgttcaaaggcttgatggcagatgggagccaattgctccaggagatttactcccagttccttttcgtgcctgaacgttgtcacataaaccccaaggcagcacgtccaaaatgctgtaaaaccatcttcccactctgtgagtccccagttccgtccatgtaccattcccatagcattggattctcggaggattttttgtctgttttgagacggagtctcactctgttgcccaggctggactgcagtgagccaagatcgtgccgctgcactccaacctgggcaacagagcaagactccatctc

SEQ ID NO: 599824 - DNA, 241 bp, Homo sapiens
  misc_feature (11)..(11): n is a, c, g, or t
  misc_feature (48)..(48): n is a, c, g, or t
  misc_feature (75)..(75): n is a, c, g, or t
  misc_feature (94)..(94): n is a, c, g, or t
  misc_feature (97)..(98): n is a, c, g, or t
  misc_feature (127)..(128): n is a, c, g, or t
  misc_feature (147)..(147): n is a, c, g, or t
  misc_feature (149)..(150): n is a, c, g, or t
  misc_feature (154)..(154): n is a, c, g, or t
  misc_feature (173)..(174): n is a, c, g, or t
  misc_feature (176)..(176): n is a, c, g, or t
  misc_feature (180)..(180): n is a, c, g, or t
  misc_feature (222)..(222): n is a, c, g, or t
  misc_feature (234)..(234): n is a, c, g, or t
  misc_feature (236)..(236): n is a, c, g, or t
aataaattganagatggagtctaaaaattattagctgttacaaatggnacatttcattataacgtgatcactttnacttgagcaaatggtttanttnncatcttaaaaatcagttaagaatatatannctcctactttggccaagtntnntctnttcattatagtttatatgnnangatnaccttaagtgaaattattttcctttaatcttttatgtatttnttacttctggangntagga

SEQ ID NO: 599825 - DNA, 1887 bp, Homo sapiens
aaaaaatcgatggtgacctctgcttatgagtcatgagtgatctgttcgttgtaggtccctgaggacctcactctccactcctgtttcaggcatggggcggctggttctgctgtggggagctgccgtctttctgctgggaggctggatggctttggggcaaggaggagcagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagacacagtcccgctctgtcacccaggctggagtgcagtggtgcgatctctgcttgctacaaccttcgcctcccaggttcaagcgattctcctgcctcagcctcccaagtagctgggattacaggcacccgccaccacgcctggctaatttttgtattatcagtagagacggggtttctccatgttggccaggctggtctcgaacttgcgacctcaggtgatccacccgcctcagcctcccaaagcgttgggtttacaggagtgagccactgtgtccggcctcgcggctccattcttgaagtcagcgagactgtgaaccctccggaaggaaaactctggacagacagatgcctgtgcagagacaccaacgcctcccaaaccaaagctgtccaaatttattttaatttccagcctggccatccttctgatggtgtctctcctccttctgtctttatggaaattatggagagtgaagaagtttctcattcccagcgtgccagacccgaaatccatcttccccgggctctttgagatacaccaagggaacttccaggagtggatcacagacacccagaacgtggcccacctccacaagatggcaggtgcagagcaagaaagtggccccgaggagcccctggtagtccagttggccaagactgaagccgagtctcccaggatgctggacccacagaccgaggagaaagaggcctctgggggatccctccagcttccccaccagcccctccaaggcggtgatgtggtcacaatcgggggcttcacctttgtgatgaatgaccgctcctacgtggcgttgtgatggacacaccactgtcaaagtcaacgtcaggatccacgttgacatttaaagacagaggggactgtccccgggactccacaccaccatggatgggaagtctccacgccaatgatggtaggactaggagactctgaagacccagcctcaccgcctaatgcggccactgccctgctaactttcccccacatgagtctctgtgttcaaaggcttgatggcagatgggagccaattgctccaggagatttactcccagttccttttcgtgcctgaacgttgtcacataaaccccaaggcagcacgtccaaaatgctgtaaaaccatcttcccactctgtgagtccccagttccgtccatgtaccattcccatagcattggattctcggaggattttttgtctgttttgagacggagtctcactctgttgcccaggctggactgcagtgagccaagatcgtgccgctgcactccaacctgggcaacagagcaagactccatctc

SEQ ID NO: 599826 - DNA, 573 bp, Homo sapiens
ggggtccctattcctgaggtacagaagagtttcctctctcctgtttcctcaaatgcctttctggtagctctgggctctgagagcattctgagctgctctctccctgtgagtagtagtcacctgcaagtctcccatcagtcactgtctcgccagagcaccctatgtggaccatctcagtgccccggtgcagcagacaggtgctctctgagtcctgtgtctcctaacccaacggtgccaaaccttcatctcccttcaaaagcacaacacaatcccagggatgcctggtcactgtccccagtatgagccttctgtttctggggtccctcccacccctcagctctggctgctgccccacataggactagcttggctgaggggaacaagatgggagagtagacagacatgggggaggggaggccaccccagaagtcttcgaggcttttgaggtttaggtctgggaccaagaaagagtatttgtgtgtatgtgtgtgtatgagtgcgtgcaagagggtatatgtgtgtgtgtcttcccacaaccccaccgtaccttgtctatgtatgcatgtttttgta

SEQ ID NO: 599827 - DNA, 243 bp, Homo sapiens
cccccccccccccccccccgaaggcccgggttttttaaaaaaagggtgggggttcccccggggtttgttccaacccaagggggggggattttccttttttccccgggtttaaaaaaggcccaaagggccttttttttttttgcccggggggggagtgggttttcccccaaaaaattccgggggggccctgccttagggccagggttttcttttttttttttgaataacccccccccttcttta

SEQ ID NO: 599828 - DNA, 510 bp, Homo sapiens
ttttttttatttccccctccaacaaaatttttttaaatacgctacacggatccactttattaacaaggtttccgggggaaatgaaaataagggctctcaaaacgatcggtcgttgacagcagtttatggtaccgctttttcttttactttcgttcggacattaattttgaaccgtgtttatgaacactgactccggcccctctataagactggaaatacatgtctcgcatgtcggattttaaaccctcaagaccgtattcttgtgtactgttgaaacccaggccctcattcttgccaagagcactgttgccatcccctagatagtaatagatgaaaagggcgcgtgaaagaaaacacggatgggaaaacgttcagctaacctggctaatgctgtcacccccttgagttaagaatcgggcccattgacactggaaccttttgcttgagcagcctcgtaggggcttttccgaaaggcgcccccaacttaatttaagccctccaacataaata

SEQ ID NO: 599829 - DNA, 212 bp, Homo sapiens
atgattctagcagcctcgatcactagccctactagtctcaatctccaacacatcttgcctagactactgtacataacctaaacctactccaatgctaaaactaatctgtcccaacaattatattactacccactgacatgactttcccacaaaacatcataatttgaatcaacacaaccaccgcagagcgctacattattcagcatcatccc

SEQ ID NO: 599830 - DNA, 95 bp, Homo sapiens
tgggaaagctaaatgaggcaaaacaagattttgaaactgttttacttctggaacctggaaataagcaagcagtaactgaactctccaaaattaaa

SEQ ID NO: 599831 - DNA, 128 bp, Homo sapiens
cttggctcagtgactcatgtcatgttatgcagagtattcccaatcaccttgtttctcctagtactgtaacaacttcttttcctccatgaattcatgatgcatgacttagggagccctaaatggaaaca

SEQ ID NO: 599832 - DNA, 142 bp, Homo sapiens
tgtggtagtctacaggatctccctcagtgtatagagtcctcattggacttatctatgacaatttctgtgccatagctaggttaattgggaccaagacatgtagacaggtgtatgagtttagagtcaaagaatctagcatcat

SEQ ID NO: 599833 - DNA, 228 bp, Homo sapiens
ataggatacagccgtcaccttgcgtggacggataagcacgcttagtgtaaaacaacgctagtgtgtattcactacactaggatattatcgtcacttttgggagatgaattcagtaatgtggttggtgaggaaaacgcgatataggaggccatattcgaagatgtcaaaaactcttgagggttcaaggacacaaacaaggaacgagttgacgtttacataaatcactcc

SEQ ID NO: 599834 - DNA, 145 bp, Homo sapiens
agatgtgcacgagtacatgggcagcacaaatggtatgaacaggaaaaagaaatgtcacatgtacaataatttttttaagaaggtgaaggttaactactggggagataacagttcccctctccctcccccggcacattcttccaag

SEQ ID NO: 599835 - DNA, 839 bp, Homo sapiens
gtgaggagcaagctgagccagatggcactgaagttgctgacaagggcagcctatctccaaaatctgaaactctgatagatcctgctcaaagccctcgttgctaccctagggtcaaggtcggcgaatgacgtatgtcaccaaaggctcgaaattgtgcagcaggctgtacaatgcagtgggtgctctggccaaggctggtctacgtataagatgtacttgtggatggtcacccgcatcaacctagtcaagcatggaacacccaagcagtcccaggtcggagtacattcattggggttcttggaactattgctggctttgagatctttgagtttcaactagcctggagcagctggtgcatcaagttcaccaatgagaaactgctagcagtttttccataccaccacatgtatcgtgctggagcaggaggagtacaaagaaaggagaaggctatccgatgtggacgtgtgcattgactttggtatggacctggcatgcctggatcggagctcatcgagaagcctatgggcctcttctccatcctggaagaggagtgcactgtactgcctaggcgagagtagcacctcgttcaacgagcaaagctgttatgaacaacatctgtgtgaaattccaataaactgtcgcataaagcccgagcctgccgataggcatgacctgagggccacttctcttagattcactatgcttggtcgccgtggactacaacattgcgggtgggttggccaagaacaggggaccccctgaatgagactgtggtgggggcgtacccgaaaggctggcaggaaactctggttgccctccttgtggggcaccggggaccg

SEQ ID NO: 599836 - DNA, 472 bp, Homo sapiens
  misc_feature (449)..(449): n is a, c, g, or t
tattaaaggagaggggtctaactctgtggcccaggcaagagggctgtggtaaatcatagctcattgcagcctcaaactccggggctcaagtgactctctggcctcagcctcttgagtagtcaagactatgggtgtgagctacctctcggggctaattttaaaaaatttgggtagatataaggtatcactatttggcccaggtgggtctcaaatcccggggcctcaagcaatcctcccacttttactccccaaggtgctagggtaacaggcataagcctccacaccgggccataagtactcagttaaaaaggtcggctctaaaatcaggtctggagaaattgggttcacctgtgtagaagaaggttgggggtcaggcctatggatactccttttcatgcacaatggggacctataagtgaattccccttggtagaatatggatagtcttnaaagaatagtattcctgaatacc

SEQ ID NO: 599837 - DNA, 320 bp, Homo sapiens
agaaatcgcaaacctctgagcttacacacacacacacacacacaccccgcccacccccaacaggctttcggtcctgagcaaccataacctgtgtttgtctctgccgcgtgtcctatttggactctaacgcgaatgcgcccatacaccacgtatacggtggtgtctgactctatccacttatggcgctgtgttcaaggctcatacatgctcgagcccatgtcagagcttcacttctttttatgggtcaaaaatcgcctatggggggccacgcacgggggctctctcctgtgatcccaccactgtgaggccgaggcgggcgc

SEQ ID NO: 599838 - DNA, 568 bp, Homo sapiens
acgcggagcagatacaggtcattgagctgcaggtgagcccgtgcagctgggaaggcctcacgtgacaagacgagcaggttgccgatggcgatggccagtgacctgcggcagaaccatggaacaaatacgcttagcgagttgccattttgagtgagttgtgcacagacgaaactaagggtcagaagcggagagggtgcctacaatgaggagtcaaatgggcaaatgggttgagaccctctccacctggtccagcttggactactaggcctcaggtgatatccgtgctccttgggggcaagttgtgtggccctgtgatgggccccccctgtgggggctgttgggcggtgcgaggcttgatcctgccagaggcccttccaccttggcgcctggcccagtgtgctggctagcacccagtggccctgttttggccggccctgtcccccaggttacagggccagaacctggaagcagagcgcaggaccagccagatcgcgccagggttccccggggcctccccagtgcctctgtgccacctggagccaggcccggcttctccatgggtgccgtg

SEQ ID NO: 599839 - DNA, 136 bp, Homo sapiens
  misc_feature (98)..(98): n is a, c, g, or t
  misc_feature (106)..(106): n is a, c, g, or t
gcagatggagcttgttataatatagctcataggatagtacaaggagggtagctatgtgtttggtcaggggtgagaatagagtgtgaggcgtatcatancatagcgnctagtttaagagtactgcggcaagtactat

SEQ ID NO: 599840 - DNA, 175 bp, Homo sapiens
  misc_feature (4)..(4): n is a, c, g, or t
gagngaggtggatcggtcgcatctacgtgacttgggcaatacggccggtctgtatgtaaaatgaggatatcataacactcatctttatagggtggtggggagaaatcagatagataatccatgtaaagtgtttagaataaggcctggaatcaaaagcccacattcttcgcctgat

SEQ ID NO: 599841 - DNA, 154 bp, Homo sapiens
gctcaccctgattgttgtggtggctgagattcttgattcacttccctagtgctgtgtgcccataggaaagctgggcttccttggatgaactctagcgtctcaaacacagtggagggccatgatgacttgtctattgtttaaaatggaacatttg

SEQ ID NO: 599842 - DNA, 393 bp, Homo sapiens
tttttttttacatattggaaaataaaagcatttaatatctcttaaagggcatccacatctgcgttaatccctagcgaaagagtgagggggcttcacacgtgcactcacctctgtggacgagagtgggatattcccagacccctgaggtcacctgtcaggttcatccccatgggtgctgcttgaggctacgggggactggtggcacctggacgtggcttggcgcaggtggtgtcacctgagtacattcttggctagcagacagtggatagaggcccctttcctcttcctcaccaaagcctggggctgtcgccagcctgtcttaggccaggcctttgcagaaggcgctccaggccatgaaagcagcgggtaaaggcgtggtgcctcatggccttg

SEQ ID NO: 599843 - DNA, 269 bp, Homo sapiens
ctgatgctgcaggtactctaaggatccctaggtcttagggaggagggggatgagggggccctaaaccagagctcaccccaaaatgcatttgaccttcactgcatggcaggagtacgatgcgaaaggtgagggggtttgaagatggagtggcagaatgaaaaatcaagtcagtagatgcagaggcgaagtcatcaaatggtaaaccaggagattaaagaaggaaaaggtagggaaaggggtgccgtgaaaggttcttccctaagacctta

SEQ ID NO: 599844 - DNA, 977 bp, Homo sapiens
taagtggataacccgaggttttgagaaacatccttagttaaatctcatcctatgaagtgggtcagttcatgatcctacccagctaaaacagaggccaggagccagggaggaaaagcagtcaggccacgcaacattgtttcgcgaaagtggcacttctctgcaagcctgagctcctgagactgtgcattgtaccctgaaacgcagctttatccatagacttctgtcgataaatggctgtaagtcgttggactccttgctccaaacgcgagcgactctagtcaatagaacctcccagcgtcccacgtcgccttccatatgctgcccatgggctttacataggagcaagagaacatttactccttcgtataattgccatctctttgcatctctcaacatggatgaacaccgatccggactcctgtgtatgtctcgaaattaagcagattccgtcttctgttgcacatatgagaactatgaagagttgtagacggctcttctaaactagctttaaagttgtgatattgacatttatcacaagcatgatgtcagttagagagaatgagattctccactaacatagatgaccctttcatgctgtggcctccatagaagcatgtcccaggccaggtgcccacatggcaggcatttattttctcacagatctggaagctgcaggtccaacttcgaggggtgggtggggttgtatcctctgaggcctgtccttctggctggcagggagtctcttccagccgtgtcctctgttggcctttcctctatgcacacgcacctctgggatctctctggctccaatatcatcttgtggtcaatacaaattaatctatggacgacagagggttagacgatttggtcccgcgcgaactgactgtgggcaattttgggcctcctgtgagcctccgattcccagatttacgagaaccatggggtagaacttcccgatgtcacaggtcgtttacaca

SEQ ID NO: 599845 - DNA, 451 bp, Homo sapiens
cgaatcctatagtgttcccctctctagtggtacactgtgacactagttaactagatcacactagcactggaggaaggtcccatagtggttagaaacataaaatggaggcagggcgccgtggcttggatatatcttccccggcactttgggaggccgaggcagccagatcacttgaggccaggagttcgagaccagcctggccaacatggtgaaatcctgtctctactaaaaatacaaaaattagctgggcgtggtagctgcgcctgtaatcccagctacttgggaggccgaggcaggagaattgcttgaacctgggaggtggaggtttcggggagttgagatcatatcactgaactgtagcctgggcaagagagtgaggctctgtctcaaaaaataaaaagggggggtattgcagacatgtggtggcctctacctagtcgtttaatactgc

SEQ ID NO: 599846 - DNA, 1084 bp, Homo sapiens
ggctgctccggcgcggagcccagagccggttcggcgcgtcgactgcccagagtccttgcgtgcctggggcgctggggaggatgccaagcctgacatggcctaccacagcttccatggtggagcccatcagctgccacgcctggaacaaggacctgacccagattgccatctgcacccaactaaccatgaggtgcatatctatgaaaagagctggtgccaaatggaccaaggtgcacgagctcaagtgagcacaactgggcaggtgacatggcatcgacatgggcccccgagagtaaccgatattgtgacctgcggacacagacacgcaacgcctacagtgtgtgacgcatgaagggccgaacaatggaaagcccaagcttggtacatcctgacggatcaaccgggctgcccgctgcgttgcgctgggacccccaacgagaaacaagatatgctgtgggcagcggctctcgtgtgatctccatctgtatattatcgagcaggagactgactgagtggagttttgcaagcacaatcaaagaagacccaatacagactccacgcgagtcctcaagcctggaacttggcaacaccaagaaatggtgcatcgctaggactggccagggcatcactggtgaacttacaaagtagctccagaatcatatacaagagctacacatccaacggcacgggttggaggagacacgtggacgggaaaccaaaacacccggtggagggccttcccagagaagtgccacctaacggggagaaaacattaactgatacaggaaaatcctcaggcaggtaagcatgacggaatggggtaaacatgtgcattacatgcattgaactatcaaggacagacgacgaggcgaagtccagtctgcttggggccctatggagcataacagaccaaggaacccgaggaaaccccgaggctatgccctttggtaatggcaattgcccgagacaagacaacagacatggagccggccaggggaaagatccatgggacgttacttgtaaagacgaaaaaaacaagcgtgcagtggagaggcatggacacctaataaatcaaaagtacaag

SEQ ID NO: 599847 - DNA, 207 bp, Homo sapiens
cgagaggttcatgacagttgtcctactagatagtgaccgtcatgagatctggggatgacctacagaaggaggaacacaagttactacactaacactatagctactacggtccactacatattccaatcagcttgaaggaaagggggaatttatcttaacggatcctggagtatcttgtgtgaatgggatatcctctatgagtcgacc

SEQ ID NO: 599848 - DNA, 832 bp, Homo sapiens
agcggacgctccaggccgggaggcccagcgagcggacgccagtggatgacccgcggtgggggaggaggagataccatcagtcaaaatgccagacgtctagacggagagtgtgcccccgtagaatatcctggcggacttcatgagggctatggtcgctgtcatgccctgaaatgctcgaggagcctccccatggaacgaggcaacgagcgggcctccggatgacccgccgctcgccgtgatcttggacagacaacctgttgaaatgaaagttttgccaaagcgtgaggcaacacaccgatttgcggattgaactcgctgatgtactaacagtggacacgaagaacggttttaccgtccaaagcacgtctgccaagggcaaccggtcggatggagagactgttgcactacattgccttttctgggaccatcttcaattgaagcaacctaatcacgcaactccgccctgaccttctagcgtggtgcgctctttgaaacttcgtgaaacgaacgctctactacgaggactctttgctaatcacttgcgtattgaccacgccgagaaccgacgcatgatgaacttgagcatttgaacggaagcgtcctggaacgtggtccttgctccagtcgcgaggaggcaagaaacactggggggcccttgaaaaggttccgtctatcgtcgtcgtaaggtaccgattcttgcacgcattgactgcgcttttggctggggttgcaccaagttcgagatgaaggcagtgaagatatgtagaaaaaaattgacggattcctgatttggttactgaagagggagtctccaaggatcgtggggcggatg

SEQ ID NO: 599849 - DNA, 1169 bp, Homo sapiens
  misc_feature (670)..(670): n is a, c, g, or t
gttttgtgttttgttgtgtgttttgtgcgcgagagagagctgcagccaagcgaggaggtagggaagacacggaacagcgcgcttgtttgtgttgcggtgctactactttgtcttggttgaagactcttcttctgttctgtgcttttcctcttcttccctcccgttcgtgtgggagccccctccttcgttttaactttgatacacatcttggggctgttgtttgcaaccaccgccggcgttgttagatatattgtctgagctcccgtggttgacaccttggggcaacacagaggggcgacccccgcttgccattgaggtgttgccatgttccgccttggttcccatttcctacccagcgttgtcccttgggcaacataagttgttgttgggcgccaggcagagttgcgggtccaatttggcaagggtccagcattagagattcccccccccacctcgtttgtccactttggtctcacccactgcattgcccataacccaatggcgttgtcccacgggctgcccccggttttcccaacgggcccagcttgggaggctccccacgccctctccccccttattgccgcacggcctgcctcgatgcccacccttcacggcatgccttatgggaactccgggccccactctgtccactcggtccacccgctgtggncccgaagtgggtcccgttgttccccgcacacactccgtgggctgcgcctcaagacacactcttggcacggaatcttttctggggcctcacccacgacacaggaagcggcgttgtccaagcccgggcacaggctggtccaccctatgagcccaccacgcccctctgggagagcacccccaccctcctgtcgtgtgaatagtaagctttctctccctcacgcctcgccagggtgccgagtttgcccctcgccaaaagagccacctcctactctgtttttctttctgtattttgagtaaacacctgagagctcggagctgttaaatttattcttggggagaaccctccacgaagctggttctatttggtggttcgtggaacctcttactgctttccatacccgattagtaatccactgttttgtaaaacttgttttcacgtttcctttcgaccaaccagccccgtaattatagctattagaattaaatctcttaactattta

SEQ ID NO: 599850 - DNA, 848 bp, Homo sapiens
  misc_feature (186)..(186): n is a, c, g, or t
  misc_feature (645)..(645): n is a, c, g, or t
  misc_feature (689)..(689): n is a, c, g, or t
  misc_feature (695)..(695): n is a, c, g, or t
agcggggctgtcgttgtcccgcgagccgccgaccaggcctcgaacgggatggcagaggaggtgaggagggaggaagcgtccggagtggggcgggcccggactccgacccccggggcgcttcgagccccccagctggtcaccgaggcaccgccgcttcacccagtgccagtatgccgccccctcgcngcaccccggccccgcctcacacgcgcgcccgagctgagccccgggctcccctcgggcccagcgtggcgcagggtgtcagtggttctctcgggtctctgggacaggtgagcaccctgatgaaggccacggtcctgatgcggcagcctgggcgggtgcaggagatcgtgggcgccctccgcaagggcggctggagacctggttacaggtgatttctggattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaacggagaagctacctcatatggtggaatggtggaccaaagccgcacaatctcctatgtcagcagaagattcagaagtntcagatagcccaggtggttcagagagtccaatgcaatgctcagngaaggntataagaccttctacaacacaactctaacataacaaaattcccttacgatataactgcgggcatagatgatatctgcaaaaataaccgcagataaagtgtcaccaaaatcaatggtttacaactgaaaaagaaaagcacccagaaaaggcgcc

SEQ ID NO: 599851 - DNA, 148 bp, Homo sapiens
tgtgagcgataatcagggttgttgatgcagacagttgctaggtagatggggatgatgtgctgcttacacatcagacctagcaactgtctgggctagtcgtgtggccccgacctagccctgacacgtgtgtgtcgcacgtgcgtgtgtt

SEQ ID NO: 599852 - DNA, 500 bp, Homo sapiens
actgcaagctgtgctctgacaaaagtgattgaaacacaaagatcaaaaaagacaaaaaagggcactgcataatggtaaagggaactattcaacaggaagagctaactattctaaatatatatgcacccaatacaggagcacccagatgcataaaacaagttcttacagacctacaaagggaattacactcctgtgttaataatagtatgagattttaacaccccactgtcagtattagatcaatgagacagaaaattagcaaggatatccaggacttgaactcagctctggatcaagtgacctagtagatgtctaaagaactctctaccacaaatcaatagaatatacattcttctcagtgccacatggcacttattctcaaatcaaccacataattggaagtaagacacttcttagcaaatgcaaatgaactgaaatcataatagtctctcggaccacagtgcaatcaaattagaactcagggaggcacagattgcagt

SEQ ID NO: 599853 - DNA, 274 bp, Homo sapiens
  misc_feature (87)..(87): n is a, c, g, or t
agtgtaaagggcagggacagttggagtccaagcatttgctgatgcatagctcattattcccaaggtgtcttgctcagacactctggntgtttgaccttcaggaaacattagttcacacattcaagcagaaacattcacgaatccaggtcagcttgtggggttgtggacctgaacacaggtgagcccaatggttggccagcgcaagtaggcgtatgggataactactctgtggtccagaaaccggttcttcactctgccctggggattgccacaa

SEQ ID NO: 599854 - DNA, 1253 bp, Homo sapiens
  misc_feature (501)..(501): n is a, c, g, or t
  misc_feature (509)..(509): n is a, c, g, or t
cagggtcgctcatgcctgtagcccgagcatgagggtgagatggtgggagcacgggagggcaggaggtcaagaccagtctagccagcatgcagaaaccccagctgtgctaagagtacaccctttaggcagggacgatgacgcttgcccggaagcccagctacttgataggctgaggcaggagaatggctcgaacccgggaggtggaggctgcagtgagctgagagcatgccactgcactcaagcctggtgacagaacgagactctgctgacacaactatgagaatgagtcgaccctagagtagctactgatcaagggcaggctatagcacaaccagactagcacagttagagccagggacagcgcccaggaggaacggactagtgataagcactgaactgtgatgatcttgagccagatccttgacacacctctctcctaccagcatacggttcatatgtgccagacctgctgtgacagactgcgtagtctggtgaagtagncgttcganaggagtcgacctgcacctggtcctgcgtctgagagtggtaagcagatcttcgtgaaaaccctgaccgccaaggacattactctggagggtgagcccagtgacaccaatcgaaatgtgagggccaggatccaagattaaggaaggcatccccccgaacagcgaaggcttaattttgcaggcaggcactggaagatgccggaatcttttggctacaaatcccaaggagtggccctgaactgggtctggcttgaggcacgctgaattcttagccaggctttgcagtcccaaggatgcataacttggccttaggcattgcccacttaagttagagatcccagttagaatagctaacctgataaaggttaacaggtttcgtcgggaaaaaataaggacccatctagaaaattgctggcccttgccaaagatttatacttgcaattttacatggccagcattggcactaggcatatccctatggggcgataaaacagtgggggtttcaaacggttgggaaaccggtgtcccattaatcctggaaacccttttgacgggcgtaccaggatccactaacgctttcaacgtcgactgtggttcgaacctcgctacctttacaagcgtgattcgtgatctctttttcacagccctgtacacctctatacaccccacgttgttctccactatagctttaattcgtcactctaaccatctacttttcggagtctgcacccttcgtggggcgggccc

SEQ ID NO: 599855 - DNA, 249 bp, Homo sapiens
tattcaacgtcaatcgcttcaccagacttttctcttgaaagtctgtccagactttcaactaacaatgtagttcctggcaatatataaccatgctctatagcatctaaaaattccgaaaaagctcctgattgtgcatgctttcctttgaatgcacttaatcctaaatcttcatatgttatggtatcaagataataatcactatttacctttaaccattcagcaataagtcttctctgtcggtttaatgag

SEQ ID NO: 599856 - DNA, 448 bp, Homo sapiens
  misc_feature (1)..(1): n is a, c, g, or t
ncctggccggtgaagagagaatcaaaataacctacgaagattttttgaaaacacaccaggtaaggaagggttctgcaattctaccacaggaacagttaccataacttaaaaagaaatgctttccacactgaactgacagcgctgcagaccacgcctgagtggggacggcagccccaagcccaggggcaagcgcccacaggctggacccaggccaggcacacctggggagtctcttactgctgaaaacctcagccatctcacttcatgtacttatcctgctggtcagccaggattttggcggaggacttggcatcatagaaaagttcactgatctcttcgacatgctctttctcaatgctgtccttcccgttgattttagcaagcaagttggccggggtcagcaactgcactgagtacctcaatgtggtcttggtgccaatcttcctca

SEQ ID NO: 599857 - DNA, 271 bp, Homo sapiens
gaagacatctctggggtaaggagagaaatactggaatttcttttttatttaattatgtagaaatttttctatatatgttacaatgcatattactgtagtcatatatgtatatgatgtacacgtaattcataaatacacatatgtttggctgcctcttaacatttttggtcatggccatgtgtaatcatgccaaaaattgaccacaggtctatgtaaagggtcttcataaatggaagaagtccctgtgtaaaatgggagatttcaaggcatt

SEQ ID NO: 599858 - DNA, 240 bp, Homo sapiens
tcgaggaggctacccgccgaaatatgatcatctatatcgccctctattgttccccaccgtccagagatatctcatcgagcaaccgacttaagcacgcagcccaacactgacgtaagtcacagctaacctcgaaaagcaaagtgataagcatgcattacactaaaggacgaacctgatctcttatgctagtatccttaatcatttttattgccacaactaacctcctcgaacgacctaccg

SEQ ID NO: 599859 - DNA, 375 bp, Homo sapiens
  misc_feature (121)..(121): n is a, c, g, or t
  misc_feature (223)..(223): n is a, c, g, or t
  misc_feature (369)..(369): n is a, c, g, or t
  misc_feature (371)..(371): n is a, c, g, or t
  misc_feature (373)..(373): n is a, c, g, or t
agttatgtttctatctttaagtagggagaaacatgaagaggaagacaatagagtttgggatgagctgctgcccagagccctttgtttctgtcctcaggtaaaaatatcctctagacctgantcccattggatggcagccttgtggaccctgcagagatgtcaccgtagagaaccttctgtcagctacccccagtcactaaaggaaggatagaaggatctgtgncctggaagtttaggactttgcagaatgtaacttttaggatgaaggctggaaacagtgcaaataatatctggacactgtttcacactctgttcgttgcaaaaaagggcatttaaaaccctccctttgatgtgatgaaatttccaatnancnca

SEQ ID NO: 599860 - DNA, 292 bp, Homo sapiens
  misc_feature (103)..(103): n is a, c, g, or t
tcggtgctggggacagaaatctcccccgagctcgtccccgctcgtcccggcgagaagatccagtccactcaagcgaagataggtccctacgagctgcaggacnctaccctgtaccacctgctgcgccacgggatgcgccccagccggatcattttcctgtcccaccatgcctggcgggatgcatcggtaggctcctggcctcccgggttccgtgacgaggaccgacactcctatgacctgtcagcaatcaaggactggacgcggctgtttctgcgccggttcgtcggaaatc

SEQ ID NO: 599861 - DNA, 371 bp, Homo sapiens
gccccctaccagcagcagcagccacagccgcagccaccgcagccggcttcgtcggggcccccctgcacaggggccaccctcagcacatgcagcagatgggcagctatattggacgttgggatttttccatgccagcaccatggtcagccacaccagacgggttacccagttttcccacggccaagagggcctataattaagggaaatccttttattcccaccttagggccctgcccacttgtcccacgtgtccccagcagagtccccgcatttgcacctttcttgctttaaatatggggcagcagtttattacaacccctttattattctcaatggaggagcccctgtcccccacgccagagctccccaat

SEQ ID NO: 599862 - DNA, 118 bp, Homo sapiens
  misc_feature (69)..(69): n is a, c, g, or t
tagcactaatatggagattatcctttcattgagccttttatcctctgttctcctttgaagaacccctcnctgtccccttcaaagagaacaccctaaggcccataatacttcagatatc

SEQ ID NO: 599863 - DNA, 705 bp, Homo sapiens
gagcgagctgaatggttgtgtggctcatcgtctcggaaaccggtagcgcttgtgatatggctgaccaactgactgaagagcttggatgcacgcaattcactaggaatgcttcttcactatttgatcaaagatggtgatggatacatatatacaactataggaatggggaacgtgtaatgagatcgtcttgggtagaatggcacgagaagcatgagttacaggatatgattaatgaagtagatgctgatggtaaatggcacaatggattcccgtgaatttctgacaatgatggtaagaagaatgaaagagagtagacgagtgaagaagatattagagaagcgatgccgtgtgtcctgataaggatggctatggctatattagtgctgaagaacttgggcatgtgatgacaatgctgtgggagagaagttaatcagatgacgaagtggatgaccatgatcagggtaagcagatattgatggtgatggtcgagtaaactatgaaggagttgtatcaaagtgatgacagcgaagtgaagaccttggtagtgaatgtgttaacatttcttgtgcaaattgttgattggccttttcttgtgtatgacttattgggaaggttctccctatgtgaaaatatgcatgtatgtattagacttattcctcagtgtcttctattaatgctgtctaaactattagaaatgtcagtacg

SEQ ID NO: 599864 - DNA, 208 bp, Homo sapiens
cacattgacacacagtttaagcttttatattagtagcagttgaatatatagattaattttacatagattaatttactatttttctttgtttaaacagagaaccaattgaaagccgacagatactgcaaatgactggaatttttgtttctgccttatctttttgtgtttttttttctgaataaaatattcagagggaatgcttttacag

SEQ ID NO: 599865 - DNA, 1146 bp, Homo sapiens
ccattccaagttgtaaatgctagtctttcttatgttttgttttccagattaaaaagaccagttacgctctaagatgtgggtgtaaaagtgcttggataaagctgagaagtctaaagtggggacaaggcaggtgtggaggggaggccaggtgctacatgtgttaacatgtgcccacaggcccagacattggggtttcccttcccaagggccccaggaaccaaccttcgtgaggcccaagagaccttgtgccggtgaaaacaaggcatgattacccggatgtggcgtatcaatcccataaattgtaggagaccattgttggggctcatacggtgggccattttcaccgctgtggtgggcgaagcgcggcggaagagggcgcaactcagtggactaacctcttacacagtgatctcatatatctcgacgcgccacgtctagaagccctcttatagagggcacacacaacaaaaacacccccaatgttgtccgctctgctagagaagaacgaggtggattatttataaaaggggagcgtttgtgcctcgccccccaaacgtgtgtgtagcctgtagacgagcgcatctaatcagccctgtggcgtcccttaaaagtcgtataaagccatcagtggtttgacaaaacaatcccagtctgctggtggtccaaatgagaacaaacaccgtggtgggatatctgttcagacagacgcggtggtcgtaattaccggtgggtaatacgattctttctaacaagaaatattttctttactgccgagcacggtggatcgaggcggtatggcagtcgggcggcatacagaaccacaaggggccagacagctcaattgaatgcaccgacaccacatgcattctagctatggtgggtatcaacgacggccccccccagatgagatacatgcttccatagttacttacgatggtagggccccctagataaaacagcgcgaagggaaatacgcaacatatattaaacgcgcaagcgggtactgcacaccacccatttgttgggagaaaatttctccagcagcggtagacgtggttgttgagagaaacgagggttgatagaatagcggcaacaatcataactcgactcgactagcgagggcccccatccatcactgccgccttc

SEQ ID NO: 599866 - DNA, 504 bp, Homo sapiens
cagcctgtactgtaactgtctggccactgcagtaagcaaagatgcacaagactgtactagcataccagccagatcttacatactatacacataattcagtaagacaaactaccaatagacagaaccaccagttgtagctgcaggtaaaaatgacatattatcaagtaacagccttcaacagaacaggtccaaatgctaggttgacatggatcacatttgccattactaatgcacacggctagaaatcgggcacacttatgggctatacttcgtcctgcctcaaagaagcaaacacgtacgatgtactgacagacattttcgtagtagaatgaaagtagagttctcatttccttcctttgagcttccgggtccattagaatgaactccagctaaccaaaagagagtatccaacacaaggctctgggcatgtactgtgatctggccatcatctgtaatactgcaaagagtatacagcagcttctcatgaaaatctgaaaactgtaa

SEQ ID NO: 599867 - DNA, 2476 bp, Homo sapiens
  misc_feature (298)..(298): n is a, c, g, or t
  misc_feature (432)..(432): n is a, c, g, or t
  misc_feature (1349)..(1349): n is a, c, g, or t
  misc_feature (1366)..(1366): n is a, c, g, or t
gctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatgngtctggtagaaacaccaacaggatacattgaaagcctgcctagggtagttaaaagacgagtgaatgctctcaaaaacctgcaagttaaatgtgcacagatagaagccaaattctatgaggaagttcatgatctntgaaaggaagtatgctgttctctatcagcctctatttgataagcgatttgaaattattaatgcaatttatgaacctacggaagaagcaatgtgaatggaaaccagatgaagaagatgagatttcggaggaacttgaaagaacacaggccaagattgaagatgagaacaaaggatgaagaaaaaggaagacccccaaaggaattcctgaatttgtggttaactgtttttaacgaactgttgacttgctcagtgatatggttacaggaacacgatgaacactattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcnactggtctaccttctgncttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgatggatgctgttttcttttaaaaaaaaaaaaaaaaattcattttcttggggttagagctagagagaaggccccaagcttctatggtttcttctaattcttatggcttaaagtatgagtatgtcacttacccggtgcttctggtttactggggtaattaaaagggggtagtactggtgttacctaactacctcatggatgtgtaagggcatatggagttaaatctcatataaggtttctcaatctggttaaaagctcaaaattttggggcctatttggtaatggccagtgtgacactaagcatttggttcacaccacgcttggataactaacctgggaaaacaagggtgttaagtacctctgttctggatctgggcagtcagcactcttttaagatcttggggtggctcctatttttatagaaagtgggggggatgcctatttcacaggtcccagattgtgtttccagatattttggatgactgtttgtaaatactacagggatagcactatagtatggtagtcatgagacttaaggttgaattaagactattttgtgacaaagatgcattaaatttcagactgttagagccaaatttacaatacctcaggtacttactggtaattttggggttgaactttttttttgacagggagggggggtaatggtttgtccatagaggaggtctaaattctgcctaaaaaaatacatgaattggtttagggtatggaacttctttttggaatatggttagttggatgaccattgtgttggtcatcttctggataatttggaatacaatataatttttaa

SEQ ID NO: 599868 - DNA, 2557 bp, Homo sapiens
  misc_feature (1430)..(1430): n is a, c, g, or t
  misc_feature (1447)..(1447): n is a, c, g, or t
gctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggatgcagagaaactaggatacgtcaaagacacgtcttagcctagactggttcagcattgattgcctaacaatcacttctaggattgcttgctacgcccattctaagcaagagcacttcgatcggtcatgagttagatagagtaccgaactaggaatcaccattagcaagagccttgccttaggagtcagttcacataaggaccggagttgaatgcgtactcaatgaaactcgtgctaccagttaacactgtggcacagatcaggaagcccaagattctcatgcaggaagtctctatgcatcgttgcaaccaggaagtatgctgttctctatcagcctctatttgataagcgatttgaaattattaatgcaatttatgaacctacggaagaagcaatgtgaatggaaaccagatgaagaagatgagatttcggaggaacttgaaagaacacaggccaagattgaagatgagaacaaaggatgaagaaaaaggaagacccccaaaggaattcctgaatttgtggttaactgtttttaacgaactgttgacttgctcagtgatatggttacaggaacacgatgaacactattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcnactggtctaccttctgncttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgatggatgctgttttcttttaaaaaaaaaaaaaaaaattcattttcttggggttagagctagagagaaggccccaagcttctatggtttcttctaattcttatggcttaaagtatgagtatgtcacttacccggtgcttctggtttactggggtaattaaaagggggtagtactggtgttacctaactacctcatggatgtgtaagggcatatggagttaaatctcatataaggtttctcaatctggttaaaagctcaaaattttggggcctatttggtaatggccagtgtgacactaagcatttggttcacaccacgcttggataactaacctgggaaaacaagggtgttaagtacctctgttctggatctgggcagtcagcactcttttaagatcttggggtggctcctatttttatagaaagtgggggggatgcctatttcacaggtcccagattgtgtttccagatattttggatgactgtttgtaaatactacagggatagcactatagtatggtagtcatgagacttaaggttgaattaagactattttgtgacaaagatgcattaaatttcagactgttagagccaaatttacaatacctcaggtacttactggtaattttggggttgaactttttttttgacagggagggggggtaatggtttgtccatagaggaggtctaaattctgcctaaaaaaatacatgaattggtttagggtatggaacttctttttggaatatggttagttggatgaccattgtgttggtcatcttctggataatttggaatacaatataatttttaa

SEQ ID NO: 599869 - DNA, 138 bp, Homo sapiens
atggcgctggtactgcataccatcctgggccccatgctgttgaaccgaccactggcatgggtcaccagcagcctgccctcccctagcaactgaaggggaagatcctgctgaaggggaagacgctcggggggctcctgc

SEQ ID NO: 599870 - DNA, 1320 bp, Homo sapiens
  misc_feature (298)..(298): n is a, c, g, or t
  misc_feature (432)..(432): n is a, c, g, or t
gctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatgngtctggtagaaacaccaacaggatacattgaaagcctgcctagggtagttaaaagacgagtgaatgctctcaaaaacctgcaagttaaatgtgcacagatagaagccaaattctatgaggaagttcatgatctntgaaaggaagtatgctgttctctatcagcctctatttgataagcgatttgaaattattaatgcaatttatgaacctacggaagaagcaatgtgaatggaaaccagatgaagaagatgagatttcggaggaacttgaaagaacacaggccaagattgaagatgagaacaaaggatgaagaaaaaggaagacccccaaaggaattcctgaatttgtggttaactgtttttaacgaactgttgacttgctcagtgatatggttacaggaacacgatgaacactattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagacttgaagtgacagaatttgaagatattaatcaggttacagatgagatttttatt

SEQ ID NO: 599871 - DNA, 281 bp, Homo sapiens
cttacagtgtagattctgactgtcctgcagcagatttgagtgtgagtactgaatctcatctttggtggagcttgggtgattgtgtctcagtgtgagtggtgtgcaggatgacaggacaccattcattgtgagtctgagtttagggcactcttgggttctcatgtctcctgaggctcacataagccccaggtgaccagcctacctgtgttcgtcaaacatatgagtgtttgactggacttctttgagggatgggggtgctggcagagttgcagataaagacc

SEQ ID NO: 599872 - DNA, 257 bp, Homo sapiens
ctggccctgtggttcggcaagcgctcatctcgcctttcaccagccatcctccgtgaattagaaaacacggatttccatctccaatgagtgtttggttctggggcagggttgaggctccagtccgcagtgtgatcttggctccacctgctctggcctttccccggctgccctatgtgtgcgccccagcccggggctcccagcctgaacctgatgcaaggccatgctgacgtccttccggcccttcgtgactctgtcgc

SEQ ID NO: 599873 - DNA, 235 bp, Homo sapiens
aactgcgaccatcaggtatcagcatagtacccaacaggcaatatcaatcttcatcctcttcccaacctccacccataagcccgtgtctactgttcccttctttgagtccatgtgtaatcaatgtttagctcccacttataagtgagaacatgggatatttcattttctgttcctgcattaattcacttaggataagagcctcagctccatcgtatgttgtctgtaacagtgacac

SEQ ID NO: 599874 - DNA, 142 bp, Homo sapiens
cgatagtgagtgatgacttggactttgaaacacacgaacctgcgaagaggctatccctgaaacgaacactatataatctcaagtcatacattgcccagatggaccaggaactagcacacgcctcaatcagcaaaagtttcac

SEQ ID NO: 599875 - DNA, 702 bp, Homo sapiens
  misc_feature (547)..(547): n is a, c, g, or t
  misc_feature (585)..(585): n is a, c, g, or t
aacaatgtaacatagatacaatataactaaagtggtatgaccagtaaaaaaaaaaaaaaaaaaaaaaaaaaaaaaaaaaaaaaaaaaaaaaaaaaaaaaaaaaaaaaaaaaaaaaaaaaaaaaaaaaggggggggggggaaattttgggggaaaataaaaatttttttagaaaagggggccgctgtttgggggtgcttttattatactggctgcgccgcggggggctgcgttttatataaaaaaggtgttgtgtgtggggagacaaacctggtgtcggatgggtgattatgttggaaaggagcctccacatttgtcttgtggagagggagataatacaatatgaggggaacaaatcaataccatcagaagatatgtatattaagagttgtctgcaggagaggaatatactccataacaatgatcgaaggagtggagtattgaggtgtagggagtaaaaccacccgaatcgctgctatctattagtgctgtagcgtgagcaggaaagaataaattctggtccaccgacggatgtttatttatgatganagaacaatatttttcgataaccgggagtcgcgctggtnagatagtaaatcaggagcgacccagccgaagaagaaaaacgaagcatggcgactgactacgcacgatagatgactaagaatcaagacgagagatgggagacaaaaagtatgatcgcg

SEQ ID NO: 599876 - DNA, 1320 bp, Homo sapiens
gccctgatcaaccgtgtttatcccacgcggggtagtgtgtataattccttgcgtgcgagatagtgtcgcccacgctgataatgcttctttagtaagtgtgaacatctcttttttcctcgtgggggagacgacaattttggggggcgctctccaaaaggtccacaaacggaagcggtgtttccctttatacatagggaaagttagtcttaccttctggtagggcacaaaccgcgtttgcgcattgtgtgtacccacgacacaagtacttgttgccccccccccccaactttggggaaagaccgaacccttgggggtttctaccttgctccaagaggtgggattcgaattccgcttggtaggacccccaatatcccgagaggcccccaaaattataaaaggcgtcgcccgggggcgttaaatggccccccctggcttattttctggcactgttggccccgaaccaccaggggtcttaccacccaatgtggcacaaatgcccctatattttctacctttgagcgactttgagagggggaaacaaaagagttttgtggatttccccccctgtttttctctggtcatataaaaggtctcgggaacagattgcggccccctctaaatatttctcttgaaagtttctcgggtgcagagatgctcgaccactatacgtgtttgagatattgggtttccccgggccaaaaccccccacatggtgttgctttgcaagagagccttctctcacgaagactattcccccccctcttttggcgatctcccctgtctgccgtgtatgtctcgtcgaaatatatgtcagagcaccgacacaccagtttgccgcgttgaggtcgtgtcacttcacaaagccacgtgggaccacaagaaaggcctcgctctcggagagcctgtgccacaagtgtgccccacaaagtgctcggcccacagacaaagctccacgaaaaggcctatcaattgaaatacttatgccctatataacctcgccacccccaccttcttaatccacgttggtggaagaaccggctttcaagaacactcgtttgtttcacacattggccaccttacagtttaagtaagtaaaagagctggttaaatgaataatcacaatgcactcgtaaaacccttcacgaaggaaaaggagaatgttttgtggacccacctttggttttcttcttttgcgctcgtggcacgttcttaacgcttatttatcattctttaaaaatcagtactttttaatggaaaccacttgacccaaaattctgtcacagaattttgagaccccattaaaaacagttataatgagta

SEQ ID NO: 599877 - DNA, 302 bp, Homo sapiens
cttctctctgcttccctttgtatcgtatgtcttgctagttttttgtttttctctttacaagattgctgatggtatggcatatattgagagaatggactatattcaccgggatctcgggctgctaatattctgtagggagaaatcttgtgtgcaaatagcagactttggtttagcagggttaattgaggacagtgatacacagcagacagggtgcaaaatttccatcatatgacagctcctgagctgcactgtatggtcggtttacaatagtctgatgtctggtcatttggattctgcaacag

SEQ ID NO: 599878 - DNA, 234 bp, Homo sapiens
catggcaacaggcactggaaattagtgttcctgccaagcccaggaccagtcccctgggatttcccatgggttccacatgagacccttgtcccagaccttgcaaggagaggatttctggaatgactgaaagaccaccgaaaaggatcccccttcaaataggaaataccctgtttgaaagtatagtgaaaagaagttcagttaggagtataaatttaaaatatatgaaaaaaaaaa

SEQ ID NO: 599879 - DNA, 157 bp, Homo sapiens
tgtcatctcattcttctcggtggaccatgcccggacctcgctggagaacatccccgagaatgtgggtccccgatgtgtgaatgcacttcttgtcccaatgtgcccatcatccgtggtggccaacaaaaacagacctgctgcagcgacgacgcatgtc

SEQ ID NO: 599880 - DNA, 121 bp, Homo sapiens
  misc_feature (92)..(92): n is a, c, g, or t
cccagctgacgtttctcccccgagtttgtggacttcactgctcagtgcctgagggaagaaccccgcaggagagtatagagctacctggagcntgatggagcacccctttcttcacctttgc

SEQ ID NO: 599881 - DNA, 545 bp, Homo sapiens
agcagcatagcaccatatagggatgtccatgatccaacatcgaggtcgtaaaccctattgtagataatggactctagaataagattgcgctgtatatccctagggtcacttgttccgtaggtcaagttattggatcaattgagtatagtagttcgctttgactggtgaagtcttaacatgtactgctcggaggttgggttctgctccgaggtcgccccaaccgaaattatataatgcaggttaggtagtttaggacctgtgggtttgttaggtactgtttgcattaataaattaaaactccatagggtcttctcgtcttgctgtgttatgcccgcctcttcacgggcaggtcaatttcactggttaaaagtaagagacagctgaaccctcgtggagccattcatacaggtccctaattacaggaacaagtgattatgctacctttgcacggttagggtaccgcggccgttaaacatgtgtcactgggcaggcggtgcctctaatactggtgatgctaagaggtgatgtaattggtacacaggcgg

SEQ ID NO: 599882 - DNA, 295 bp, Homo sapiens
ttttttggggttttgggggccccccccctaaccgtcccccttttggtttggggggccccgcgccgaaaaacccaaacttttttaaatacaaaggttttccccctgccccaagacccattttaacttttttagccccggcaggggggtttgcttcccaaaaaggcctcttttccccgggggtttcccccaagggtggggccccccttggaaaaaaaaaaattgcccccccctggggggaacaaaaacccgttccccctgggggtgtggcccaaaaaaaacccctttttttttttta

SEQ ID NO: 599883 - DNA, 206 bp, Homo sapiens
tcctggtacccagccatttgcccaggggtgccccctcctttcccatccccctgccctcgtggccagcccggctggttttgtaaaatactgggttggggcccagtgatttttttttttttttaaacaggcccagcattgctggttttatttaatggacatgagataatgttaaaggttttaaagtgattaaacgtgcagactatgca

SEQ ID NO: 599884 - DNA, 470 bp, Homo sapiens
  misc_feature (15)..(15): n is a, c, g, or t
  misc_feature (61)..(61): n is a, c, g, or t
  misc_feature (129)..(129): n is a, c, g, or t
  misc_feature (210)..(210): n is a, c, g, or t
  misc_feature (279)..(279): n is a, c, g, or t
  misc_feature (409)..(409): n is a, c, g, or t
  misc_feature (434)..(434): n is a, c, g, or t
  misc_feature (449)..(449): n is a, c, g, or t
  misc_feature (459)..(459): n is a, c, g, or t
caaaatgctgggatnacaggcatgagtcaccacgcccagcctagatgtctttactattctnaagatggcagtagtccccaagttgatctatggattcaactcaatccctctttaaaccccaaattgctnttttttgtagaaatcggcaggctgatcctaaaattcatatggaaataaaaagggactgagaatagccaaaactattgaaanagagtaacgttggcaaggttatgttgcttgatttcaaaacttactacaaagctagagtaatgaagactntgtggtactggccataaggatgaccatacagacccgtgggaccggaattgaggatccagaaataaatgcatactttcacaacccatcaatttttgggcagcggtgtttaagacagttttttgggcaaagnattgggtttttccacaggtgatgcnggggacaactgattntcccctgaanaggatgaagtt

SEQ ID NO: 599885 - DNA, 246 bp, Homo sapiens
gggggtgggggttaggattaataaggtgaactgttcaggaattttttgccccagctgggcaaaaaagcaaaaaacaagcgctgctttggcattaatcccaggaacccctaacagtagtgggggccccccaatttaacatgagcccaggggtttcatgacaaacattactagcatgttcaactgccccatgttttggccctgttttttgaaagcccttaattttttaaataaattgtatattttcca

SEQ ID NO: 599886 - DNA, 688 bp, Homo sapiens
gagagacctcacccgcttagtgagatggccccgttatatcaggttgctagctggcgagagagccatcctctataaatcggactgaacaggtgcctcctgcgattaagcacagttcacccaggccctggaccggcgaacagctactcagctgtttgagctggccgcatcgaagtacatgaccatgagacataagcataggagaagaatgcagagactgttggcccgggccgagaagaaggctgtgtggctaaaggggacgtcccaagctagaagtagtaccacctgtccgttcgacgcaggagttaacaccgtcaccaccttggtggagagacaagaaagctcagctggtggtgatttgcacacgacgtggatcccatcgatgctggtttgtcttcttgcctgccctgtgtcgtagaatgggggtcccttactgtcattatcaagggaagaggcaagactgggacgtctagtccacaggaagacctgcagcatctggtcgtcttcacacaggtgaactcggaacgacgaaggcgcttgaggctacagctggttggacagctatcaggaccaattacaagtgacagatacgatggagatccgccgtcactggggtggcactgtcctgggtcctaagtctgtggctcgtatcgccaagctcgaacaggcaaggctaaacgaacttgcacta

SEQ ID NO: 599887 - DNA, 95 bp, Homo sapiens
aactcattccagtaatatattcaaacgaaacagcttggaaaagagggtgggagaaagggaagtgagggggaagataagaaaggaattaagtgatc

SEQ ID NO: 599888 - DNA, 152 bp, Homo sapiens
  misc_feature (50)..(50): n is a, c, g, or t
gcggaccagctagagcattgagccgctggcaggctggtcctgccccgagntctagtcacctggggcctggctgatgtgacttcctgcgatctcataactatttcctcaccagtgaaacacccccagtgcccagtgtcagctagactcggtgg

SEQ ID NO: 599889 - DNA, 87 bp, Homo sapiens
tgggatgttcagctccatggggccgcccttgttgtcgaagccccaggcgcccagttccagcgcgcgctggtaggcgtgggcggggtt

SEQ ID NO: 599890 - DNA, 121 bp, Homo sapiens
  misc_feature (13)..(13): n is a, c, g, or t
  misc_feature (63)..(64): n is a, c, g, or t
  misc_feature (74)..(74): n is a, c, g, or t
  misc_feature (79)..(79): n is a, c, g, or t
gcacgagaaaaancatgataattctttgagtagatgccccggataatcctctgaaggaagagnntttagtccancttantgaaaaaccatgataattctttgtatataaaataaacatttg

SEQ ID NO: 599891 - DNA, 421 bp, Homo sapiens
atcacggacgtgagacaagttactcgtgtcaaatccgtttggatccactctagcccacaggctaaagcggggggaaaacagggatcccatcaatgcaaacacactttggactacctgccctataaaaacacgcttcttctggaagaccatccaacaggtgagaatgacatggccgatcatgaaacctgcaaacaaatatcagtacaattcaggctttgaccttcctgagggccctctgacaacatccttcaaaggaaaatatgggtgcgtatactactggatgaaggctttttttgaccgcccgagccagccaactcaagagacaaagaattttgaagtagtggatctggcggatgtcaatacccctgatctaatggcacctgtgtctgctaacgaattgacagatacggctctgtgcgcg

SEQ ID NO: 599892 - DNA, 181 bp, Homo sapiens
atacacacgcccatgccacatgctcacaaacatacattggcacatacacaggggtgcgtacacacccatatcaactcctctcaaacacacacatacacacacacccctacacagacacatacacagaggtgcatacacacacccatgccacatcctctctctcacccacacacacccctaa

SEQ ID NO: 599893 - DNA, 263 bp, Homo sapiens
  misc_feature (16)..(16): n is a, c, g, or t
  misc_feature (54)..(54): n is a, c, g, or t
cacagatctgccctantcccgccaggggggctgaaggtgggcagatcactgagntcggagtgagaccagcctggccaacatggcgaaacctgtccgtactaaaaatacaaacattagcccagctgtggtggtggacacctgtaattccagctacccgggaggctgagacaggagaactgcttgaacccaggaggcagaggttgcagtgagctgagatcgtgccattgcactccagcctggatgacagagcaagaccccatctc

SEQ ID NO: 599894 - DNA, 324 bp, Homo sapiens
ggtgttcctatctaagttgtttgtttctatgttggcccggtatggttcccaatcagaggcagctgtttatcgttgtctctgattggggatcatatttaggcagccatttccccactgtgttttgtgggatcttgttgtgttgttgcctgtgagcactgtatttacgtcccgtttcatttattctttattggttttgtacatttcactcaaataaacatgtggaacccagattacgctgcgccttggtccgaatgttatttcgacaatcgtgacacattcagccatatctagtatacttcagccgtaggaaatcaatgtcgacgc

SEQ ID NO: 599895 - DNA, 535 bp, Homo sapiens
acaaatttaacttcaagtaaaaaaaaaaattacaaccacagatttcgcataaatgcaaactggtctttccttgatttccctttgaagtcactaatcagtatctaaacctgttgcactgcaggttttaatcaacttcctgagggctgtgcctgggaggaaggagccatgacaatctgtgaaagtgcaggctcggtgctctggtctgccatctgggtgaggactgaagtggctccagcttctgttttggatgtgaactgactccattggacgtactgacagagctgggctggatcgcttctgtattgtggggctgcttgggcacggaaaggtcttcttgagcttgtcatcttttatcagaggattgataggccagacttctcctgaatgggggggttacagggaacttttgagccagaagaagctgtcacttggccacttccatcctcaagaaggggattccctcctcaggtggcccattggggacccaagcctccctgccttcctcccctaggcttgcccccccttcccgaggggg

SEQ ID NO: 599896 - DNA, 198 bp, Homo sapiens
taagtaatgagtccaatgtacttcatcctgccaacactcgttatttactgctatttttgatagccgccatcctaacaggtgcgaagtggtagttaactgtagttttggtttgcatttatctaaggatggtagcatgtattcacgttttttttttttttggcttcaaaaaatatctattaatttctgtgcccatttcaa

SEQ ID NO: 599897 - DNA, 413 bp, Homo sapiens
aacagatcctctatcaagcgcgcacaactgtgtctagagctcacagctcttgtatagagctcgaggacagtacactgacgctactactatggacgtagatgcagcactgcctgggactatcgacttaccgagggttatgctgacacaagcaaggccaatggcctcacatgtgcagtcacctggactctatgttgctgggcttacagctacatcaggatatgctgtgccggcaccagtctggccatatctgagaaagtaaggggattgagatacgttgcccagtacattgctgactgaacccgatgggagatgactgtgaacacttgcggataccacgctgagagctatttgggatacgaagctcatattatcatattcttttacgagatatagatgatgtctgctcgggcttg

SEQ ID NO: 599898 - DNA, 929 bp, Homo sapiens
gcaggagacctggtactgggtactctggtgaatataacagaggtggtgatgagtggagtgcgctgcaacaggaactgagctgtccctggatcagtgtgcccatacatggcacccacatcacctgcaagaggacatgggacccgcttcacctgctggattcatctgttctgacactgcatcagatctgttgctgcactcagcactggtgcaggagagcgcctacatctgacagacccgtgcccctgcattatgtttgtacttgtgtcgtgcaggaatgagaactgccatgtgatcagctcagcccgtcgtcactccaagctggtccctatggtctccggcgtcatgcatccgattctcctcccagaatccacgacctgggacgagctgacttcaggcccatggctgggcgccaccgtcctgggtgtggcaacagagtgccatgggcattaccacacgtcatggacgtcttcactcactatgtatatcctcaccccaaatggtcaccacactgtggctgaccggccacaaagctagtttactgtctcgaagacactgagtgtcaggaggactgtctccaagcggtatgagtgtgccaactttggagagcaaggcatcactgtgggttgctgggatctctaccggcatgacattgactgtcagtggattgacatcacggagtgtgaagccaggaaatctacattctccaggttgtcatcaatccaaactttgaagtagcagagacgtgactttaccaaacaatgcatgaaatgtaactgctactatatggcccttcgatcctgggtgccgattgccacatttggtgatccttcatgaagaagccaaccggccggttgaacgtaccctggcagaacgaccgttatcttagtccctgctttgacccccgtggcccatggggggttgggggccac

SEQ ID NO: 599899 - DNA, 998 bp, Homo sapiens
aaaaaaacggtgttgaggccaatcccaagaaagccaaacgggttcccaaaggggcacaaacacgggggccaccccacaggggacgtgaacaagggcgccacaaggccctctcacaggggcgaaagaattccacccggggttatagcacggccgcaaaagatcacagagcactttggtgagccaacatatgagtcgaccacgagggctcgcacacagaaaaaaaagtgtgtgcttataaacgggccgcgacctcttatgaggacccccgggggggttttctccaaaataaatacctgcggactttatagagagataagctgcttctatcaccctcggcgggggacaaaatcgagaatggttgtttaaaaaaggggaggaatccccccggcagcacatgtggaatataccacccgtgttggtgagaggctggcgatatagaaagcccacactttgctgttttacacagagatatagacaagagaaagggttatatattgggagaagagcgcccccgagggagtgaggaaaaagggagaacatttctgtcttctcctagagattttgtgagaagaaagagcccaggtacatatatcatggaacacacagcggacaacatgtaaaaggagatatgttttaatgtggaggaaatgataaagccgctgaaagggtcacacctcaaaagaggcttaacccctcctcgtgtggcatcttgtgaacctaggcaacagagaattagcccctgtggatcactcttttattcacggccaaagatgtaatatcggtttcccaaaatagggggacactcccgaagaattgacccgcggggaatatagtattgtcccagagagagcttatgggagaatagttcaaagaacataggggtcccttatgggtggaacaaaagtgtttgtcttttatttcccttttattttttaaaactttttaaacaaactgtgggtttgcccaaaaaataaattgctttttttaaaacctttcca

SEQ ID NO: 599900 - DNA, 816 bp, Homo sapiens
gtcatgacgagtgacgcttgcacaagatgaggggctgtcagctgggtcgcctgcttgttacctctcgtctgactgaaaggcagtctcagagccctattcctgtacctactaattacagcgagcgggaagcagtgagcgcttcgggacgcaattggaaaccagcgtgcagggtcaaagacagagcggacaccccatgtcagtggtctaggatggccagtgaaggcaccaacatcccaagtcctgtggtgcgccagattgacaaagcagtttctgatttgcagtatatgacctggaacggtacaagaatcacaaggttctcccctgtttgcacaactttctgcgagaggtgcctgcagaactacattcctgacccacagtataaccctctcctgcccagttgtgccgcacagaacctccatacctgcccgagaaaaggggtggccaggctccagaacaaatatctttcatcaacacaacctgatggacagtgctgcaagaacgaactccaggcagcaaccgctgaaggagtcttccatcctggagaacagtcactgatgtggctggtggtgaaagcctctcatcatgcacgaaaccagagaggggcactgtgactggactaaaacatgccaggacctgtgagaactgcccatgtgtacgtgagtagcacggaaggggaggacggcaaggacccaagagatcacacacggaaggtggtgaaacaagacaaggctagacacaggaccaggtggatgatgtcaacagaggtaccggaataaatctgctaaagtcaactcagaatcaacaacagataaaacc

SEQ ID NO: 599901 - DNA, 593 bp, Homo sapiens
cggcatgtatgcctcaagttttggggcgctgttcatgtcgcgccccgggtgatcttttcttgcggggtgttccctcctgtcgttgttgccacagtcctggccgctcgcatatgttgacccgatgggggtgttcttcttggaacgggtgcggttttggtcacccacttcggccgggagctgcacccagaacagcgctgatcgtggtttgacaccccccccgatggccttgctgggatggtttgtcgattaccgaccggcgtgccccagtttaaataatatcatatcccctccttttcttgaccctgtgcccccccccctcgtctcgtttttccatagagtcggttatccaccctctttcctgatgacagagtccacacttgaccaacgacccagaaatcagtcttttcttacaggttcccccggggtctacttttcattctgtgtctatttgtttcaatggacaccacaaaaattttcctcttttctatatgtgtaccaatgatccattgccgaaaatctaaacactatcccttatgttcttcaacgcaggggattttccaacaaaaacaaaaaacggaaggaacaaatcacac

SEQ ID NO: 599902 - DNA, 262 bp, Homo sapiens
tgactctacaggattccggtgttcctttgtctacaaatataaaagaattagccaggcatggtggcaacacctgtggtcacagatacttagaaggctgaggtaggaggatcacttgagcccaggaagtggaggttgcagtgagctgagatcatgccactgcactccatcctgggcaacagagcgagactctgtctcaaaaaaaagctatagtaatcaaaacagtgtgttactggcataaaagacatgtagacaaagggaaaca

SEQ ID NO: 599903 - DNA, 337 bp, Homo sapiens
  misc_feature (322)..(322): n is a, c, g, or t
ttgtttgccacttactgtgttccaaaatgctgggcctatttcacattactataatcacactgcgagatagggacttgcatttcgtcaggaatttagcacgaaagattcacaaagtgaatgtgttatacttgtacataaaagggcaacactttcagattcttagtaaataaacagctataaacaaggtcgatggtatctaaacacaagttttttacagtctatcaaataagtagaatactcaaatagctcattcatgaatataattaatctttatgcgaacatattatcagactaatatgatataacgtgtttataccttacnattatttcatacata

SEQ ID NO: 599904 - DNA, 333 bp, Homo sapiens
attaccttgctgagaattaaaaagaaaattttatattagagtgctgtttcttttgtggtaccaaatctttatttgtaataattggggggcttgcccgtgattacattcccctctgggggtggtctctagttctctctcatgaggaggcacgccccacccacttgtggctgcctcagggctgagaaatcaggacccacctaatgtgaagaataaccccagctctcagcaacacggaaagaaactggccagcaaactagcttgaatgattctcacatactgtggcgacaactctgtgcacagaccaaggaaggagaagccgtgggagcccgtaaa

SEQ ID NO: 599905 - DNA, 535 bp, Homo sapiens
  misc_feature (185)..(185): n is a, c, g, or t
  misc_feature (240)..(240): n is a, c, g, or t
gagggactttttctcttctcccttaccccggaaatttttaatattttttcccccaccccccggggcattcattttttaaaaagaagggttaaaagaggacatggcccaactttaaccgttaaatatctgatcccttaggctggattccccaggactggagaaaaatatgctaatataaaaggaanctgtggctagaatagggaggggctttaaaaataatacaataaaataaagaagacnctggggaggtggctaatgcctgtaatcccagtactttgggaggccgaggagggaagaggatcgcttaaggccaggagtttgagatcagcctgggcaacatagcaagagaccccgtttctacaaaaaaaatttaaaaattagcttggtatggtggtgcctgcctgtgtacccagctactcaggaggctgagttgggaggattccttgagcccaggagttcgaggctgcagtgagctatgattgcaccactgcactccggcctgggcaacaaagcaagaccttgtttctggaggaaa

SEQ ID NO: 599906 - DNA, 225 bp, Homo sapiens
ccatagggtagccaggttgatgaaccgcacatgggcgcggttcaagtccgggtgcagttcagtctgttctggcgtggctagggcgcaggtgccagatcgtgcaaacgggcgttggctggcactcatggtttagcttcccaaccgacctggtagagcttgccgagggacttgtccaagggcgcacgcaccaccggcgagtgtaggtagatatcgacgaccttgatc

SEQ ID NO: 599907 - DNA, 432 bp, Homo sapiens
cttcccccccactgacgaataagtagaaataagtgaggatttaactgtgagcctctagtatgcaaatgtatgctgagcggtattggggttcagcagatactctccaaacacttgaaaatactgtcttgtaataattctattatgggtcaatccagagtggatcaaaccagaaatgaacgtctctggccagagcaaaccttactgagagaaataatatatctaactcaggaattgagccaagaaaaccctgggaagtaaatatttctgaagtgaaaagtctcctgtgtgtgtacaaaactatctggttctagtagtagagatagtctcatctctctattaaagcttaatgtgattccattaaatatttgaatcataaaactggaccttttattctgttccttttctcaataaatgcagttctgaatattattt

SEQ ID NO: 599908 - DNA, 298 bp, Homo sapiens
  misc_feature (67)..(67): n is a, c, g, or t
  misc_feature (90)..(90): n is a, c, g, or t
  misc_feature (122)..(123): n is a, c, g, or t
  misc_feature (145)..(145): n is a, c, g, or t
  misc_feature (170)..(170): n is a, c, g, or t
  misc_feature (181)..(181): n is a, c, g, or t
  misc_feature (192)..(192): n is a, c, g, or t
aatgggccaaagtctgagttcttagagactgtgtaccaatgttatgcatagtgtcttctaaatcttntactcttcctaagtagacttggntcggctatcttaggaagacacagcatagaaanntttctctctcttgtgaatattnttagacgtgcaaggttgaaaaaaantaaaaagaaantgagggcaggnttccagggccctgaaatgtaggtatgttgcaaggcttttacattgaatttgaccctacatcacttcaagactaatgcataatattaaacatcatgttgaagaaata

SEQ ID NO: 599909 - DNA, 395 bp, Homo sapiens
gtgagcctaggggttcaagactagcctgggcaacatagggagacctcgtctttacaaaacattttaaaattaggtgggtgtggtgacgtgtgcctcttgtcccagctacttgggaggcttgaagttgggagggattgctttgaacccagaaaggtttgagggcttcaagttgaaaactttttggaacttttgcccacttacacaacagcctggggcaacagagtaaggactctgtctcaaaaaaaaaaaggattaattccaataaatgggtagggttatttggccaccttttgggaaaaaaatttcagggggtaaaggcagtaaacccaagggactttttaggccccaaggaacagggaggggccttttgagtatccatgacccccgaggctaaa

SEQ ID NO: 599910 - DNA, 165 bp, Homo sapiens
gaattcggcacgagaagaaccagatgtcaaaactgatttcagagattgcatagttttatccagataaggagaaaacaaacccgagagacactgaccccaggagcatgagctaccccaggagcagagtcagcttccaattccttcagaggccagcacaaccttcct

SEQ ID NO: 599911 - DNA, 921 bp, Homo sapiens
  misc_feature (6)..(6): n is a, c, g, or t
  misc_feature (76)..(76): n is a, c, g, or t
  misc_feature (82)..(82): n is a, c, g, or t
  misc_feature (86)..(86): n is a, c, g, or t
  misc_feature (88)..(88): n is a, c, g, or t
  misc_feature (90)..(90): n is a, c, g, or t
  misc_feature (128)..(129): n is a, c, g, or t
  misc_feature (132)..(132): n is a, c, g, or t
  misc_feature (135)..(136): n is a, c, g, or t
  misc_feature (139)..(139): n is a, c, g, or t
  misc_feature (141)..(141): n is a, c, g, or t
  misc_feature (165)..(165): n is a, c, g, or t
  misc_feature (169)..(169): n is a, c, g, or t
  misc_feature (179)..(179): n is a, c, g, or t
  misc_feature (201)..(202): n is a, c, g, or t
  misc_feature (204)..(204): n is a, c, g, or t
  misc_feature (229)..(229): n is a, c, g, or t
  misc_feature (236)..(236): n is a, c, g, or t
  misc_feature (247)..(247): n is a, c, g, or t
  misc_feature (250)..(251): n is a, c, g, or t
  misc_feature (269)..(269): n is a, c, g, or t
  misc_feature (286)..(286): n is a, c, g, or t
  misc_feature (289)..(289): n is a, c, g, or t
  misc_feature (309)..(309): n is a, c, g, or t
  misc_feature (313)..(313): n is a, c, g, or t
  misc_feature (338)..(338): n is a, c, g, or t
  misc_feature (340)..(340): n is a, c, g, or t
  misc_feature (354)..(354): n is a, c, g, or t
  misc_feature (356)..(356): n is a, c, g, or t
  misc_feature (359)..(359): n is a, c, g, or t
  misc_feature (362)..(367): n is a, c, g, or t
  misc_feature (377)..(377): n is a, c, g, or t
  misc_feature (380)..(381): n is a, c, g, or t
  misc_feature (388)..(388): n is a, c, g, or t
  misc_feature (401)..(401): n is a, c, g, or t
  misc_feature (412)..(412): n is a, c, g, or t
  misc_feature (419)..(419): n is a, c, g, or t
  misc_feature (441)..(441): n is a, c, g, or t
  misc_feature (458)..(458): n is a, c, g, or t
  misc_feature (464)..(465): n is a, c, g, or t
  misc_feature (471)..(471): n is a, c, g, or t
  misc_feature (473)..(474): n is a, c, g, or t
  misc_feature (476)..(476): n is a, c, g, or t
  misc_feature (478)..(479): n is a, c, g, or t
  misc_feature (513)..(513): n is a, c, g, or t
  misc_feature (556)..(556): n is a, c, g, or t
  misc_feature (825)..(825): n is a, c, g, or t
  misc_feature (836)..(836): n is a, c, g, or t
  misc_feature (847)..(847): n is a, c, g, or t
gaaaanaattctatagccaaatgacattgataaacagtgttcttacacaaagttaagcctgtttctttattataancctttncccncncnttcccagtgcatagtgtgactctccacaaagcaagccnnacnccnntancnccctaaacttacttgaccacagantgcntcattctatntccatggaaaccacttggcaanntntcctactccaatttttttttccaanaaaactnacctgtttgtnttnntctgaactcattttgtgntcttgcctttatataanagngaagttctgtgaaatgttgnggangcagggttatggggctggtgatggngngggggctatagaantngtnaannnnnngggttatttnggnncagaggncctaaccataggnattctaacagnggattgngggacccagtatgggtgtttgngacatgttacaaaatanaggggnnattttngnnangnntccatttaataatactgctagatgctgtgggggncaggggctccccggcccagcacacacgcttgagcaggaatggngacatgggcatgggtaggcaggctggtggtcagcagataccctttctgtccctcctctgtgacaatcacccccaagtaatttttgggattcagaataagggagctgctctcccatcctggttactatgagtcgctcttggcagaaaggaccacagatggagagcttggcactcgctccaactttgccgaaaagaggacaaccaccaaagtagtaggtaaaaacacaattttagcagcagtgaaataaaaagaggaagtgaggatggggncaggccgcaantataattaaantgtctgtttaggagaagctgaatccagaagaaacacaagctgtaaagtgagagaggacagggagcagggccttt

SEQ ID NO: 599912 - DNA, 176 bp, Homo sapiens
caggcgcaggaaaatccgggtccttggtcttgttgtttgtctgtaatacagcgtgtgcttgcctgaagtgcatctgcaggggctcagttaagatggacagccacagcccaaactgcttagggagataaaagaagagtaagaatgtggggttgtgtttctttttgggcttttttctc

SEQ ID NO: 599913 - DNA, 167 bp, Homo sapiens
aggctggtgattagcaggatcttcagaggacaaggaggtcgaggctacagtgagccgtgatcatatcaggaggttaaggcaggaggtcgaggctacagtgagccgtgatcatgtcactgaacttcagcctgggcgaagagtgagacctcgtctcaaaaaaaaaaaag

SEQ ID NO: 599914 - DNA, 154 bp, Homo sapiens
tcgctattcatcggcaccatcaactttcgatggtagtcgccgtgcctaccatggtgaccacgggtgccgatgaatagcgaggtgccgatgaatagcgagaggtgccgatgaatagcgaggtgccgatgaatagcgaggtgccgataaatagcga

SEQ ID NO: 599915 - DNA, 254 bp, Homo sapiens
acacaataatgtcagttcaatcatactattcaacatgtcccaagtccacagtggggactaccaacgctgtgattcacaattcttgagagtcaactgttcttatatgtcaatgtgggctaccatgttaaaagaagaaagagaaagaaaagaaaaaaaggaaggaaacagagagagagaaaagaaaaaaggagaaaaaacaattcaggacatcaaagactcattgaggtcagaacatactataatgagataccata

SEQ ID NO: 599916 - DNA, 307 bp, Homo sapiens
tattaatcagtataatattagtatgcatggacctctagagctatggtgccgataatagcgctattcatcggcacccgtattgaattcaagtataatattaagtatgcatggacctctagagctaatggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599917 - DNA, 357 bp, Homo sapiens
  misc_feature (135)..(135): n is a, c, g, or t
aggtcacgagaaccgctgagggatcgccacgggtgtttcaccagcaggaaaacagctactgagctaggatttacgaagttcgacgctcggacccatcgctattcatcggcaccggggttggtgtaaaataggcgnaggtagaagtagaggttaaggagggtgatggtggctatgatggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599918 - DNA, 641 bp, Homo sapiens
tgaacctgtacacagacatcatcaacatactcttctgggctcaggtacagctgctggggaacaagcagtgtccctgagcgcatatagtgtgtgcttgctgcgcgaacctggtacacagactcatcgagcatctgccgtgtaacattcctctaaccattcgaattgatgctagctgcaaaaggagagtacccagatattgcagcatgaagaggatgctagcgcacacatcagaggtagagcacagtgcataggcaacctgaaagcactgcccctatgaacacaggaaggtcacaagattgttactatcccaatctcatctttgatcacacaagagcacaaagcataaggaaaagaaggaatagcctacgttctcgcaaaagccagaataactgtaatatgatacgagcttgcaagcaaatatcggattaccaatagagggagaccacaggactagaatggagacacgaagacaattgggaagcccttataaaaatcccaatcaacagaaagaccacaggctcaaaaggtagaataaacagaaaggggagcaaagaataaacccaggataaccatcactaccctagatctaactcaaataatgtatgcgcaatcaggacccagtggatgtgggccaaatccca

SEQ ID NO: 599919 - DNA, 299 bp, Homo sapiens
  misc_feature (18)..(20): n is a, c, g, or t
  misc_feature (25)..(25): n is a, c, g, or t
  misc_feature (27)..(27): n is a, c, g, or t
  misc_feature (30)..(30): n is a, c, g, or t
  misc_feature (32)..(33): n is a, c, g, or t
tcgctattcatcggcacnnnggacngnatngnnagattcatcggcacttcgcgtattcatcggcacccgtattgaattcaagtataatattaagtatgcatggacctctagagctaatggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599920 - DNA, 301 bp, Homo sapiens
ctcgctattcatcggcacctcgctattcatcggcacttcgctattcatcggcacctcgctattcatcggcaccgggattcggcgagtgctgctgccgggggggctgtaacactcggggggggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599921 - DNA, 731 bp, Homo sapiens
  misc_feature (72)..(72): n is a, c, g, or t
  misc_feature (79)..(79): n is a, c, g, or t
  misc_feature (82)..(83): n is a, c, g, or t
  misc_feature (92)..(92): n is a, c, g, or t
  misc_feature (156)..(156): n is a, c, g, or t
  misc_feature (166)..(166): n is a, c, g, or t
  misc_feature (168)..(168): n is a, c, g, or t
  misc_feature (195)..(195): n is a, c, g, or t
  misc_feature (197)..(197): n is a, c, g, or t
  misc_feature (211)..(211): n is a, c, g, or t
  misc_feature (227)..(227): n is a, c, g, or t
  misc_feature (287)..(287): n is a, c, g, or t
  misc_feature (317)..(317): n is a, c, g, or t
  misc_feature (322)..(322): n is a, c, g, or t
  misc_feature (324)..(324): n is a, c, g, or t
  misc_feature (328)..(328): n is a, c, g, or t
  misc_feature (363)..(363): n is a, c, g, or t
cctcagaattatttgctttattttttcatacaacttggggaagggaaccatgggagtatgcacatgggatcntaatccnttnngtggtttgnaaaaagaaatgttatccccaacaaagctagtagctaccctctaaagcagaggttagctactagntttgttgggnanaaaagtgtaaacatgcattttgaactntnaaagtttgccaatntgaaaaggggtgtttntgaagaccactatttttacgaacacttaaaaataagtgtttgcagttgtgtatgggcacnatactgtattctttacatttttatggcccnacagntncttnttatccctgcaagtatataaattaaaaccaagtcnctttagaacagctttgaaactagagtttcaaaggtaaaaggatctcatgtttctgaatctgcgtaaagcaagatggctgtgatttgacaggtttaattgctaggttttataggtggatagaaatgaatagtttggagtctttaaaatgttttaaaaaatgtctgcttactatctatatatatgacattattcccaattagttttatatctccaagatatatatatgtatataggtatatacgcctttgtctttttcctagtctatatattctattttagaatttatccataagaattattccatacgggatattttagtcctgatgtattcgccggtacattcacagctattttaccaaataaaaaaa

SEQ ID NO: 599922 - DNA, 1685 bp, Homo sapiens
  misc_feature (606)..(606): n is a, c, g, or t
  misc_feature (1258)..(1258): n is a, c, g, or t
ttttgaatcccccttgggggcgcccgcacaattgtggagtcgtatattgtttgtcgtcccccccgccaacaagtggagtggtatatgattgcgttttgtctatcagcatgcttttgtttgttatcggcctcctggccggccctgttctatatttttttgttgcgtgctcagctggtgggttctgtgttattccccccccccctgttagttagccctcgctttgtgttcctgcggcgacacactattatagtggcgggaagtgtgtttagtagctgttttatgggggaaagatattaatctgccttttgttgccccatcagcgggggtgtggttggtgccgccccaatagcgccgcgtgttattaggattccccctcgctccctccgggtgtgattctcctcacgggtacgctctgcgatggtggctttatatcctcctctttattatggtggtaccactagcgccctttgttatatatagtggagtggggggcagctaccatatccgcccgcccggtgtgtcttaagattgggttatgggcccgccacgacatttaatagcgttgggggggactaaaagacagactcttttaacattaaagagcgnttatacagaagaggggccgcgtacacccacaaagaccccctgtcttttcccgcggtagagctcccccttcggcggtgtgaaagttaatagactgccttcggtcggctgtgttgtgtcgccacacaacggctagattattggagatgtttctctcttatagggtgtttcgacaacaccgtcgttgttatacaagatgtttgtggtgccccccaccaccacggggtatccccgccttgctttagagagaagatgtccgcccgcctcctcgggtagaacagatctgttagaacaccttcggtgttattagcttcccccacaaaaggagagtgatgatcacacagtgttctcttcttttgggaggacacatcttatttgggagaataataaccccctcctggttatagagagagaggtgtaggtttattaaaaaagattttagagacacccccccactttatagttataggggcgcctctagatgagaggcacgtgccccacgcgcacacgtgtataaagatattaaggacggtttctcacagagggcgttcacaaacactaccccacgcttatacccctttataataatatttccccacacacacacatatatatacacgtcgagaaactccctccacacacacaccacacattngtgagacccacacttcgtatgtcaccccctcatatatagagaagagacactataatgtgtgtatagtatatataagtatacacacatgtagaataaacactttctctctcccgcgcactataagccctgtgcgctcaagagattataatacacacacgtgagaactgagcacacacattataccacggcgccacaatattcttaccacacatcacacaccacacactacgtgcactgtattaaccctcacctgtcacacccctaacaccacggcactggctcactaaggagaaaggtttaaaaaaagttaaaaggagaactcggcacaattcttataccccgccctcgtttttcccaaaaacactcacccttctagcatcacccagtattagaggcaccgcctgccccagtgacacatgtttaacca

SEQ ID NO: 599923 - DNA, 278 bp, Homo sapiens
gcccttatcggcactcgctatcatcggcactcgctatcatcggcacattagctctagaggtccatgcatacttaatattatacttgaattcaatacgggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599924 - DNA, 707 bp, Homo sapiens
  misc_feature (72)..(72): n is a, c, g, or t
  misc_feature (79)..(79): n is a, c, g, or t
  misc_feature (82)..(83): n is a, c, g, or t
  misc_feature (92)..(92): n is a, c, g, or t
  misc_feature (132)..(132): n is a, c, g, or t
  misc_feature (142)..(142): n is a, c, g, or t
  misc_feature (144)..(144): n is a, c, g, or t
  misc_feature (171)..(171): n is a, c, g, or t
  misc_feature (173)..(173): n is a, c, g, or t
  misc_feature (187)..(187): n is a, c, g, or t
  misc_feature (203)..(203): n is a, c, g, or t
  misc_feature (263)..(263): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (304)..(304): n is a, c, g, or t
  misc_feature (339)..(339): n is a, c, g, or t
cctcagaattatttgctttattttttcatacaacttggggaagggaaccatgggagtatgcacatgggatcntaatccnttnngtggtttgnaaaaagaaatgttaccttttgctttagagggagcactagntttgttgggnanaaaagtgtaaacatgcattttgaactntnaaagtttgccaatntgaaaaggggtgtttntgaagaccactatttttacgaacacttaaaaataagtgtttgcagttgtgtatgggcacnatactgtattctttacatttttatggcccnacagntncttnttatccctgcaagtatataaattaaaaccaagtcnctttagaacagctttgaaactagagtttcaaaggtaaaaggatctcatgtttctgaatctgcgtaaagcaagatggctgtgatttgacaggtttaattgctaggttttataggtggatagaaatgaatagtttggagtctttaaaatgttttaaaaaatgtctgcttactatctatatatatgacattattcccaattagttttatatctccaagatatatatatgtatataggtatatacgcctttgtctttttcctagtctatatattctattttagaatttatccataagaattattccatacgggatattttagtcctgatgtattcgccggtacattcacagctattttaccaaataaaaaaa

SEQ ID NO: 599925 - DNA, 316 bp, Homo sapiens
tagaggttccccgccagtgcttcggcccatgatgggctgctccagcgtgcgcccgagctacccgcagctattacagaccctcctcctagacctgggatttctaataccacacctcgtgtctcccagaccagtaccgggtactggtacgcactctgactgggtggggtattgcctctggcgtcgctcacatagacgtccttgtattcctttacgagtcctcagttttccccactcctgtcacagcgggcatgtgatgctcttgagcggtaccgacgctcgatcttcgtaaatctctagtcagtagctcttttcctgc

SEQ ID NO: 599926 - DNA, 293 bp, Homo sapiens
tcgtgatagctgactctagaggatacacctattcatcgggacccacgagggtgtttttggctgcaattgcagtgaaaacccaatggtgtagaccggcgccgatgaatagcgaggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599927 - DNA, 268 bp, Homo sapiens
gtcacattggtaacctgttctactaaaaatacaaaataagcgggcgtggtggtgcgtgcctgtaatcccagctactcgggaggctgaggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599928 - DNA, 942 bp, Homo sapiens
tataaaattattagttataaaaggggagaataggtaggagttagcggtggtaggggcgatgaggtggtggggaggaagtgggggtgggtttggtatgtgtccaaacgtggtcattttatttttacgtgtgttagattagtggggagtaggggtgatgtgagggtgggagttagaattgaggcgcgttaggttagaaagttagaagggttaaggggaggggtgacagtgcggtggcctcatgaagtgcggtggaggcatgaagtggagggcctatgggtattaatgggtgaagtgcagtgtgtgtgagggcgttattgaatacccaatagaggcgcgccataaaattataaaagagaatgatactggcggcgcaagagataacataatgggagccacaaggagacaaggggggcgctatccagaaaattggggggctataagggagaggtgcacatacagcggtgagaagacacggaacaaaagacgggtgtatatctatgagactttataaaaaaaaagggacatataaggtggggatgaagaggctaaagatgcaattttataaaaagagttgtgaaggtgaagcattacaaagagaagatttttggagattaagagtacactaggggggcgcaatgtgagaaagaagtgagcaattaagaggtacaagcacacctggtgataacgagaagaaagcacccaaaaagagagagcagatacatgcacacacgagtggagcaaaaaagtaaacaaggacggcaagacaatcaaaggaaacagagcgcacaaaacgtgggaaacacaccaaaaaacaaaagaaggagctcgcaacacaacaaacacagcgaacaaacgcaataggtaggcacacccgaccggagacaaaaaggaagagaacaaacacggcacaccgcaacaaacaaaccccaccaatagaaccga

SEQ ID NO: 599929 - DNA, 248 bp, Homo sapiens
tcgctattcatcggcaccgacataagctgcacgtcgattcaatcccagtgctgatttctctctttaaggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599930 - DNA, 240 bp, Homo sapiens
ttcgtgataatccttattgtctaggtaggagagtcttaagttctttcatccttttggcaggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599931 - DNA, 209 bp, Homo sapiens
  misc_feature (17)..(17): n is a, c, g, or t
  misc_feature (19)..(19): n is a, c, g, or t
  misc_feature (69)..(69): n is a, c, g, or t
  misc_feature (110)..(111): n is a, c, g, or t
tgtatatcccatccctngnaggcggtggttgcattgggctgagattgcacaattgtactctagcctggncaacaggagtgaaactgtctcacaaaaataaaaaaacaaannataaaatttccactcccattttatcgcaaagggttatactgggactccagtaaattcttggaagtttttattccttgtgaagttacggccgaaaacac

SEQ ID NO: 599932 - DNA, 170 bp, Homo sapiens
  misc_feature (93)..(93): n is a, c, g, or t
  misc_feature (147)..(147): n is a, c, g, or t
tggggaagccctgtctctgctagaagtacaaagtcagccgcacatggtggcctatgcctgtgatcccggctgctcggggggctgaggcggganagtcgcctgggcctgggaggcggaggttgcggtgagctgagatcgtgccatttnactccaacctgggcagcaagagg

SEQ ID NO: 599933 - DNA, 164 bp, Homo sapiens
atctcaagtattgcaatagagctgggatggatactgcagacctagagcaagctgtggaggtcatgctgctttgtgcccaggcgctgcaaacgatatgattacgctgggcgagattgcggggcatttgaggggaaaagaccctgtgtgatcttcttatcctcaaa

SEQ ID NO: 599934 - DNA, 730 bp, Homo sapiens
  misc_feature (144)..(144): n is a, c, g, or t
  misc_feature (174)..(174): n is a, c, g, or t
  misc_feature (200)..(200): n is a, c, g, or t
  misc_feature (209)..(209): n is a, c, g, or t
  misc_feature (212)..(212): n is a, c, g, or t
  misc_feature (254)..(254): n is a, c, g, or t
  misc_feature (260)..(260): n is a, c, g, or t
  misc_feature (306)..(306): n is a, c, g, or t
  misc_feature (311)..(311): n is a, c, g, or t
  misc_feature (606)..(606): n is a, c, g, or t
  misc_feature (698)..(698): n is a, c, g, or t
agcggagtcggccgacaccacaccagccggggagccgccgccgccgccgccacctctgagcagccggctgggagcgagagccgacagctagtctgcaagccaccgctgtcgccatggggagccgcgtctcgcgggaagacttcnagtgggtctacaccgaccagccgcacgccnaccggcgccgggagatcctggcaaantatccaganatnaagtccttgatgaaacctgatcccaatttgatatggattatnattatnatggttctcacccaattgggtgcattttacatagtaaaagacttgnactgnaaatgggtcccatatttggggcgctatgcggtttggcgagttggccattaacccactccatggactctgggctattccctggagattggcccacaatggctggcctttgggcaactggcaaagcaatggtgggaatcgcctgggtttgggacatggtttgcgtaatccttccttattggggattccattattcacatttccctttaacgaaggtattcacagtgggatcatcactcgggtaccttgtgagcctgagtggcgtcgaatgtagaatattccttaccgattttgaggngcgtggttctcctggtaccgcgtttcagacaagtttatatggggttattcttcaggcctctcttttatgcctttcgacctctgttcatcaancccaaaccaattacgtatctggaagttatcac

SEQ ID NO: 599935 - DNA, 524 bp, Homo sapiens
aagcagtaaaaacagactcacttccgtagatagacccggtaaggctaggcctttctatgctagctcgtgattatcgagcggctttgcaggatacgctgctctgtgtgtcacgacagaatattgcaatatgtttgtgtgtacatcgcagtctaggaagttactccgggctctgctaaagttatccttaatgtgccccgtacctatagcagttaagtgataatggaaggtcattgggtacaaatattcactgaaatgaaaatggaagttttccaatgtgtatgtatatgttaactaattaccccttttttaatgggaccgagggggtaagggtaggttaaccacttgcatttgttccacaagttaatttttacaataactaaaaatgtttttacattcttaaaatgtattttaccacttcttaaacacacatgaatcttatatggtagtactttatttttcaagagagcgagacaaaaggtggttcagatgttcttaccaagctgtttagcatatctgggaactaa

SEQ ID NO: 599936 - DNA, 512 bp, Homo sapiens
  misc_feature (144)..(144): n is a, c, g, or t
  misc_feature (174)..(174): n is a, c, g, or t
  misc_feature (200)..(200): n is a, c, g, or t
  misc_feature (209)..(209): n is a, c, g, or t
  misc_feature (212)..(212): n is a, c, g, or t
  misc_feature (254)..(254): n is a, c, g, or t
  misc_feature (260)..(260): n is a, c, g, or t
  misc_feature (306)..(306): n is a, c, g, or t
  misc_feature (311)..(311): n is a, c, g, or t
agcggagtcggccgacaccacaccagccggggagccgccgccgccgccgccacctctgagcagccggctgggagcgagagccgacagctagtctgcaagccaccgctgtcgccatggggagccgcgtctcgcgggaagacttcnagtgggtctacaccgaccagccgcacgccnaccggcgccgggagatcctggcaaantatccaganatnaagtccttgatgaaacctgatcccaatttgatatggattatnattatnatggttctcacccaattgggtgcattttacatagtaaaagacttgnactgnaaatggatcatatttagagcctatacatttaacagttacattaaccactcaataactctaactattcataaaattacccacaatactacctttaacaactacaaagcaatataaaatcactaatttaaaatatttactaatcttcctattagaattccatattcaatttcctttaagaaatatcacatagatcatcatcag

SEQ ID NO: 599937 - DNA, 254 bp, Homo sapiens
  misc_feature (3)..(3): n is a, c, g, or t
cgncaagagtccaggatccaacaagacgcagcaagttaactgttaaactggaacagggacgaactggcgttcttgcgggggctgccggcagcccccgcgagacgtctatgtcacgagaaatgacgcaatagcctctgtatttggaatccagaactcagtgagttgcaaaccgcactgacccagtcccccgtggatgtcctctttcggccggacacccccttcatttccctcccagactcgtctggcgcgggctg

SEQ ID NO: 599938 - DNA, 172 bp, Homo sapiens
tgcatttcgcgggaaatctgcttcaagtgtgcacattccataaagaaacacacacatcaattacagaagatgggatgaggaatgatgtatataatcccagccaggcgaaaatacaggtccaatgtatttgctccagaaatactttctgagtgaggtcaagtaggttggaact

SEQ ID NO: 599939 - DNA, 392 bp, Homo sapiens
gacatatcttcaagtgaaagatgtgtgactcttcccatcacttgaatacttagaggccatgatagggttattaattggctggaattcaatactggtgtgtcttaggcaatagagagaactaagatggctggtcagtggagcaatcagaacacacacatttattgattaagatctggtatttgatagcccaacagggtgactgtagtcaaaaataatttaactgtatatttaaaaataactaagtaagcatattgtttgcaacacaaaggataaatgcatgaggtgatagatactccatttatcctgatgtgattattacacattgtatgcctgtttcaaagtatctcatgtgccctataaatgtatacacttactatgtacccacaaaaatt

SEQ ID NO: 599940 - DNA, 1432 bp, Homo sapiens
tttgtttgttttttaactttccataataaaatggagttctcttcaaaaaaaaaaaaaaaaaaaaaaaaaaaaaaaaaaaaaaaaaaaaaaaaaaaaaaaaaaaaaaaaaaaaaaaaacaaacaaaaaaaaaaaaaaaaaaaaaaaaaaaaaaaaaacagaaagcaagagcgaagcgaccacaaaaagaaactagtcaaaagcaagcgaagccacaccacacgaacacagaacagacgacgcaccgagcggacagcgccacatacgaggaccagacgcacaacacacaccagcacacagccacaacgcgcagcacacgaacagaggcaaaaaaacaactagcgacaggcacacaaacaggaaacacgacctacagcagacaaacaacgagagacaaagaaccaactgaaggaaaacagagcagaaaagaaaacaacacaggacaacagacgcgagcgaccggacagacggagagagagagagaggggagcacaaaggtggaaaataaacagaacgaagactaaggacagaggcacgagagaccgacaggacagcgagcaaagccaagagatcacaacacgcagacgagagacacacgcgaagaacaaaaacaaggacaccaacacagacaagaaggccgacagcagaagaagaagaaagcacaaggcagcgaagaggacacaggggccgcagcaacaggagaagaacactaaagaagagcagcgagagcaccaacggccaagaaggaaacacagacagcaagaaaaaagataacagcagacaaacaggcagaagggagaaagaaaaccaaccgagaggagagacacgacgaagacgaagaaagacgagaaccaagggagagagaaacagacagtaagagaccaagaaggagaagaaagaagaggagaagaggaaagaaacgagagaaaacgaaaagacaaccacacaaacgcagcgagagaggagaccaaaaacgcaacacagaagcggacgcaaagacaagcaagcacgggagagagaacacgagaagcgaggacaacacagaggaaaagcaacaacaaggagacgacgaagcggaggaagaggagagggagaaagagggagggaggcacgaaagagaaaccaagagagagagcgaaaacaggacgaaaaaaaggagcaaggaggagagacgagaagcaagaggcggagagagcaaaagcggagaacgagaaaacgaagagaacagagagaacgcagaacaacaaaaaagagaggaacagagaaaagacaaagaggcagaagcagaggaaaaggcgaaagacgcgagagcacgaaataggagcagcacaagaaaaaaacaggagagacaagatggaaaggagaagaacgaggagacagcgcgacgaagaggaggccacggggcgagaagagaacaagaacaccgagaagaag

SEQ ID NO: 599941 - DNA, 250 bp, Homo sapiens
cgacgtattctactgcatcagatgctcttcattcacaggcagaggtcagtaatcctaccagaggtcaatttacccaccactattgttccacaaccatgaactaaaaataatgttcatattttttaatggttagggggaaaaaaaacgaaagaagaataaatttactgatgtgacaattacatggaattcacattccatttgttgggtaaactaaaatttttcttgttgttatgcctctgttttagagatg

SEQ ID NO: 599942 - DNA, 163 bp, Homo sapiens
cgatcgagctcggtaccacgcggggcaacaaaacggttgctccaataatggctatttcatctgcatgctccttcggggataggttcagtatcgtgacgcaggccgatgtgcctgctgcgtggtgtttactctagtccttaacaatagccgtgattagtgccat

SEQ ID NO: 599943 - DNA, 443 bp, Homo sapiens
taaattgagacaagagtctagctctgtcaccctggctggagtgaaatggcataatctcggctccttgcaacctcaccggcctgagttcaagcgattctcatgccttatcctcctgagtaggtgggactacaggtgctagctaccacacctggctaattttttctgtattttttagtagagacagggtttcactatgttggccaagctggtctcaaactcctggcctcaggtgatctgcccgcctcaccctcccaaagtgctgggattacaggcgtgagccaccgtgcccggccaagaccctatcttaaaaaataaaaaataattggaagagggtggtaacttgatacattaagaaaatatatgtgaaagaaacctcagttaatgcccccaaagtttatcctatcacaagagtatgattaaattgagaacctccttttgagttc

SEQ ID NO: 599944 - DNA, 702 bp, Homo sapiens
ccgctacggacgccctgtagcggactgatcaggttggctctgctgcctctggcgccgttgcaacgacggtcgccaggcgcagggcttcgatgcttgcctgggccttgaccaggtccagctcaagcgccttgttgtgctgctgatactccagcagtgacgcttggcgcgattggctgtccagcacggcaacccgtaggcgctcctggagcagggtgcgctcgctgtcgatctggctgagctgctccttgggtttcagctgtagcgcctggtcctggcgagcttgctcctgcagcgtattcatgaccttggttgtcactcgctgctcactcagcacgcgctcgttgtcgcgatgcagttgcgtccgtagcggccggacgctacggactgcccgcctggctcaaacgctggcgccagccgcctcggcctttgcgcgaagcggagatcggtgccagggaatgcaactgcgcgatctgcttttgcgactccaggtagaacgccttgtgcagcccccacatcatcagcagcaggatcagcgagaacggcagcgaggtcagtaccagcgcagaattgagcgagtcgatacttgacggcgaacagaacgcactggtgaccaggcggtcatcgcgcccagaaacagcggcccttggccatcttctccggttgcgctttggagagggtaaagacacaccggccggagtcgcg

SEQ ID NO: 599945 - DNA, 728 bp, Homo sapiens
cgcaaaattaaccccctaataaaattaattagtccactcattcatcgacctccccaccccatccaacatctccgtcagtgatgaacacttcgagctcacctcctatggctgcccatgtcataatcgctcccacaatcaccactaggactatgccataggccatgcactaatcaccaggacgcctcaacccgtctatctcatcaatcgcccacatcaatctgcgagacgtagattatggctgcatcagtcccgctacccttcatctgccaattgcgcgcctcatattagttcttctatctcgcctcttcctacacatctggggcgaaggcgctactattacggatcattatctctatacctcagaatcctcgaaatgtcgtgattactcctcctgccttgcaactatacgcaacagccttcagtaggctaatgtcctcccagtgaggccgaatatcattctgatgggccgcaggtaatatatcaaacttactatctcgtcattgtcgcactatacttagtttgacaagacctaagatctcgatgaaatctggagagaaggcgtacctcaagtatagcacgtcccacccgtcacaccgattcctttggctcttacacttacagtctctatccctatcatttgtggcacgccctggtgcaggcagctccagcgtcctaattgctttgcgacctgaaaacgggatcatactctaggccgcccgtattgagtc

SEQ ID NO: 599946 - DNA, 87 bp, Homo sapiens
ctatagctgaagagaaaagggaagctgccaatttaagacacaaattattagatttaacacaaaagatggcaatgctgcaagaggaac

SEQ ID NO: 599947 - DNA, 407 bp, Homo sapiens
caacgattggtctcagcttcccaagtagcttggatcacaggcgcccgccaccacgccaggctaattttttttaatatatatttttagtagagacgggtttcaccatgtttttcagcctagtctgaagctcctaggataaagcgatctgcttgctacgggatcccaaagtgctaggattacaggtgtgagccactgtgcccttccatgatttcttttatactaacgatttttttttttttttttttttgggaaacccggagtttaattattttccaaatcagtctctctgaaaacccagggatggaggttttaagggataactgggtgagtagagggccagtaagtcgggattgctgatgggccggttccaagataaaatcttagggagctgaagttgtcctcttgag

SEQ ID NO: 599948 - DNA, 243 bp, Homo sapiens
tgtttcaagtgaatggataagttaaagggaggaagaagggggaaggggctaagaatatgaggaaacagaagggatctgaagtgggcatagacaaggtagagccgagagacaaggtagagccaagagacaaggtagagccgagagacaaggtagaggcaagagacaaggtagagccgagagacaaggtagagcccgagagaccaaggtagagccgagagacaaggtagagccgagagacaaggt

SEQ ID NO: 599949 - DNA, 1142 bp, Homo sapiens
tctcctgtccctcgggcagttgttggcttttttgttcacctttctcgttctcgtcttctctcactttccctttcgcatgcattctggtcttttccctccgtgtgctcttcttccttcttgtagtttctgtccttcgtcctacttttctttgctccgtgtcccatgcttgtatcggtcatgtgtgccttttctttcttagcgttcttctatagtctctattgggctggttcccttgaatgctttcagaattgagtccatttgctacgccgcttatccacacttctgattgggtcctataagtacctggcttgtactcaacatagttcgctggcaatctgtcattgctgcttactctaacacttgtgctacactctcacagtgcaagatcccaggaatcagttccaagaggagcagtcatccctttgctcttaatgatcaggaatgatgctgtatttagtatactttttgcttgacccaggcacaagtggcttagcttaagtaaacttggctttgctcagatccctgatccttccagctggtctgctctgagtggcttatcccgcatgagcaggagcgtgctggccctgagtatctgaactttctgagtaacaatgagacacgttacagaacctatgttcaggttgcgggtgagctgccctctgccatatcctagccagagatgcacattcctcggtccagtctcagccatacagtaccaatagtgagttttgagtgtgccagggtaaaggctttcagttcagcctcagttattttagacaatctcgccatctttaatttcttagcttcctgttctaatataatgcacggctttaccatttcctgtcagaaataaaccaaggctctaaatagatgatttcccttcggtaactcacctagagccatcaggttgctcattccgtttcaccatgatacttctcacgattcagtttctatgagtgggatcaccgtgatttttttaacaatatatttctgacgggaatgggtgggtagtgtctggtgtaaagaggctgtaaatgtggattgtatgagccaatatatttgtgattttttaaaagaaagtttagaaaggaatatctgttctgaacgccacttaagtcattgtttttagtataaaacaagtg

SEQ ID NO: 599950 - DNA, 262 bp, Homo sapiens
tcgctattcatcggcacctcgctattcatcggcacccggcaagaagatggcactcatatatgacgatgtacccagctatcacgccgatggctaacaggagaaggtgtcatctgtgtgggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599951 - DNA, 417 bp, Homo sapiens
cgcttcttaaaacaaacagaatcttgtcctgttgcacagggtggggtacaatggcgccatctttgctcactgcaacttctgcctcacgggtccaagcgattgtcctccctcagcctcccaggtagctgggactacaccacactgggactacaccagctgccaccatgcctagctaaatttttggatttttagtattgacagcgtttcactgtattggccaggatggtcttgatctcttcaccttgtgatccccttgccttggcctccaaattttctggaattacagtccaaagccaagatccatatttattaaatgaaaaaaaatttcaaaggtactctgcttggtacaataatcaaatgtataaactgaggaataaaacataaccatgaaacctacttataactgcaaaaaaaaaa

SEQ ID NO: 599952 - DNA, 119 bp, Homo sapiens
tcacccgcactctattcttggatgcttaccaaaccagtcaccaagctttcttcttagaccagatctgaaatcccatctctcaggaagccttaacttgaaagtcagcggcgttggatagt

SEQ ID NO: 599953 - DNA, 244 bp, Homo sapiens
gcgtcgaccaaaaatacaaaaattagttgggcatggtggagcatgcctgtaatcccagctactcgggaggctgaggcaggagaatcgcttgcgaggttgcagtgagccaagattgtgccactgcattccagcctaggtaacagagcgagtctccatctcaaagaaataaaaggaaggaggaaggctccaacagagaggctccagaaacacttttgaaagtggcttttggccatgcacggtggct

SEQ ID NO: 599954 - DNA, 212 bp, Homo sapiens
  misc_feature (52)..(52): n is a, c, g, or t
cgttatcggcacagactgccctctaaggatctcgttaaggattaaagtggantcattccaattacagggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599955 - DNA, 490 bp, Homo sapiens
ttgagtagtcaagaccatatagtgtatagctgctttaccatgtcccatagtatacccagtgaaacatgcctgacaatgacctaaccgcttctttcatactcacattgaatatccacgtgttttccttgatttggggggagtcgttatactggcgcaatccagaaaaagcaaagtattcttcaacatactggtttactacaccttcctctcctacggtgcttacggattcagctcagtttccttccttccttccttctttctttccttccttccttcgttccattctatcgagcttgctgtcttgctaatgtaggccacggtcatctcttttctggataacttaccatatttccttattggcttcctgtggagctagttcacttggccaatgactccttatacggtagctggagtaattgtctatgaataaaatcgactctttagaatgactcatggcatgatcatgagacatgtcgttatagggtcggcc

SEQ ID NO: 599956 - DNA, 314 bp, Homo sapiens
cgaagtcttgggaagggagttggagtgtgtggttcggatgaacttctttctagatcactcattaaaaggcacattcatgctaagggaatggatagtctagtttgaccctgagtgccacagtcaagttttaggggacaggctagaggcaaaggaacaaaaagggagacgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599957 - DNA, 228 bp, Homo sapiens
gcgttgtggactgagagatgggctggtgtagtacgagggtctaggtggtgtgatctggagagtatgtaatgggcgatggtaggtgcggtattcgtcgaaagtagatggggctggttgtaattatgcctcagagggatagtacacagaaggggtaggctatgtgttttgtcagggggttgagaatgagtgtgaggcgtattataccatagccgcctagttttaagagta

SEQ ID NO: 599958 - DNA, 301 bp, Homo sapiens
ctcgctattcatcggcacctcgctattcatcggcacttcgctattcatcggcaccctttgcaggttagggatgctagctagaaggtcatcaatcaagctattagtgggagtagagtttgaggtgccgatgaatagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599959 - DNA, 515 bp, Homo sapiens
  misc_feature (97)..(97): n is a, c, g, or t
ctgggtcatctagaggatcccattgatagcggtgaggcggagtttctgcaggggcaacgtgacacatgtccagagatgaggtagaactgccgagttnaggtcatagctgaggtttcttaggaatagaggtgctggcacaggaagtgcaatgtcctggatcaaatgttggaaggagcatgtggcatattctggcaagtgatactctccacttccacatgctgagcattcttgacagcatcaaaatattggctaaagttgagccctcttctgttcatattctacttctagctttctcaattctttgtaaatatctggattctctttttcatagagtcgtagaatacgttcaaaggtttcacgcagctttttacgcttgtctttcagtactttctcatttaattgtggctgttgcactgggttaaactccatttcatccaatttctccatgtctcggattatctgttttggatccttcatctttaaaactgcagctcgaaccatcatgcgctgttttt

SEQ ID NO: 599960 - DNA, 234 bp, Homo sapiens
cgtccacccgaagctggcgctcggtcgaagaggacgaccatccccgatagaggaggacggtcttcggtcaagggtgccgatgatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599961 - DNA, 226 bp, Homo sapiens
ctattcatcggcgcccccccccgagtgttacagcccccccggcagcagcgctcgccgaatcccggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599962 - DNA, 568 bp, Homo sapiens
aaaggaaggaaatagctgggtgcctaccacatgtgttcactggagtgacatttttaatttcctacaataagtggttttgttttttgtgtatgtgcaatttggttaactggtgcaagaggctgagcttttggcctgtcttggctttcaacatccttcctcactaagcttaatcatttctagcttttgatttaaagtgtgagacatgcataacacacagaggccattgtagggttattaattgatctaatttcaatattgttgtgtctcaggcaataaaaaggactgaggagagggagagagatgggaacagctaagtggtggagcaatcagaacatacatatttattaagtatgctgtgatatgggcacagttcatggcaccccaaaacaattataatagtaacaccaaagatcacacatcaccgtagcagatagaataataatgaaaaagcttgaaatattgtgagaaatacctaaatgagacatagagctacaaagtgggcacatgctgttggaaaagtggtaccaatagacttcctcaacagaattgccacaaatccttagattgt

SEQ ID NO: 599963 - DNA, 221 bp, Homo sapiens
accgctattcatcggcactcgttattcatcggcaccctgggttggtatctgacagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599964 - DNA, 271 bp, Homo sapiens
  misc_feature (13)..(13): n is a, c, g, or t
tcgctattcatcnggcacctcaccctgtggactgactctctcaccaacaggtgccgatgaatagcgaggtgccgatgaatagcgaggtgccgatgaatagcgaagcgaggtgccgatgaatagcgaggtgccgatgaatagcgaggtgccgatgaatagcgaggtgccgatgaatagcgaggtgccgatgaatagctcgctattcatcggcacccaagcctgaccaaagtctcgtattcctgatctgtccttccgatggtgccgatgaata

SEQ ID NO: 599965 - DNA, 207 bp, Homo sapiens
tagcaggcccatgtataacgagtaatattggagttcagcacggtgctcacgatgatcgacggaaccttgtacagaggaggcatgcaccgctagtggtgaatacacgtcgaccaggctccatcttaacgatattgggaggtcagcacggtgctcaccgtgtctgacggaacttgtccagggaggcatgcaccgcagtggtgaatacac

SEQ ID NO: 599966 - DNA, 193 bp, Homo sapiens
tgctgcttctcccctcgagtccaggacaggactgttgagaaagcagccatgagcagcctgttgggctctttttaaagccgcccaactccaccccgcagcatgagaatctgagaaaaggatagaaaacagtcatttccaggcaggcgtggtcgctcatgcctgtagtcccagcactttggaagtccaaggctga

SEQ ID NO: 599967 - DNA, 157 bp, Homo sapiens
ggagttcaaggctgcagtgaactatggtcaccattacactttagcctgtgtgacagagcgagacccatctcaaaaaaaataaacagcgtttatttaaaaaaaccacaaaaacacgccaggtatgggggcctcgcattggtaatactaacattttggg

SEQ ID NO: 599968 - DNA, 566 bp, Homo sapiens
catgccaataacctcctctcataaaaggaaaaccaaatgcatgagttcagcactggcgactggaatcacatatttgcatgggaaaaaaacaagcgtacgactcgtttgttatagatacaagttcgcaatttgtagtggccatgcaggtccagcgaagcgaagcttccgactccttcacggaagctacccgggaagagatgagggacttgcaggactctcttgttaacgcaaacggcgagatcttcgaacgaccaggcgattatggtcttaccgtgtgcgaggaggtgccttcttgggccctcgagtgaagatccgacaccatcaatgattcatcaaacccgccgtttggcgggtttttttatgggtcgaaatcctccctacacatccatgtgcagcatcccctcctaccaggccttcgcaacgtctggcccaactttcaggagagtcacgatgcaacacgcaatcaaaaaagctacaagccaaccagagatgctggatggcttcgaccagaccaaactcccgatcgatcgcgattccattcgcggaggttatatggctgggtaccg

SEQ ID NO: 599969 - DNA, 470 bp, Homo sapiens
ctcgcccacgggtttctacgctcactttggtagtttgctctgcccccgatgagtcttttagtagtgatgtcgggtgtcaatttgagatatgtctagctatctgatgtggtgcatttagtgctataaatttacctcttaacactgctttagttgcctcccagagattctggtacattgtctctttgttctcatgggtttcaaagagcttcttgatttctgccttaattttattatttacccagaagtcactcaggagcacgttgttcaatatccatgtagttgtgtggttttgagtgagtttcttaatcttgagttctaatttgattgcactgtggtctgagagattgttatgctttccgttattttgcatttgctgaggagtgttttaattctactcttgtgatccattttagagtgtcatatgccacttagaataatatatagtctgtggttccgtgttggagagtctg

SEQ ID NO: 599970 - DNA, 902 bp, Homo sapiens
catggtggctcacatatgtaatcccagcactttgggaggccaaggtgggcagatcatttgaggtcaagagttctagaccagtctggccaacatactgaaaccctgtctctactaaaaatacaaaaattagccaggtgtgatggtaggcacctgtaatcccagctacttgggaggctgatgcaggagaactgcttgaacccaggaggtggaggtcgcagtgagtcacgattgcaccactgcactccagcctgggagacaaaatgaggctccatctaaaaaaaaaaaaaaaaatttcacgcttgaaaagactgctttgggccaggccccggtggctcaaactttagaaatcccagcatttggggaggccaaggccggcgaatcacttgaggtccggagttcaaaaccagcctggcaacatggtgaaaccggtctctactaaaaatacaaaaactggctgtgtgcaaatggtcacgcctgtattccagcactttcagagggccgaggtgggcggacccatgatgtcagagatcaagtgatctcagggttcacatcttcaaaatgctgctgaactaaggtagatcttacttgccgggaaagccgttacttttgaaggacattttgaacatgacgagttcatattcacgttggtaatactcacttttcggaagagaatggagaaacagaagttcaaggccttagagcggttgggattcggtatacttcacagggcgggagggccaaaatttaccgcacttgtgcccaggcgaatttcggcaagtgtcaccggcgacatgtggcgttgaaacacataggggggacacacacgtgacggagagccacgggtcgagactcggaggtgttaacaaaaagtcacttgcggcctgacgcaatgagagccatga

SEQ ID NO: 599971 - DNA, 235 bp, Homo sapiens
  misc_feature (200)..(200): n is a, c, g, or t
  misc_feature (229)..(229): n is a, c, g, or t
ggatccctattccaaaggttcccggtccccgccccctttgtgacctcatacaaagacttggctaatactgcaaagtttgggatgcacagtctacaaaaccccacatcccctgagaattctctcgcctgccttaggacttaggctctggtagattgcaaatgacctgctttctttctgttcccgggtggcatcgacccgtnggagagtaaatcccaagtaaggtacctgncgttgg

SEQ ID NO: 599972 - DNA, 1394 bp, Homo sapiens
ggtgcggagcgttttgctaagccgaaggtgcacgagtattagttgcaccagatgtgcttttccactcatcgcaccggagtgcgggagacgggcacgtgaggcagctgctgggtcgagtaccctcagacactaaatgcatctccctgtagatggctgttagcatccgatgtcactggtgctaggcatcaactgactggttcctcgcgtagcctagtgagttttcggtacgctcgatgagacgagtagtaaggtagtgtcgaacgtgatgctgtcctcacagctgatgcggtgggtgatagacgctcttgctaaacttacattgactgatagcaacggacttgcaacaatcaggtcctaaagttcatggagctgttgcagcttcggcctacatcccagtgccttgctgagtattcatatcactcctaagctttaccatggacttaggaagatccgtctcgacggcgatcccttgtctagagagcgccgatccagtcaatctgggggcctccaccagaggaagggaatatcgcatggactcctaattggtcgtcggctcctctgtggactgtgtttgtagaacaggaaccagagacgttggtgcggaattgttgttccccctcgcataggccggtgctgaagttcgaataccacaaagtgcccggactacttggaggaattgaccgaaggtatgcaaacaacgggtcgagcctatcttacttgtagggcgtctttagccctcttatccctagggaggttcagataaataagtaagggccaaatgggtcctttgatggttggccccttggttcgacgtaagatgaatcgcttccaattcacatttggccttgtctcaaaattgggtggcttccctccggcacacttccttattgcccaatttcaaagggaacatgagagcgggaacgggaagccttcgttgaacggcctggtagtttgcggctccaaatgctcccaaaatcccggcttggaattaattcgctccaggggcttatggataggcgccctaattttaaagaacggcgtatgttgccttgggccccttttttggggaggggaccaagttccccccaccaaagggccctccaaaaagtggtattagtgcacccccttggaaaagcccgcaattaatcgtagacggcgggcactatggttaattagatgtcccgacgccgcttgtgctgagggcgataaacacatgcaaggcggatatattgcagcacccggttggtggggccacacggtttgggtcctctcgtcaaaagtcgctatggtcataattgccagatgcgtcacccacagaggtttttatcttcttttgtgcgtcacgaggaaacggcggtggtgctacgaaactttgccctgtggtgttctacaca

SEQ ID NO: 599973 - DNA, 324 bp, Homo sapiens
  misc_feature (45)..(45): n is a, c, g, or t
  misc_feature (47)..(47): n is a, c, g, or t
  misc_feature (62)..(62): n is a, c, g, or t
  misc_feature (64)..(64): n is a, c, g, or t
  misc_feature (73)..(73): n is a, c, g, or t
  misc_feature (76)..(76): n is a, c, g, or t
  misc_feature (78)..(78): n is a, c, g, or t
  misc_feature (83)..(83): n is a, c, g, or t
  misc_feature (87)..(87): n is a, c, g, or t
  misc_feature (91)..(93): n is a, c, g, or t
  misc_feature (97)..(97): n is a, c, g, or t
  misc_feature (102)..(102): n is a, c, g, or t
  misc_feature (112)..(114): n is a, c, g, or t
  misc_feature (122)..(122): n is a, c, g, or t
  misc_feature (138)..(138): n is a, c, g, or t
  misc_feature (223)..(223): n is a, c, g, or t
  misc_feature (227)..(227): n is a, c, g, or t
  misc_feature (233)..(233): n is a, c, g, or t
  misc_feature (236)..(236): n is a, c, g, or t
  misc_feature (241)..(241): n is a, c, g, or t
  misc_feature (301)..(301): n is a, c, g, or t
ctcggacgcgtgcctagagtcctggggagcttctgtccacctgtncngcagaggagtcgttncnagcccggcngcncnaggangggngagnnnaacnagaanaacaaaaaannnccaaaacnggcaagaaacgaaagnagcgggaaagaaaaggcagcaggagccagccagccaagccagcgaagccaacgcccaagagccaacagccaaagaaacacgcaanaaanaacaancanccaanaaccaaaagaaagccaaaaacaagaaagaagccgccgccacccaaagcgacgaagccgcnagccccgaggcccagcagcacaa

SEQ ID NO: 599974 - DNA, 852 bp, Homo sapiens
tggtaaaaacggggggtggggctcctgctgtggctgaggcgggtcttgaattcctaggctcaggtgatccttccgcctctgttctcccaaatggctggggattacaggcatgagtcaccatgctgggccagcaacaatttgggtgtgtttggagaattaacctgagccatttcctggaagctacctaacagggccatcccacagtggggaaatatcttcagcgtatctaccggctaagggaaaaatcggggggcagaaaaatcacctttattccagaagcagcaatttagaacgacgtagctaaggagttcggtcaaggggagatgttcacccatagggaatttccctattaaaatggagcatgaaaagggggatatcccttctggacttccacgattgtatagggctatcagtggcaccaatattttacacctgggaaaagggccatccaggggatcagttacatggctccccggggcagaatccaattatcggagcacatgattcctaagctatcgggattgggacatctgggtcctggccagcaactggtttggacatctcctcaaaactccaatccaaagccatggcctgaaagacaagcttcctatgtcagagactaagcccagagggtttccatcaagcccgtgatcattagggtcccccaaggtccccggagagccggactgcggctgggaccccgggaatttcgaatctgaacatctcaggtcgggccagataggtgtcccagaattccctggtcacgggctcctgtgcacctcccacgggggcacaacgtctggtgcgccatgccggggggcctccttcgagagaaacccgcctcccaaaatg

SEQ ID NO: 599975 - DNA, 110 bp, Homo sapiens
aaaagtttaacaagcacattatggctgagcatggtggctcacacctgtaatctcagcactttgggaggccggatcaactgagttcaggaatttgaggggaaaagaacctg

SEQ ID NO: 599976 - DNA, 140 bp, Homo sapiens
agaataataatagagtccaccaagatcaccatatgagccacaaccaccctgcataggaatactcatatccggagccaccctgtagatacataagccatcatgcattctagatgaggctccatagtatctaattgcaagag

SEQ ID NO: 599977 - DNA, 102 bp, Homo sapiens
tgaggaggatgcacgcactcctctctcggagccctcagacattccagtgtgcagacaaatggagtgagtgttgttgtgtgtgccacgtgtgttgagtgcgcg

SEQ ID NO: 599978 - DNA, 374 bp, Homo sapiens
tccattgtgaaaggaaaatgttaggagtatggtttttaaacctgggcttccttttaaacttttttttttaaaccccgttatttcccctgatttgctagcttcaaagaaaagatccgaatctgtgcccagcgctaaagggtcagtgttagcatggcttgtgctggccggtgtgccatattcttgttggaaatgaaccgtagccccaaagcccctttttccttgtcagttttggcccaaagatgtcccccttcctagttatttgtccccccataattggtgttgattggaaacttttttttaaatggggcaaaactgctggggtgtctttttccctgtaacttaagcatagtaatataaataaagtaatagttgga

SEQ ID NO: 599979 - DNA, 389 bp, Homo sapiens
  misc_feature (382)..(382): n is a, c, g, or t
tcagccctgtgacatccataggaacccaaccttcacctgcatgtttcccatgggtatttaaagagttacccttaaataaacgtagtcaagaatgtaaatgaacccccatttttattcccaaaaatagcaggctggccaggcacagtggctcatgccgataatccctgtaatcactttgggaggccaagatcgggggattgcttgaccctaggagttcaagaccagcctgggcaacatggtgagaccctgtctctacaaatttttttctttttttaattagccaggcatggtggtggacccctgtacatccagctactcaggaggctaaggcaggaggatcacttaagcccaggaggtcaaggttacagtgaacagtgtttgngccattg

SEQ ID NO: 599980 - DNA, 333 bp, Homo sapiens
tatcaatgggtggagaagcacgttgtctgcaaagtcatcccacacagcatcgaaaaggagacattagccgaagtgcattgcttacctgaagctgctggcatagaaggctcaagcacagtcagttatgttaatatttctatcccagtttagacagctagaaacagttaactgactacagtaagactaggtctatttaccaagtctttctgtgttggtgtctacggaacttattgtttccccttccttaaattgattagtttgtttcagtattgtgagagaacgatttctctatcggccagtctgcatgtttcgcatccttcttgctctgccttt

SEQ ID NO: 599981 - DNA, 233 bp, Homo sapiens
ttttatttttaaaaaattttccttttttttttggattttaaacccggtggttccctcggccaagcccgcccccccaaaggggaaaaaaattaagaaaggggcctttttttgaaaagaaaattttggcttaaaagccaagggccgaaaaaaatttggaggggggtggttttggttcttccaaccgggacctttaaaaaaatttcccccaaaaaaggtttgtttttcccctttta

SEQ ID NO: 599982 - DNA, 903 bp, Homo sapiens
accatgctggtcgtcgtcggtggacgccggaggcgtcggtgaggtagatgaatctggagcagctgtctcatctggttcatcacttgtgaattggaccgtgtggatcacatcgaaaatttgagtgcctttatacggagtaatacatgcagaaaattggtaaatgcacgacattttatagctaaaatggattatgagcaatagttaacataatgatgggaaaaatctttaatgcatgcattagtttcacagaaggcaaagtacagcatgtagatggggaggacgatcaggatggtgagaacttcggtgcagatgtggaggagtatgaggttgcggggacatgcgggggatttgatcaccgaagaagctgtggagcttctacaaactattaatgcatgagctttctgttgacattggcactcagacttctcagggactaccgtagaggcccgagacgttacggccactggagagaactggaatgctaattcctcagcgacacggcgggtcgctcgaatgcggtgtctctacggacctctgggttaaatatcgcctgaggaattactggatattatccggtcagctaggtcaagggctatttctccaggcgctccatggctgagccaaggcgaatgaagagaacccaaggtactgccagcatcactggtggaaaactggtgcaggaggcagctcgtgataaacgcgcacaagcggggccaagacggctgtggggcgaagcatacaagacatccggggaggccttggagggaccaaacacgctaagctgcgcgccgtggcgtcaacggacacaggcgcccttccaatccgcccgcggggccccaaggcccccggaccctcggacacggccgcggctcgggcaccccaagcaacggctgcgggcacaaa

SEQ ID NO: 599983 - DNA, 1161 bp, Homo sapiens
gctgataggctgttgagttgcctgagtgttttggcaccgccattctatatgacctggcaatccatgcatctgtccgagctgtcggttactgggagttgtacaacagatagtaagagctgctcagcgattatttgccacgagaaatagaaacacttctatagatgacatgatgatatggatagaacagatggcctgtaccgtattgaggagaaggaaggtgacagcggctggtctcattcctggtacaaatctcttgttgtctgcacactatggagctgctgatgttcagttttagtacggctatatgccgacatctcagtaccaaggtggtcagactcttccaagtcgacatagccgacttaggaatctcgactatcagaatgaaagtgctcgtttggtggcagccacagttaccatactctctgatttaccatccctttgttcacccgctggatgtatgacaatcctgcccacaattctgtgtcttaatgtgcaagaatattgaaagacacagcaataaagtctgcagataatcaggttcctccaccagtcagtgcagctcttcaagggattaaaagtattgtgacactttcaatggccaaaactgaggctggcgttcaaaaaacagtggacagctctgattcgtaacacgcttgcttgcatcctggaatattctcaacagaagaatcctgtagctaaacctgatgaaataagcatggaaacagcaattgcactcttccgggggctgctagtaatgaatactagggaacccagtcatttccggaaagtggcgcagtggacagaatttaaagaggcgttaattcctggcgacaccaggggttcaaaccccagttgccacgcgattccctcgaagttcacattcacaggtgcatgtgaacctaaatgctaaagtcgccaagagtgtcaaccaacacgtgcgggcaaacaaacacccgcggcatatagaacatgcggcgagaagagaacgatcaacatgggaggtgtgctagcaaaaagcagcaaacgtgcctaagccagaagaaagagcagagtatccacacagcacgaagatcgcaatgatggcggcgcgaatagatcgcgggtggacggtccctccctctgttttctctccgtgctcagacgaagaagaaaagagaggac

SEQ ID NO: 599984 - DNA, 148 bp, Homo sapiens
gaggtgggattactggagggggtagcaaggttccacagaaaaaagtaaaatgggctgtgatgaagatgatgacgatgatgatgaagaggatgatgatgaagatgatgatgatgatgattttgatgatgaggaagctgaagaaaaagcg

SEQ ID NO: 599985 - DNA, 755 bp, Homo sapiens
tgtggtggctcatgcctgtaatcccagcactttgggaggccgaggcgggtggatcacgaggtcaggagttcgagaccagcctgaccaacgtggtgaaaccctgtctctactaaaaatacaaaaattagctgggcgtggttacaggcacctgtagtgccagctactcaggaggctgaggcaggaggattgcttgaacccgggatgtggaggttgcagtgagccgagatcagcactcattgcactccagcctgggcaatagagcgagacactgtctcacaaaatcaataaataaacaaataacataaataaattccaccagggtagtctcgctataaggacacacctactggcattaccggaccacttacctggattcacaacatgagcaggtttcgaccagctcgagctcccagatcaccacacacttacgtcccccacgtcctatactgcccttacctgtacgcagaccatccgacgcacacctcacaccacgccacacagctgggcacacctcgtcaaagcaccctgtccccgaccagcgttcccccttctagatgcttcttaccaccagcacagtagcagcaacagcacatcgtcaccaaatcgcaacacttcaaccgaccaacgcagccgcgcacaccgcccccccccctcctccaccccacacaaccccgcgcatcacaccacacgctccaccggcccacccccccaccaccacgaaccaccccccccaccccccaccccccccccacacc

SEQ ID NO: 599986 - DNA, 436 bp, Homo sapiens
ggggctttccgggggtgacgacctacgcagactagaacatgcctgtggtaaaggatcttgttcatgcctctccagaggaggagacgaggaagcacaagaagaaacacctggtgcagagccccaattcctactttatggatgaggactgcccatgatgctatgaaatcaccacgggctttagccatgcacaaacggtagttatgtgtgttggctgctgcactgtgcagtgccagactacaggacgaaaagcaaggcttacagaaggatgtttcttcaggaggaagctagactaatagcactctaagtcaagatgagtgggaaactatatcagtaatcacattatggaaagaatacattcaatcgttggtaagatgtcgcccgccacggactaactggctctggacttgagcgcttatgcatgcttcgctcgggcttg

SEQ ID NO: 599987 - DNA, 447 bp, Homo sapiens
ctgtcggtcgtctctagcaggatcccccccgcaaattatgggatgaatcctgtctcctttgaccttttttatagctcatgaatccatcccagttgcctccccagctctgtcccacacctgctgcacacgcttagtgccttgattttccttacctcagtctccttttctattaatccctcttttgcgtggctggctgagtccactttctcaaacagcgaacctcactatgccactttgtgaatctctgtcggctcacctttgccatttcttaatattgcattctccaaattgctaatctctatccagtctcttgaactagacttggcacatggtgattccgctcagaaagtgctcttcacacttctacctgcttgactaaccccagattatctttcacgactttaatctgctcttgtgtcttatagaagcccccattattcgggtggc

SEQ ID NO: 599988 - DNA, 729 bp, Homo sapiens
  misc_feature (5)..(5): n is a, c, g, or t
  misc_feature (62)..(62): n is a, c, g, or t
  misc_feature (114)..(114): n is a, c, g, or t
  misc_feature (140)..(140): n is a, c, g, or t
  misc_feature (146)..(146): n is a, c, g, or t
  misc_feature (149)..(149): n is a, c, g, or t
  misc_feature (170)..(170): n is a, c, g, or t
  misc_feature (254)..(254): n is a, c, g, or t
  misc_feature (277)..(277): n is a, c, g, or t
  misc_feature (279)..(279): n is a, c, g, or t
  misc_feature (293)..(293): n is a, c, g, or t
  misc_feature (298)..(298): n is a, c, g, or t
  misc_feature (319)..(319): n is a, c, g, or t
  misc_feature (335)..(335): n is a, c, g, or t
  misc_feature (341)..(341): n is a, c, g, or t
  misc_feature (416)..(416): n is a, c, g, or t
  misc_feature (421)..(421): n is a, c, g, or t
  misc_feature (499)..(499): n is a, c, g, or t
  misc_feature (601)..(601): n is a, c, g, or t
  misc_feature (665)..(665): n is a, c, g, or t
  misc_feature (715)..(715): n is a, c, g, or t
gactngtagaacaacaggtacagaactgcaagggttcatccccagcgccgtgatcaccaganccacaagctctgggggagtgacatcatagactagattgaacaaccgtaggantgcgtggttttgccagttagccagcncaacangtnctccccgcttacattgcagancatcagggtcatctagctcattagagaaaaaggcatcagtttgcacacgctcacagaacttgtatgttttacagcaaaccagcnctggtacattatgggctcgagcnancagggctaactgtnctgtncctacccgtgaaaacacaganccgttggccaagagtncatgancccccaatagcaccttggaaacctctgggagcacataggaggctgcaggaatcagcaggtaggaggctgggacancagcntggactagagaacgtagtggggtgcctgccttccagcgatgggcggctgtgcaccactaccacccgaaaccgccggcnctgtgtgcaagcgtcctgaagaattggtgagagcagagatgagcatccatataccaggatcacatctgcattactgagctgctggtaagcgaagcgtgagantgcctgaccggctagcacaatcttcttttgcacataccgatcaatggctgcccgaagttctganttggcctcctcttcccgcttggaactgcccacactggtgaattccttgtnaaggaacttgatgg

SEQ ID NO: 599989 - DNA, 631 bp, Homo sapiens
  misc_feature (52)..(52): n is a, c, g, or t
  misc_feature (54)..(56): n is a, c, g, or t
  misc_feature (63)..(65): n is a, c, g, or t
  misc_feature (67)..(68): n is a, c, g, or t
  misc_feature (330)..(330): n is a, c, g, or t
  misc_feature (344)..(344): n is a, c, g, or t
  misc_feature (373)..(373): n is a, c, g, or t
  misc_feature (388)..(388): n is a, c, g, or t
  misc_feature (461)..(461): n is a, c, g, or t
  misc_feature (516)..(516): n is a, c, g, or t
agccgctcgcaagcactcccggtagtccccacctctctcagcttccggctgnannngttccgnnncnngtcgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagntccctctgcccacnatcctgggtcacagactgggatgagcaancgggctgaaggcacngtttccccggggaagatctgaacgtggttgcatctcccttttcctctgtcctccatccttctcccaggattgntgaagggggggacctggtacccagtgatccccaccccaggatcctaaatcatganttacctgctaataaaaactcattggcagagtgataacgtcaagatgtcatactgattgcgcggcctatagcccgggtcgcgaagacagagctggggatgggcctgggctaaagcg

SEQ ID NO: 599990 - DNA, 236 bp, Homo sapiens
cttgcggtctcatagatgactggtgacaccccagaagcagctgcactccgggagcttgaagaagaaactggctacaaaggggacatacgccgaatgtactccagcggtctgtatggacccaggcttgtcaagactgtactatacacatctgtggcacagtcaccagttaacggaagatgatgccagaaaacgcagaggcgatagcccaaagcctggtatgttgtgtgtcggaatgt

SEQ ID NO: 599991 - DNA, 2038 bp, Homo sapiens
gggcagagcgagcagctgagctggctggatctgccgagcgcgagtgagggagcctgatgcctgccctgcctgctgcctgcatcctgccttcccctcctgctgaacatgtgatgccctggtgcctggtggccctgtgcactgcctgccccatgccctgtctcctcgtgctgtcatgtgcctgctgatggtgtatgctgctgctgctgagctgagctgatgcgcggcgacgcgcgaagatgcgatgcagatgctgccctgcggatggggacgtgctgtgctctgtgaacactgatcccggtgtgcttgcacactggctcgctgtttgtagcgcctgctccgacgtgccgaaactgccctgccatgtgcacctctggacaccctacaatcatgcctcactaccaccaccacacctcccccctgctcactctaccccccgtcagacaccaccacaccactcaccaccccgtagcaaccgaacccagccctacgacacgcacaaagcagatcgcgaccctacacccagaacacccatcccacactatcctcaccaccggagcaaccgaccacactaagcgatagcctacatcacagaaggcctctgataatacgaccacatccagccacccgaccttcatcttagtcacacacctcacataactaacactctatcactacccttcttcctctaatcaataataaatactcacactcactaacatcaaccatactatcacctccattcgacatatgcctccacaccactctcacacaaattcaaccacatactttctgaacctcactcatacacccaaacaacactatatacaacatcaacaacatacaaactaagctaacccaaccaaccacacacaatcgaagaccacaatcgacaacaacactccatacaccctcaaccttcacataataccgccgggcgggagagcgacgctagggacagaggagatcatcgcgttgctgtgggcacgggagcgatagagccagcttccatcagcgcagagggagggagcattgcggcaagtctgacggggaggcgcggccctggtaacgaccggctcaagcatcgtcattcgcacccgctccctctggactcgccactgccctcgacgcacgcgacactgcgagagcttcgcagcatgacatctaggccgactatgtgcgcgcttcgagtcaccagcatcaactcaacacacactctctcctactctcacgatctccaccagccatacgaagctactagtctcacccacctctaccatacgcacctaaatcaacccattactaccccatacacttattcctacatcttacataacgaacactattcatgtaaccacttactactaccttatttaactcctcacacaatcttacttacatccaactcattatcatacatactaacatccaccaaacctacaattctaagtatcacgcataacccaagatatctacatatcatgaaacgacaagcccgccttccccactatacacacaacactatcaatcatatcaaccccctaatcctacaagatcaactgacctccaaccacactcacaaccaccacacacctccacccccacacacactcctactactactaccacaatgtcagacctagcagcactacacactaacatctccacgacgctcctacaccgactacaccactacaaatcacacccactcacccaccagcccaccctcacactcacacacacccatcactcacacactacacatcacacacaccccgagaccatcacatacactcacacacccacacatcctcccacccaactcctccacactagaccaccacatacatcaccaaccacacaccgccgtatcccactacaatccaatccgtcatcaaaccgacaccatactaatcccatcactcaccacaccaactccccacaccgacacctaacatacaccaaacacaacacacacgctacaactcacacactacacctacactatcgatcccatcacaccccataaccacacaccaat

SEQ ID NO: 599992 - DNA, 316 bp, Homo sapiens
acctttatggagtgagtggcataatctcgcctcactgcacccccgcctccggggttcaagtgattctcttgcctcagcctcctgagtagctgggactacgggcatgcgccatcacgcctggccaatttttgtatttttagtagagatgaggtttcaccatgttggccaggctggtgttgaactcctgacctcaagtgatccacccgcatcggcttcccaaagcgctgggattacaggcatgagccacctcgccaggcctgtgtatggcttttcttttaaaaagtttacatgtcatatttaccacggtgctataacg

SEQ ID NO: 599993 - DNA, 922 bp, Homo sapiens
  misc_feature (2)..(3): n is a, c, g, or t
  misc_feature (12)..(12): n is a, c, g, or t
  misc_feature (34)..(34): n is a, c, g, or t
  misc_feature (36)..(36): n is a, c, g, or t
  misc_feature (42)..(42): n is a, c, g, or t
  misc_feature (49)..(49): n is a, c, g, or t
  misc_feature (64)..(64): n is a, c, g, or t
  misc_feature (66)..(66): n is a, c, g, or t
  misc_feature (109)..(109): n is a, c, g, or t
  misc_feature (118)..(118): n is a, c, g, or t
  misc_feature (126)..(126): n is a, c, g, or t
  misc_feature (151)..(151): n is a, c, g, or t
  misc_feature (154)..(154): n is a, c, g, or t
  misc_feature (228)..(229): n is a, c, g, or t
  misc_feature (244)..(244): n is a, c, g, or t
  misc_feature (253)..(253): n is a, c, g, or t
  misc_feature (261)..(261): n is a, c, g, or t
  misc_feature (277)..(277): n is a, c, g, or t
  misc_feature (310)..(310): n is a, c, g, or t
  misc_feature (313)..(313): n is a, c, g, or t
  misc_feature (333)..(333): n is a, c, g, or t
  misc_feature (351)..(351): n is a, c, g, or t
  misc_feature (353)..(353): n is a, c, g, or t
  misc_feature (426)..(426): n is a, c, g, or t
  misc_feature (445)..(445): n is a, c, g, or t
  misc_feature (461)..(461): n is a, c, g, or t
  misc_feature (477)..(477): n is a, c, g, or t
  misc_feature (495)..(495): n is a, c, g, or t
  misc_feature (529)..(529): n is a, c, g, or t
  misc_feature (549)..(549): n is a, c, g, or t
  misc_feature (552)..(552): n is a, c, g, or t
  misc_feature (591)..(592): n is a, c, g, or t
  misc_feature (594)..(594): n is a, c, g, or t
  misc_feature (645)..(645): n is a, c, g, or t
  misc_feature (669)..(669): n is a, c, g, or t
  misc_feature (731)..(731): n is a, c, g, or t
  misc_feature (801)..(801): n is a, c, g, or t
  misc_feature (816)..(816): n is a, c, g, or t
  misc_feature (831)..(831): n is a, c, g, or t
  misc_feature (843)..(843): n is a, c, g, or t
  misc_feature (894)..(894): n is a, c, g, or t
cnnatctcttcntcttttcatcgtcgctcgagtngntcagcnccggagnacctcagcagctatntngaatccccatagtgtaagccgggactgccgttcgagttgcgangacccagcntctgcacncagccgatggctgacacattcctgnagnacattttatccgcctgtacatttgtatttcaccacccatcacagcccggaacactggcatcatctttaccattnncccatcttcccgatnagtggagangttgaagnagatgattaagtgctngaatgaatgtggtcttcgtctgaactttctctnatngaactcatgagtaccattcngagaccatcaagaatgtncncacagccacggaaagcttttcttctgaccccatccgtctaccggcccgttgctgtggctctagacactaaagnacctgtagatccgaactgngctcgatcagataggnagcggcactgcagtangtggagctgtagagaagngagcgcactcctcaaaaatcacgctgtgataatncctacatggaaaagtgtganganaacatcctgtggctggactacaagaacatctgcaaggtnntngaagtgggcagcaagatctacgtggatgatgggcttatttctctccaggtnaagcagaaaggtgccgacttcctngtgacggaggtggaaaatggtggctccttgggcagcaagaagggtgtgaaccttcctggggntgctgtggacttgcctgctgtgtcggagaaggacatccaggatctgaagtttggggtcgagcaggatgtngatatggtgtttgcntcattcatccgcaangcatctgatgtncatgaagttaggaaggtcctgggagagaagggaaagaacatcaagattatnagcaaaatcgagaattatgagggggttc

SEQ ID NO: 599994 - DNA, 393 bp, Homo sapiens
gagctacgctctggtgctttgggccatgcagtcgggctcgattgccgaggctgccgcgctgcggagagtcagcgtgattctggtggtgctgttcggcatgcgttacctgaaagaacctttcggccgcccacggtctatagcctgtgggttggtgctgatcggcatgttcgtgatgaaactctaaccgtcggacagaactaaaaaaggaatgggttatgacagtcgctttctggtgtgtgttgatcgctatttttctgccgtatctgtgcacgggcgtggccaagttcagcggtggcaagttcgggcccggcagaaccatgacccccgagctttcctggaaaacctcgagggattcgccaagcgtgcccacagtgcgcaactcaacagctttga

SEQ ID NO: 599995 - DNA, 120 bp, Homo sapiens
tgattgcgacaggttgtcaacatggcagaggctccatctctagtaaaaaggcacggtcacgcacaccggtaccccagctacttgggagcactaatgcaggagaatcgcttgaatttggga

SEQ ID NO: 599996 - DNA, 360 bp, Homo sapiens
aggaagaagggcccaggcgaggcccagatgcccaggccagaaccccctccctttcacagagagggggctttattgcacaattgggtgccttttagctattgtgtgaagaaatgggcgttatggaacctcgggtctggcaacagcttacaaaggcgtgaggctctgacctgagcatgtgggcagtgcaggcagcctgggtgctcttgtgattgaggttagggacagctatacccaggctatgcctggtcccacccagaatgaagttggcgtccccccacaggctgtgagctctagtggccctgggatgtgatctagctcagatgccttctcatccttgatgtcatagttgagcgcacacaa

SEQ ID NO: 599997 - DNA, 143 bp, Homo sapiens
tctctgcgctcagactggcgacacgatagaatgaaaatacttgtacacatcctcatcaactctcagagggatctgagccgtagatggaggaagcgcagaggtagggcaggtactattctttttatttgatagacaaggaagct

SEQ ID NO: 599998 - DNA, 598 bp, Homo sapiens
tctgtcatagaaaaagctagatatcaaggggcctgaagacaagaagaaacacctccttataggtagtagtcctcagatcgaggactgtgtggtgctacttcattcctccattgctaacagatgaaaagcgaggttgctacactaacagcagctagggaaagaagttatgcttgtaggaattggtgacaaaatcagaggcatactttataggactcattctgaccagtatctggtggcattcaaagaagtgggaagaaagccccccacttaaggagatgcgtcagtcatagcccttgaattactaaattctggatatgaatatgatgcaggctccatcatctttaatcaattcaggtctgtcatctcctataagacagaagaaaggcccatcttttcccttaataccgttgcaagtgctgacagaatgagtaatctaataacgatattgatgctgacgtgctgcaaaattaccaagaatacaatctggccaacatcatctactactctctgaaggagtccaccactagtgagcagagtgccaggatgacagccatggacaatgccagcaagcatgcttctgagacaattgcacaattga

SEQ ID NO: 599999 - DNA, 378 bp, Homo sapiens
  misc_feature (123)..(123): n is a, c, g, or t
  misc_feature (332)..(332): n is a, c, g, or t
  misc_feature (336)..(336): n is a, c, g, or t
  misc_feature (349)..(349): n is a, c, g, or t
  misc_feature (351)..(351): n is a, c, g, or t
  misc_feature (353)..(353): n is a, c, g, or t
  misc_feature (355)..(356): n is a, c, g, or t
  misc_feature (359)..(362): n is a, c, g, or t
tgataattgtagtttaagaactaatatttccctctcagaagagttaacatcatagtaatttaattctctgaccagaatgtaaaaatattagaaatcagtaacagacaaaaaaataaaattccncaaatctagaaacttaaggaaaaattccatttaagttaaagcaaaatgagttgagttataagtcctacaagggaaagacaagggaaacatgaggatgttgagatttatgagacatggttaaagcaaagcaacgcttggaggaatatgcatttctttggctgcattggtcagaaaacaagacagatttcagacttgaagaaggcatcatnaagntagcactcctccncnancnntgnnnntcatccaaaagcaaaa

SEQ ID NO: 600000 - DNA, 1016 bp, Homo sapiens
agcatttaccatctcacttctaggaatactagtatatcgcgcacacctcatatcctccctactatgcctagaaggaataatactatcgctgttcattatagctacgctgcataaccctcgaacacccgactccctcttagccaagtattgtgcctatggccatactagtctttgccgcctgcgaagcagcggtgggcctagccgctactagtctcaatctccaacagatatggcctagactacgtacataacctaaacctactccaatgctaaaagcgtaagtcgtcgccaagcaattatattggcataccactgacatgactttccagagaaaacacagtaattgaatcaacagcaagcacccacagcctaagtgatcagcatcatccctctactattgtttaaccaaatcaacaacaaccgtatttagcctgtatccccagaggcttgcgctccgaacccgcctaagcaagccccaacgtgcctaagtacttagagctaccgttgactcgctaggcccggtcacgaatcactggccagaggccgaaggacgcacatgtatccagtggacaccaactagtaccgaagacaaacgtgtaccgtctcgtatcacttaattcgtccctacggagcatcctccgtttaatttactaaaccatttacaccagcccaccagaacgttactcaagtagttgccagtaatcgtgtcattccgacaacccaccagcttaatccgccacacttgggggtagtcatcagcccgatgaggccaccaggcccaggaaaccggccgttggaaacgggacaggccgccaattaacgattagctcatggcctgacgaagccccatcaagaaggcgcccctgatccagcctaaaatccattccggcagatgaagggtaacagggcacaagacaagcactaacgggtccactaacacgattgccaaataactgcgaccctaccgggggccgagacaccgtccaaacggcctgcagcccaccagctaatcatcg

SEQ ID NO: 600001 - DNA, 275 bp, Homo sapiens
  misc_feature (43)..(43): n is a, c, g, or t
  misc_feature (100)..(100): n is a, c, g, or t
gtcatcaggcaggtgtcgacaatggcagcatctacaaaccccntgaggcttatatcacagaaggaactctgggcatctcgcttctggagggtgtccgcanatgttgcaagtgtctgtctgcagattggctacccaaactgttgctcagtacccccatctatatcaacgggtacaacgagtcctggccttgtctgtggagacggattacacctttcccctgctgaaaaggtcaaggccttcttggctgatccatctgcctttgtggctgctgcccc

SEQ ID NO: 600002 - DNA, 173 bp, Homo sapiens
cctcaaactgcgcccgactagcttggatacaggtgcccgctgccatgctcagctggcttttgcattatcagtaaagatgggtttcaccatgtctcgaactcctgacatcaagtgatccatttgctttggcctcccatagtgttgggatcacaggcttgagccaccgtgcccgg

SEQ ID NO: 600003 - DNA, 229 bp, Homo sapiens
accttctacccacgagaggagctgttccagcgtcaccgtttcgccaaagagccggcggcccaacacctcctcggtgaggcgcgctttcgcagaaccgctgcgttcgctttcggtttgcaacacgaagacgttaccggcgccgaactcacgctcatagcgcaggactgccaacgcgttgagctccggcgaaggcgagagggccaacaggaaattgatgggtaccgagctc

SEQ ID NO: 600004 - DNA, 226 bp, Homo sapiens
gtactatcatgtttcataggtaaatgccctaatccaatgatcactttcatttaacatatcctactctagtgagcagatagggcttacatagcattctgtcttgacgacgtttataaaaatgcagctgcaggtcctcatctttgaaactccatttggtaaaaatggccatgtctacctattacctagtagatttaacgtgtccacacgccgcgatagtaccgatacg

SEQ ID NO: 600005 - DNA, 204 bp, Homo sapiens
gaaaagctgttttcctggctagagacaagcatcacctctctgacatctgccacctggtccgccatgacgtgccctacctgttccagaagtatgtgaaggagtcacatgggaaggacatccgggtggtggtggtgggtggccaggtgatcgtctccatgctgcgatgctccacagatggccgcatgcaaagcaactgcttcctag

SEQ ID NO: 600006 - DNA, 729 bp, Homo sapiens
tacaggcttattactgggcctcctcccgcttcatccctctcaagtaatggctcagctaattaaaggcgcacattgacctccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaggagggggggggcgccaaaagaaaacacacacgagcgggggcggcgcacaacaacccacgagcccgacgtcgatatgtagaaaagaagagggaggaaaaaaaaaaggagaggaagaaaatacacaaacgagcagagcgaggggcgcgagggaaacaaaagcaccaacacaggagagggagagaacaagaaggaaacacaaagaggagaatacatcaagcgaggaaaacaacaaaaccctaccgagggcagagaagagcagacacaaagaggcgagagacaaaacagagaaagagaaaaagaaaatacaaacaagcgacaaaaagagggggaaaaaacaaaaccaaaaacatcaaaaaagaagaggacgatgagcaacagagggggagcgacagaaaaacaacaaacacaccccaaaagcaaaagaaacactcgaatgacaacacagaaaacaggaagtcgaacggggtcccaacaacagcggaggacgaaaaaacaccaacaaaaaaacaaactatcacaacaagacacgagaaacaca

SEQ ID NO: 600007 - DNA, 344 bp, Homo sapiens
gtttcaccatgttggccaggctggtctcgaactccgcatctcaggtgatctgctcgcctcggcctcccaaagtgctgggattacaggcgtgatatactgtaatcacgcccggccaatatactgcattttgtaaaagcatttatttattattattttgttttgagactgagtctcactctgtcgcccaggctggtgcaatggcacggtctcagctcactgcaacctccacctcccaggagaatcgcttgagcccgggaggcagaggttgcagtgagacaagatcgcaccactgcactccagcctgggcaacagagtgaaaccccatctcaaacaaaaaaaaaaaa

SEQ ID NO: 600008 - DNA, 147 bp, Homo sapiens
tctagcggatcgcttatctctgcaggcaactgcttggggctgcaattcttaggggcgtcgatagccgccgcgacagagctgagagcaggggcagcagcaggagcaacggggggtcagcatggtgtgggctgatgcaagcagcagccc

SEQ ID NO: 600009 - DNA, 344 bp, Homo sapiens
accgtgacgaatatagtgctcagtagaagaccgtagggaagagcaccacgcactgaggatcagtgtgagagggaaaacatgactgtactgaggaacaaatggaatgcgagaatctcataggcacatatatgtgcatctgtggacccgggtatcagcggaaaacctgatggagaaggctgtgtagattaaaaatgaatgtcagacgaagcccgggattctgtgagaatgggcgctgcctcaacaacccgaaggaactacacctattaagtgttatgaatgggttaaccgccagccccaaccaggacgagtgccttgacaaaacgggaagggtaactgttcacaga

SEQ ID NO: 600010 - DNA, 174 bp, Homo sapiens
gcaatccagaccaaagtacgctggctctgtcactgctatagccagtcaccacttcgacaggctcaagcgttcgtcggaaagggccctgtgggtaacatctgtatctgcagatgtttccatggccgatgtagtactctatcactaaatcgagtattctacttcagcttagtaaag

SEQ ID NO: 600011 - DNA, 279 bp, Homo sapiens
ggatatagtagttagtgatacagacaaaaactttctcttcttttggagtttatgtctttttgagagaaggtctcactctgttgcccagcctggagtgcagtggcttgatcttggctcattgcaacttctgcttcccgggttcaggtgattctccagccttagtgtcccgagtggctggtactgcaggcgggggccaccaatgcccggctaatttttgtattttttgtagtgatggggttttgccctaattttgtatttttggtagagacggggtttcgc

SEQ ID NO: 600012 - DNA, 694 bp, Homo sapiens
aaggacagtgtgcaagcgcggaagttttgtctgtggctgtcccccacaaccccctcccaggttaagctcgtcggagctttgctgatcccatccaggtcggtgagaggttggcagggaaatacacgaggctgctatagtcctaccagtggtagatgctcaacacgtcctccgtgctggagcagctgatcgacagtttaactgggtgtcccggctggcagacctcacgcaaggcgtagaccagtactatctgcgggtcaccacggtggcttccctcacttctgactcggacgttccttccggtgtcactgaggtggtcgtgaagctctttgactctgatcccctcactggcacggtccctgtagaagtctccagggagaaccctaaatttatggagaccgtggcggagaaagcgctgcaggaattccgcaaaaagccccgggaggagtgagatgtggatgttgcttttgcaccaacgggggcattttgagtccagctccccccgagatgagctgcagccccccagagagagctttgcacgtcaccaagttgccaggccccagcctccaggccccccactccgcccagcctctccccgctttgggtcctgccctttaacgctcgcctctgctgctcatgggaagaacagaattgctcctgcatgcaactaattcaataaaactgttttgtgagctga

SEQ ID NO: 600013 - DNA, 252 bp, Homo sapiens
ttcgtcgaagaacaacggcataggagttcgaggagcccttgtcagcattgatacgctcatctgcctggcctcagcaatggtcttaatgttccggaaggcagcctcacgaccgcctgtgcacagcatcccagatggcctggttcacaccgtgtagggcgcacacatccacagcctgtcgtctcacagtcccggcgcgccccatgcgtgtggagtcctcccggggaccactgttgatgatggcgttcaccagga

SEQ ID NO: 600014 - DNA, 250 bp, Homo sapiens
aggaattttccagatggaaaagactgacaacaaggaaaaatattggttatttcttgattaacaggaatctttattgttttaaaattttcaaactgttgatataaaaagaactttatctgtatcttgattaagttgagaagaaaacttaaagtacaaaactcatcttaggcccggcacggtgggctcatgcctgtaatcccagcacttggggaggccgaggcaggcagatcacttgtgaggtccaggagtt

SEQ ID NO: 600015 - DNA, 206 bp, Homo sapiens
  misc_feature (34)..(34): n is a, c, g, or t
  misc_feature (71)..(71): n is a, c, g, or t
  misc_feature (163)..(163): n is a, c, g, or t
  misc_feature (182)..(182): n is a, c, g, or t
  misc_feature (191)..(191): n is a, c, g, or t
ggtaaatgcataaatgagaatctataatgtttantgaactttatattacagattttctcttcttttaggantagctcagcttgcccccgctttccatctccaccatctatagtgagcctctccataattagtgccaaccattagtctcgttcatatttttacnccaggagtcaacaaacatngtgcaattngcaaatatggcctcc

SEQ ID NO: 600016 - DNA, 150 bp, Homo sapiens
gtatcagagttgcacttcattagacaccatggcagagctcttatagtgctcttggcagtatatcagtagtgtcatttatattctatgtactttaaatcaaatgtgatcaaacatttgataaataattctctctgcttttaaaaaaaaaaa

SEQ ID NO: 600017 - DNA, 388 bp, Homo sapiens
atgaggatccccgatatcttacattattacgtccacacattatttagattgtccttacgcttaattctattatcattgttccacgattccatctatcgacaccacattatgcttagttgcatgtctccataatctcctcttcgccgtgactgtaaagcccctgcgggtcaggtatcttgtaggatgcccctctactggaatttgtctgatgtttttcttattagactggggataagcttttgggagaacagtaattgtattttgtaatatgccagcttgacaatttctttctttctttttttttttttggaaccgggggaatggaatctcactctgtcccccaggctgaattgtagtgccgtgaacttggctcactgcaaactccgcc

SEQ ID NO: 600018 - DNA, 450 bp, Homo sapiens
  misc_feature (96)..(96): n is a, c, g, or t
  misc_feature (102)..(102): n is a, c, g, or t
  misc_feature (333)..(333): n is a, c, g, or t
acagggccatggtgtggggggggtctctacaaaattcggggtcttgtttccccagagcccgagagctcaaggccccgtctcaggctcagacacaantgaatngaagatggacacagatgcagaaatctgtgctgtttcttttatgaataaaaagtatcaacattccaggcagggcaaggtggctcacacctataatcccagcactttgggaggccgaggtgggtggatcacttgaggccaggagtttgaggccaacctaaccaacatagtgaaattccatttctacttaaaaaatacaaaaattagcctggcctggtgcacacgcctgtagcnccgctatgcgggaggctgaggcaggagaatcatttgaacccaggaggcagaggttgcagtgagccgagatcacaccactgcactccagcctgggcaacagagtgagacttcatctta

SEQ ID NO: 600019 - DNA, 475 bp, Homo sapiens
taaaaagttcatcatcttaagaacttaaggaattaacaggggtcggggaaactaccccaggcggagggcttctgggtcccgggaaacttgcccagcttacaggcaacacacggggaaccacgaggggggcagcgcgaagatggggtcgtggaactgggggggggcggctacagtgatgactccccacgatgggagcagcaggaaggaagtggtgtctgaggacagtgcggggccgcccagagggacagcccgtgcccgaggagctggtcgccgggagggacagggaaccaagcccccgtccctcagggctgagagagaaaaaggcactggcgaggggtactccatcacgggcgcctctccccatccggggggaagagacgggggtccatggcctccatggcccctttaagcccggcccaaaagccgggaccggggtacacgcctcgggaaagaacgctttcggccggaactcata

SEQ ID NO: 600020 - DNA, 378 bp, Homo sapiens
tgtgttattatttttttaaaaaaccctcttaaaaaaagggaaaataaaaaaaataagaaaacaattttaaaaaaagggaaatatagggggggggtttaaaaaccaaagaggagtggtttggggtgatgaacgggacgaaataatttggggggggcgctctcccgcacacctatgagggagaaagttggccccaataaagagcgggagaaaagctcgcgagaaagcacagaggggaaacaacaacaacgcgtggtgccgcccgcaacacctactcccctgacgcacacgcagctcgagcaagcggcgcgagcgccctccgactaacactcgtcgcgcgagtgatccgtgtcgaggcgttacttacacacacagagacac

SEQ ID NO: 600021 - DNA, 105 bp, Homo sapiens
tatgagtcccggtgagtgtggggggtgctcttcccttgcaggtaatgcagcaggagtggcaggtaggtttctgtgcctccaggtgcgagggtagaggctagacgt

SEQ ID NO: 600022 - DNA, 105 bp, Homo sapiens
cagcagcaccagcacggtctggatttccttacgcgcgctggcaatggcgtaagccatcgggtagccgatcagcaggcagaggatggtgctgaaaaacgccatctt

SEQ ID NO: 600023 - DNA, 188 bp, Homo sapiens
tctcccatcatgatgaacttggacttttttttttgatttctggttttaaaaaacataaaattataaaatcccgataattcgctggagtccttttgatccccctgtagatctgtatttagtatcctttggatttggaaaagtgttgattaccttatggctgggtaataaaatttttttttaaactgcca

SEQ ID NO: 600024 - DNA, 524 bp, Homo sapiens
  misc_feature (1)..(1): n is a, c, g, or t
naaaaggcaaagggccgcggccccccccccagggaaagatcataacagcggtagaggacacgtatagaaaaaagcgtttaaggttccgcagacccaagggaaagctccttggaaacgatatgctaacagagcttctcccccgtgaatcatataaaatccccctcttagcgggtaaatgaatttgaatcgacatagtagccccataagcatcagccctgtagagtgagaagccatctctaacgggcccttcattcctctccatgctacaaacactgtcctgggcttaaggtgctatggactaggggtcctttgtgaaaaagcaagatggaccaatggaaaaaagccctcttcctgaatccctggactccaaaaatgtgcatgcagatcagctgttgccttcaagatccaaaaaaactttcctgtcatgtgttagaactttattattattaaaattgttaaacttttgggcggttcctgtgaatctccaaattttggaccttgttttaagctaatatatagccatt

SEQ ID NO: 600025 - DNA, 284 bp, Homo sapiens
ggccggggatctagaggatccgtcgacggggatgtggatatatagtagctctactttagtttctgaggaagtccaaactgttctctgtagtggttatacttatgttcccaacaacactgtttaagggctccttctctccacattttcttgggcattttggtggctggctttttgaatataagccattttaactggagtgagatgatgcaatatctcattgtagtttggatttacatttggattgatgatcgatgatgttgagcacctttccatatgcctgttgg

SEQ ID NO: 600026 - DNA, 582 bp, Homo sapiens
acttattcacagactgcgccgccaggcagtatcccgtagctgacgcagatcccctcgaggagggtccacggggcggccaggatataggttgtgtgagtgcccctcctctgttcccgccccggaggaggaaatgagggtggcctcccaagaaatgaactccaccccatggacagcagaacagggcagccccctatgtgtggacaggaaggggaccccttgggagccccgtttcttaccagcagagtctctctactcactgctcaggccttcctagaaaggctgagcctgtccacggttgggaaatatgcaaatacgtttacataggggaatagtcagctagcccactatatgaaaatatacacatacatataagccctcaagtgcttgcgttctggaagatagcagtggacacgtctcccggggcgcagatcctgtgagagcctcacaggactgcgcccgccggcccagacacttcacaggtcgaagccattgctatctgcattgtcgcccgaaaattttgtcgtaaaatgtccgcatggatactcagcccacttgtagccgcgcacgaaactcctatctctc

SEQ ID NO: 600027 - DNA, 233 bp, Homo sapiens
gaagtatcatcggtcattttcaccgttacccgccggagctgctggaaaagttccgagtggagaaggacaaatatggtgcccgagaagaggaccctcatcctacactcacttccccaagtaaggctccttctaggcctaccagtgatttggccccaaagttcacatacctccctagttgtcccctatttttccagggaaggcttcctggcattggtccctcactctccctacca

SEQ ID NO: 600028 - DNA, 1260 bp, Homo sapiens
gtaaatcattcagttttggcgcgcgggcccaagttaggctaacgtgaacatggtctagtcgctgttgccgtagtgacatcctgtgtgtcatgacttagtgccttggtattctcagtcaagtacttgaaacgcctcgtgcgagattaaccgaagactggtactgaatcaattcggcggatgtgagttccctgatgcggtcacttaactggaattctagtcaaccaggtgagctccataggtcgatgctacgattactcgaactagtcacagccctcgcacctgtagtgttacatgggtacagaccgttagtccaaatgggagaagttcagaaggagctagagcctgtgactgaccttgtacagccggggacacattatttggggttgctgttgcattctataccgattgtgcgacttgtccagccgttatgtgctgggtgtcccgtacgacgagagactgtgctccagccgttttgtatgtcgcacgaattgcttaagctgtagatatttccaagcgcattgtgaacacttgattgtagacggtttgatcccgacagggttccttccacggaagaggaatttttccacgagcattgtttaggccccactccttttggcccttggcggccattacaaagttagccaacaccagaggcaaaagaagaaagtttgggctgaggttttatagagagagcccaacctaagttgaaacgcccaatctgtccgatcgtcccttctgggttacaacgcaccctgtgcacacctacagcagagatgcaattttctccccccacgaggggaagccttaccgtccgtggttagactttggtccaacccacaggcgaatctcgatagagatacgttggggatcacccataaaagggcacagtgggttcactacagtttccagcattaagagtgttcggaaggcacccccccatatagttggtcgaattcttcccagtttccaaaacgggctgagttttttgaaacgacctcgtttcggaaaaccggaatttcgtgcacaccaaagtaaggagggagctcgggaacagactggtgtgtgagaaaggagacaaccccgcttcacccggaatttatgtgctttgggaaacctgggatgtgtggccacaggtgagttggtaaagaatagggcaacaattgccgagaaacagtgccttgggcccgagcgcgaaaacgttggtggagcactccagagaaatactcgccgataaacacaatgtcacgggcccaatgtgca

SEQ ID NO: 600029 - DNA, 423 bp, Homo sapiens
  misc_feature (40)..(40): n is a, c, g, or t
  misc_feature (74)..(74): n is a, c, g, or t
  misc_feature (114)..(114): n is a, c, g, or t
  misc_feature (117)..(117): n is a, c, g, or t
  misc_feature (119)..(119): n is a, c, g, or t
  misc_feature (123)..(123): n is a, c, g, or t
  misc_feature (126)..(126): n is a, c, g, or t
  misc_feature (134)..(134): n is a, c, g, or t
  misc_feature (158)..(160): n is a, c, g, or t
  misc_feature (170)..(171): n is a, c, g, or t
  misc_feature (173)..(174): n is a, c, g, or t
  misc_feature (176)..(176): n is a, c, g, or t
  misc_feature (186)..(186): n is a, c, g, or t
  misc_feature (189)..(189): n is a, c, g, or t
  misc_feature (194)..(194): n is a, c, g, or t
  misc_feature (203)..(203): n is a, c, g, or t
  misc_feature (215)..(216): n is a, c, g, or t
  misc_feature (220)..(220): n is a, c, g, or t
  misc_feature (223)..(223): n is a, c, g, or t
  misc_feature (235)..(236): n is a, c, g, or t
ccgttgcgaagggtctgggttgtggtgtacggagagggtnactggtgtctaggctggatagggagcaacaaatnagtttaaaaccccaaatgttctgacgttttctgagagcanttncntttnccnctgaattntagcagctatttgttttttaaacnnncagtactganntnntntccaaagatngtnttgtnatgtactcnttttgctgtttnntgtngtnttgttttttttnngaggttccctctctttagctaaaaatcacaaaacattaaacaatggaaaaagccctcccctcagttcttgctaattgaggtgtccgtgatttacaaaaaaagagttccttaaacactgcaggattcttatttttttaatataatttatcttgctgagatagcaagtcaagtttataaagaagatgca

SEQ ID NO: 600030 - DNA, 1797 bp, Homo sapiens
tggtggcacacaagtccttccattcctaggtcattctcattggcattggcaacatctgtcagccaagcatgcttgtctcacaacattcacccatcatagtaaacacatcattcatcactatcagctcgtctgtgctcatctgccacacttccttttctcgttgcttccagcacagattcagctatccacacattcttgcctcacgtcatgccatcaccatttcaccttcgttcacacattatttccttggcgcaatagacggacacattacatatgcggacaactcatcacactttatgtgaatcccaaccccgtatttttaggcacaacactagtcagcacattcctgcttactacttacaatcaccagacacaattactcacaaaaaagatatgcaccaatcacaaccacatcgtcctggccacttcaactacacacctatctacaacacacaccatccccctcccatcacacatagcatcatctatttccatcgcaccttcccctctgcggcgccggcgatcaacacacggaacatccacgcacacaaccaacaccaccgacacacctcccaacccagccaagatcgccacacgacaaagacttcacactacgtcccaccggcccaccaatcccgcacacacaccgcgccacgaaactcatgacacccccacaccaaccaccacgcgccctctcacccacgcaccacatgctgcggcaacacccacagaccccgtgcacactaccaccacgcgggctacctacagacatcgcacacgacctagtggcacccacgacggagggtcccagtgtgccgaccttaaccatacccagaacaacaacgacaccaacaaaacacaaatggaccaccaacaccagaacacgacagcagcagcagcgcatggcgacgatacacgcccgtgcgggcctaggacacccccacacctacctacgactgagacaccaacgcgcagctaggctcccacaacagcaccctacccggaccaccactcaacaatggctatcacagatgtccgacccaacgacgccactggcacaccccaacgcagatacccgcctcgtatcacctagcaccacactgcccagctcacccacccagcacccagccccagcaccacccccaactcggcaccccgcgacaccacctcacgcaccgctacagacagcacctacacccgtgccgtcggccaccacacacaacctacacagcatgagaagaaccgccgacactgcgcgaccaaccccacacaccaacaacgccacaacagcaacgcaccacacaaacaacaacaccaaacaatcacaacacgcacgacaccagacgccaccaaacgaaccacgccccgcagcacgccaccgcagcacacagccaacacaagcaatgacagaccaaatggcagaggcgccgcgacagccacccacccgacactaggataagaagcgagtgagcgaaagacacgaacaccagagcctacaccgtcactcagatacaagctgcatgaagaccagcgacaacaacaacatggtcgcgacacgcgtacatgccagaagactcacagagcgaggcagaacaagccggtatcagtccaaagcagtccgcgacgagaacagacaaccacacagcaagcgagaacatcactaaccgcactactgcacgaagcaagtagtgaagcagcgagacagacaatccatgtgcgttctccttatagtggctcacaacgaacaggtcgagtccacctaatcacgccctatttctacccagagcaagctagtac

SEQ ID NO: 600031 - DNA, 132 bp, Homo sapiens
gcggccgcctactactactactgctcgaattcaagcttctaacgatgtacggggacatggagatcaaggctgcagtgagctgtgattgctccgctgcattccagcctgagtgacagagtgagacactgtctc

SEQ ID NO: 600032 - DNA, 966 bp, Homo sapiens
gcggcgctcgtttcccgcaccgcggccgggcggccatagccagccctccgtgcacctctgtcaggcgcaccctcggtacatgccccaagggccccgccggcgctccagcgccgctgcagctcgtccgccgcgcgactgacgactgcctcggtccattagtcgccgacaatgacggacgcgcgttccacgcgtctgtcaggttgcgccaggaacatacacacacagagactctatgaggcacggccatctaaccagtctagatcgaacctcggagcgtcatacgccttgcctgacgcttgtacctagtgcccatgtcgttacctacttatgacccggcggaatgaatgtgggcttttgcaaggaacctttcgtccaagagtagcttttctgtcatcaacatctgcatgaggaggacgggaaccatgctggacgagagcgtgactcgagagtcgtgcataaacgcgaccgaagggttggccagaagtctatcacattacaggaatagtccatagtaataggcgagaactgtggattgactggagggatgaacgcggtgggcatggataatgcagagtggggaggtggtggcatataccaattgtgtgggaaaaaaagaagtggtgagattcaagtgcaaattaattgggaaattggcggcaaagcatgggaccaaacgtggatccatatgaagagtgaaacccgcacaaattatggtgctgaacatattcacattggaggaaccgacagttacacttggaacttgaccgtcacgggctcgaacgacgtcccaatttcaggaggaccactcggggagtttgaccctaagcgttgtagacccaaacccatttggccggccacagcgaagttggggacagctgccccggaagctccttggggcctttgggcccggtaaacatactcaattcctgtttggaccacaggcacaatccgcctgggggcacaccc

SEQ ID NO: 600033 - DNA, 218 bp, Homo sapiens
gcttacagcacacagagctggctccctatgcccacaggccccgaaagtgggagtcagatagcgctcactcgtcaacccaatggatcaaacggaagcctagttggtgattaccagacagacaacgggatgtgactgcgggaaccgcaaaccagtcttgcgtacgcctatgcaaggggcagtccaagagcagagacagacaccctgggtggtccgagcgg

SEQ ID NO: 600034 - DNA, 118 bp, Homo sapiens
  misc_feature (2)..(2): n is a, c, g, or t
antcactctactgatcgcttagaggtcgcccaaccgaaatttttaatggtagttggtagtttaggacctgtgtggtttgttaggtactgtttgcattaataaattaaagctccatagg

SEQ ID NO: 600035 - DNA, 733 bp, Homo sapiens
  misc_feature (677)..(677): n is a, c, g, or t
  misc_feature (697)..(697): n is a, c, g, or t
aagttttcaaactccaaactagtctccccatcaactctatggtgctttttgacacgtaggcggtttaaagaaatatgacccggtgtgggatttctaagagcctttttttgacctcagccttaaatattatggattaagaaaagaatggctcctaggaatgcttggtgctgaatctgctaaactgaataatcaggctcgctttttcttagagaaaatagatggcaaaataatccttgaaaataagcctaagaaagaattaattaaagttttgattcagaggggatatgattcggatcctgtgaaggcctggaaaaaagcccagcaaaaggttccagatgaaaagaaaatgaagagagtgcccccgaaaaggaaactgaaaagagtgactccgtaacagattttgggccacccttcaactattttcttgatatgcccctttggtatttaaccaaggaaaaaaaagatgacctttgccggctaagaaatgaaaaagaccaagagctggcccccttaaaaaaaaagagtccctcagatttgtggaaaaaagacttggctccctttattgaaaaattgggggctgttgaagccaaggaaaaacaaaatgaacaagtcggccttcctgggaaaggggggaaggccaaggggaaaaaaacccaaatggctgaagttttgccttntccgggtggtcaaaaagtcnttccccgaataaccataaaaatgaaagcagaggcca

SEQ ID NO: 600036 - DNA, 1145 bp, Homo sapiens
agcggagtctggagccgggcttgcccgggcatgtgggaactgccggactatccggacgccactgtgtcggaccggaagagacatcgcggggcttcaggctgcatgcacctgattgctaagattacgtcctccttacggacgtgttccccttgcctgcgcaacggcagtgaagcgggcacctggaaatgggtcacccctgcggaggctgcactgcatgtctggcgtacaggtgacctgctgtccttttctcctcgagcaatcaccacgatgcacaccggatggtggcgtacacgcaatgaggcacagatagacatagatgccggaacgacgtcacccaggcgggttccatgggccccggcacatgtgctctttgcttgcgtcgtaatgccagggggtcttgctggtacgtcgattgtcctccctagtcaccgagggtggtcctcgccccatttgtggctgcctccttttacgggggcatgaaccgagcggtggtgcatgcttcccagttcgagtggcgtggccatggtgtcatggaagggctaggtatctgggtcagttgccccccaatgcctcgacagaaagggcctgcatccctgggaaagccttcagtgtcccttgcccaggcccgtgtgtggctaatcggacgtgtcagaatggtgggcacgggtacccccgtaggggcggggtaagctgagctgtcccgcttgttcccctttgtgacgactaccattggcgatgtcctctatgagcaagtacatcaggcctgagatgcccattggttgaactttaccgttacccgctggaagtggcattcaactcgggcagcacattgcgcaagggttgtccccctttccaggttgggccacaaaaagagaatccctttaagccttccttgaagtgggcaaagggggttgggttggaggaaccagcgccttgtgacaaaacgggacacttccacaggcggggtcacagggtttgcgtcccaccccctcgggagagcccagaacccggcgaataccaccccttatgttcccacaaatttccgcaaaggaaagcccggactccaaaaacacccggggccgggggccctctaaaggaaccctgcccctcagtaaagaactccccaccaacactggtgacctacg

SEQ ID NO: 600037 - DNA, 369 bp, Homo sapiens
tcagtgctttggagcttagtgttttatgtcttgctctcgttaaacaataacagaaaatctcttgcagggaatggtggctcatgcacgtaatcccagcattttgggaggccgaggcaggtggatcacgagttcaggagtttgaaaccagctctgaccaacatggtgaaaccctgtctctgctgaaaatatacaaattagtagggcatggtggtgcatgcctgtagtcccagctactcacgaggctgaggcaggaaaatcacttgaccctgagtggcacaggttgcagtgagccaagactggtgccagtgtcctccagtctgggcgacagagtgagactctatctcaaaagaacaaaaaaatctcttaact

SEQ ID NO: 600038 - DNA, 374 bp, Homo sapiens
gtttactattaggaggtgggaggatacttgagcccaaagttcaaggctgcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgatctctaaaaaaaaaaaaaaaaaaaaaaaagattaactaaaacttctaaaactctcttttttacggttacccaaaaattatacaagtggtttaacatgctttatcttactcaatccatacaaaattcttttggaggttttagcacctcctttagt

SEQ ID NO: 600039 - DNA, 187 bp, Homo sapiens
gtataactgaagcaatagtaggtggttattaactaaagtccaactttattcagatttctttagttcttaatgaccattttctgtcccaaaatccctatccaggttatcatgttacacttcagttgtcacgtctccggaggtagtactagtccaagaggcaggtacaaggaggtaccgcagctcggaa

SEQ ID NO: 600040 - DNA, 308 bp, Homo sapiens
  misc_feature (137)..(137): n is a, c, g, or t
  misc_feature (172)..(172): n is a, c, g, or t
  misc_feature (206)..(206): n is a, c, g, or t
  misc_feature (212)..(212): n is a, c, g, or t
  misc_feature (229)..(229): n is a, c, g, or t
  misc_feature (258)..(258): n is a, c, g, or t
  misc_feature (299)..(299): n is a, c, g, or t
  misc_feature (301)..(301): n is a, c, g, or t
ataacaggacgtcatcattctttcccagagtttgcttccttaatgccaatcaagggcatcataagtcagcgttctcaagacgatgaacacttgtctttcaaaactggttaagccagataggaaaacatgtataaggntaaaaacatcagcaaacattcttaaatgcttttgngagtctttttcttaatttcagagactaatgaccncacacnatggccctttaaggaantgtgggaaatgaggccaaggtattgctcnctgatatcccaatgctttcctgttgcagaaacattgatgangnttggccg

SEQ ID NO: 600041 - DNA, 636 bp, Homo sapiens
tacctgagagttgccaagatacttccaggtcaagctgatcttgacaaagcaaacaaaaacataaagtggggaaaggacacccttttcaaaaaatggtgctgggataattggctagccacatgtaggagaatgaaactggatccttatctctcatcttatacaaaaatcaactcaagatggattaagggcttaaacctaaaacctgaaactataaaaattctaaaagaaacattggaaaaacccttctagacaatggcttaggcaaggatttcatgaccaagaacccgaaagcaaatgtaataaaaacaaaggtaaatagctgggacctaattaaactaaagagcttttgcatggcaaaaggaacagtcagcagagtaaacagacaacccacagaatgggagaaaatcttcacaatctatacatctgacagaggactaatatccagaatctacaacaaactcaaacaaatcagtaagaaaaaaacaaataatctaatcaaaaagtgagctaaggacatgaatagacaattctcaaaagaagatatacaaatagccaacaaacttatgaaaaaatgttcaacatcactaatgatcagggaaatgccaattggaaccattatgcgataccaccttactc

SEQ ID NO: 600042 - DNA, 548 bp, Homo sapiens
aatttaggggggaaaaaaacaccccaatataaaaggggtaaaaacacgtcccatcccctcaaaaaccatgtaaaaatcctaaatcgactcccccccctccttctaataaaaataaaaaatttttccacaaactccccccttaaaaacctataaaacacattcacagtcaaaaaatctagcaacttcaaaaacaaacaaaaaaaaactttctttcaaaaaaaaacaacataatctccaccccacaacacccccaccaaccaaaaaaatctttcctaaccctccacaaccccgcacatctacaccccaaaacaaaaaacgcaacgtcattcccacaactccaaaaaccacacaaatcaccccgcaacaccccagaaattactgcctcacacaaaaaaaaaaacccactaaaaagtgcgggaaaaaacttcgtacacacccaccatacaatacataccaaacggccctacaccctaaacatacccgctcctccaaaacttcaacccacaaacaaaaacacccctcacatcagaaaacaccccaactcatcg

SEQ ID NO: 600043 - DNA, 120 bp, Homo sapiens
tggcacagcaggataataggcggtgagccgacgaggcgtcacaccaggtaatgacgaggcctcgacgaacttctccttcacttcgggcactaggctggctgggaatcacctagctaactc

SEQ ID NO: 600044 - DNA, 659 bp, Homo sapiens
  misc_feature (5)..(5): n is a, c, g, or t
  misc_feature (71)..(71): n is a, c, g, or t
  misc_feature (95)..(95): n is a, c, g, or t
  misc_feature (163)..(163): n is a, c, g, or t
  misc_feature (181)..(181): n is a, c, g, or t
  misc_feature (183)..(183): n is a, c, g, or t
  misc_feature (198)..(198): n is a, c, g, or t
  misc_feature (236)..(236): n is a, c, g, or t
  misc_feature (239)..(239): n is a, c, g, or t
  misc_feature (249)..(250): n is a, c, g, or t
  misc_feature (252)..(252): n is a, c, g, or t
  misc_feature (405)..(405): n is a, c, g, or t
  misc_feature (422)..(422): n is a, c, g, or t
  misc_feature (435)..(435): n is a, c, g, or t
  misc_feature (439)..(439): n is a, c, g, or t
  misc_feature (454)..(454): n is a, c, g, or t
  misc_feature (485)..(485): n is a, c, g, or t
  misc_feature (491)..(491): n is a, c, g, or t
  misc_feature (553)..(554): n is a, c, g, or t
  misc_feature (557)..(558): n is a, c, g, or t
  misc_feature (572)..(572): n is a, c, g, or t
  misc_feature (590)..(590): n is a, c, g, or t
  misc_feature (599)..(599): n is a, c, g, or t
  misc_feature (629)..(629): n is a, c, g, or t
attcnttggatttataaataacgtatcaagtgagcagtgaatttaaatcaagcttgtacatcaagaccgtnttgccaaaacaacagttgcttttngctgctgggagctgtagcttttcaaaacgttcacacatttctttgtttcgtcgttgttttttaattgnctttccgggggggtggcncnccgccaaggcccgcnggccctcgttgccccgccgtccaggttgggtgctgggnggnggggggtggnngngggggttcttttttcggtgtctgggctttgactccgctttctgttggttttgttttctttcttttaccttttccttcttgtctgggagcctgtggggggcctgtcaccttagaggcaagggttccttgtttgcgccaggcaggcaaatgtcanaccgcggccccgggggntgcgctgggggtngggnccgggggcccccggncatccggccccggctctttcgtgcctctgcncctggngggggggcccggggttccctcgggggggcgcggggggggggctgcgtcctggtccagtgtcnnggnngggggggcgctgcnggggcctggacaggaccncctagcccngccagggacaggagggtgagaccacctggnacaaaggcacagaggctggagagaaggcgg

SEQ ID NO: 600045 - DNA, 308 bp, Homo sapiens
  misc_feature (194)..(194): n is a, c, g, or t
  misc_feature (297)..(297): n is a, c, g, or t
gagaaattccgcacaccaccctcaccttcctgtaggtcaggccggttccttctgcggtgggcgtgggagagccacagcccagtggagaggcgttgcaaggccccacaccccttccaccatgttctaccaaccacggcaaatcaaaggccaccgagacccagggcctagggacacagacccatcccgggaggganggtgccgcccagtcacagtcccaccagtgcatggacacagggagaattgcccgggccccggttttggtgaatccggcagcccgccctctgccccagcgagtcncttcccctctc

SEQ ID NO: 600046 - DNA, 137 bp, Homo sapiens
tgctgggattacaggcatgagccactgcgctggctaggtcaacctttaatagttaaccatagctatttgttctatcaaggacatatcacaactactagaagttagctgccaccaccttgattcatgccacagtgcca

SEQ ID NO: 600047 - DNA, 239 bp, Homo sapiens
gactctagaggctcccccctcgtcctgtatagtgaggccgtccagtgatgccttcctcaccctgcccggcttcactatacatgacgatgtttacctacatttgccacatcaccacctctctgtaccgagctcagcagatcatccagctcaacatccaagcttcccctaaagtacgactgagcttggcaaacgaagctctgctgcccaccctcatctgcgacactgctggctgatgaatt

SEQ ID NO: 600048 - DNA, 358 bp, Homo sapiens
  misc_feature (173)..(173): n is a, c, g, or t
  misc_feature (182)..(182): n is a, c, g, or t
  misc_feature (197)..(197): n is a, c, g, or t
  misc_feature (215)..(216): n is a, c, g, or t
  misc_feature (230)..(230): n is a, c, g, or t
  misc_feature (240)..(240): n is a, c, g, or t
  misc_feature (243)..(243): n is a, c, g, or t
  misc_feature (251)..(251): n is a, c, g, or t
  misc_feature (285)..(286): n is a, c, g, or t
  misc_feature (300)..(300): n is a, c, g, or t
gaaaaaggggcccccccggggtttaatggtgacagtccaaaccactccactggcctcctggcaaaaaccgagtgtgttggggtttccgaaaagggtccctcctttttgggggaaggtcagcccagcccctccaaaggtttgatgtttccactttcacccgcaggccttaccgntttgtttanagtgaccccccctanattttccccaaaagggannggggtttttggggnccattttttnagncaggggtnatttgaaaatttgattttgattttattttttttnngtaaacttccaagngggcttttcccattcaattcctgtgatttatgccaataaagtttgcccatgattttca

SEQ ID NO: 600049 - DNA, 913 bp, Homo sapiens
tggtggcggatggggactagcgactcccgggtccggacaggagttgttacgtggcctggaacagcgttgagcaccggtctggtgcctcggctgcgctggtggcttgtgtgtcttccctggaccacgcgtgtagcatctccctgccactaggaaagatggagctcctggagctggctggtaggaggttcttgagagtggaaccacggagctacattcggtacctggaggatgtggttcggtggaggtcgctgcagaaccgatctgaaggcctaacatctccactctgagttctggaatgccatctctcaatgcgagaactcatgtggatgatgccccgagatgccttttggtatctccttgacgtctttttgggctgctggatgatcgcggctggtatgcctacctgggtaggctagagctgttggagaaatggactcggctggggttgctgatggtcacctggtgcttcaggggactgcgacgaagaagtccacatcgtatgttgcgccgtgacgtcttgttctatagcatgccccagaatcttccacgagatgatcccagcgactgtatgggtgccttctatgagagttctactaatgcacgagataaggagggacaggagggcaaaggcgagggacggaaactggcacaccacgtgggaacttccgtagccgcaggggcctcgtccaggcgactggtggcactgcaaagccggcacgcgaatatccggtgtcaccatcagattgttaccatagcctcatagaggctccaataatgggagcatgagcacccaaatgggagagatagtcgggcagatgacacgctgcatgcgtttccagaagaggaccagggcaggggcacaggcgagggtcgccgtaatgatgagcaacgatctcagacgacaaggcgtggg

SEQ ID NO: 600050 - DNA, 437 bp, Homo sapiens
gtgttgcagtgttgtcagggtggtcaaactcctgggctacgtattctcctacctcggcttccaggtagctgggaccattagtgtgtaccaccatgccaagcctaatttttttgactttttttttcttattttttaggtgagacagagtctcactctttaacccaggctggagtgcagtggcgtgatcttgggtcaccggaacctctgcctcccgggtacaagcgatactcctggcttcgagctcccaagtagctgggattacaggtgtctgccaccacagctggttaactttggtattttcagtgacagcacggattccaccatgttggacaggtggggctcgaactcctgaccttgtgatccacccacgttcgagctcatgctccatgggccctgggacaccctattggtaccctgggacaagagcgacaccagcc

SEQ ID NO: 600051 - DNA, 325 bp, Homo sapiens
  misc_feature (217)..(218): n is a, c, g, or t
  misc_feature (221)..(221): n is a, c, g, or t
  misc_feature (223)..(224): n is a, c, g, or t
  misc_feature (227)..(227): n is a, c, g, or t
  misc_feature (230)..(232): n is a, c, g, or t
  misc_feature (234)..(234): n is a, c, g, or t
  misc_feature (290)..(290): n is a, c, g, or t
  misc_feature (299)..(299): n is a, c, g, or t
tgttctgctctctcccgtggtgtgtccccgtccgctcctgtcctactgccccgcggtctggcctcatgggcagaagcgttatgagcagatttctggtcatgctccatctctcttccttcttccgccgttcgggcctcaccacctcttcctcctcaatcacccggtctgcttgaatcaggtcagcttcctctgcgatctctatcagcgaactctcctnntcncnntcntcnnncncatccccttctgcctgggctgtattctcaggtcctgctggagaaacactttgcgtnaaagaaccnacaccaagacctgagcaagccatgga

SEQ ID NO: 600052 - DNA, 1046 bp, Homo sapiens
  misc_feature (1044)..(1044): n is a, c, g, or t
aaatttagaagtcgaaaaatacattgtccataaggaattcgatgatgacacttacgacaatgacattgcgctgctgcagctgaagatcggattcgtcccgctgttgcccaggagagcagcgtggtgcgcactgtgtgccttcccccggtggacgctgcagctgtcggactggacggagtgtgagctctccggctacgggaagcatgaggcctttgtcctcctttctatttcggtagcggtctgaaaggagggcacatgttcagagctgtacccatccaggccgtctggcacattcgacaacatttacttaacaggaatcagtctaccgatcgaacatgctgtgtgctggagacactccggtaggcggcgggccccaggtcaaacttgtcacgacgacctgccaaggcgattgcgggaagggcccctggtgtgtcttgaagcgatgggccgcatgactttggtgggcatcatcagctggggcctgggttgtggacagagggatgtcccgggtgtgtacaccataggttacccaactacctagagcggggattctgtgacaacatgcgaccgtgagccaggagagcacccgactcctcaaaagcaatgagatcccgcctcttctttcttcagaagatcactgcacactggcgcaggtgcttctctactgatttctccagacccacaaacgctagaagcgggacgagaacctacgggagacggaagagtgcatttcccagatacttccatttggaagtttcaggactcggtctgattcaggatactctgtcggaggggagagtgatgcaataggctctcaagaatgctcttcctgggagaaatggcctgcacctgttaagtaaggcaaactctgacgtccggacagtggaacaggaccaaaagagggtcaaagaaaagacgacttgggagcggggtaataagaatttatcaaaacacgcacaaggggagggggcataaagagcgagatccaccgggagggagaggacacaaaagagcgcattcattcctataagtcgagtggtccgngc

SEQ ID NO: 600053 - DNA, 923 bp, Homo sapiens
  misc_feature (469)..(469): n is a, c, g, or t
ggcgcgccttttgttggtctttgtttaatacagaaacttcattgaaaaaacctagccgtgtacagctgccctttgaacgaggtggccattgcagggtactctgcctccccatcaggtggagtatgctgcccggccactcgttataattaactgtcccctgtagggggccgggttttgaaggcagggacgccctgcgcactcctcctgggggagcacccgttgcagtgtatgacgctattctcacttgggtagtgtacagtggccggtaactatggcaaagacggaggcattacaatataacctgcctccgagagaacgcatggacctcgtgtgtcctggaacacgggagagggacgcctgcgtggaggaccgctggtgtggacagtggtcggttgaatgtcacggtacaccttgctcggtggatttgtcggattgcacctcgatggatcattctgtcctctcactccanagggcatcgtccgccctgataccatgctagtcgttgaacagtttgaccgagggaccgtgctccagagaatcgtagggggggggcactctttagaggggtggcacggggggtcagggtttgtacccagacgcccaggcccaaaaccccgggcagggaagggtcagggggccttccccacagggggcacgctcgggggcgatcccaccgtgcgatcatgaagttcaccgggggcatcgcgcggggcgccagatgtcctccccgaaatatggggcacacacgagggaatggggcgagcctctgggggcaacaatgagcgggccccgggtaatttccaaaaacggaaaatgggggggggtacacggcggcagcgagtcccatagagcctcacggtaatggggacagggaaccccccatgactgaaggggaaaacgccggagaggacgccagaaaggtg

SEQ ID NO: 600054 - DNA, 103 bp, Homo sapiens
ctcggtacccttaagctctttcacatctgtatatcacatttggttatccactcaatcatctatggacaggaagtgaaatgttggttgctaggatcccggcaag

SEQ ID NO: 600055 - DNA, 892 bp, Homo sapiens
gagtacagccatgcggctccctgatctgagacctggactccctggtgctgtttggacgcggctttactgtgtgtctgcttcagggccctctggggactttgcttcctcaagggctgtcaggattatggctgtaggggcaccctgctggtgtgaggtgctgtgggtggctgctaaagctaggagtggctgctgggacttggtgggtgacactgctgtgtcccgctctgtctggccaaccctcctgatctgtctccctgagagtcctggtctggcgggggtccctcactgtgctccctcccagccatgagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgcttcttcttccttgtccttgctgtttgggtgagacattaatccctcactattctggtcgtgtgattgacatcctgggaggtgattttgaccccatgcctttgccagtgccatcttcttcatgtgcctcttctcctttggcagctcactgtctgcagagcttgcgatgaggctggttcactacaccatgtctcgaatcaacttgcggatccgggagcagtattactctcctggtgggcaggactcgggttcttacaggagactagacaggggagtggactccggtgaagtcggatacacctgatgagtaatggttctttaaagcaaagtgtcctggaactgtgaatgtggggcgttggcaagcagaatgccgcacccccttttgggaaccaaaacaggaggt

SEQ ID NO: 600056 - DNA, 141 bp, Homo sapiens
cttatggaagatgttagtagctctgacagggtgctcccatctgccagctgactttccggcaaagatcaacctctgctggtcaggagcgcatgccttccttgatccatggatctatatgctttgacagttctcgcatggtgt

SEQ ID NO: 600057 - DNA, 239 bp, Homo sapiens
tgggactacaggcaaaaactaagagagcccccatgcccagctaatttttttattttttgtagagatggggtttcgccatgtaggccaggctggtctcgaactcctgacctcaaaatgatacacccgcgtctgcctcccaaagtgctgggattacaggcgtgagctatttttaatttttaatagaaaataaccctgttatttaaagcatggattcactacaaaataaagattaaggtcca

SEQ ID NO: 600058 - DNA, 462 bp, Homo sapiens
gggcaggatcagaaagataaatacttcatcttctcactcaaatgcaggacttaaaaaatgagctcatagatctagagagtagaattgtggttatgagagattgggaagggtagggggaggggaggctagggagaggttaattaacagatacaaaattacagcaatataggaggaataaattctgttctactgttctatagtgctatgtggtgaatacagttaacaataatttattgtatattttttcaaagctagaaaaggatttcgagtgttcccagtacaaataagtgataactatttgaggtgattgatgtgctaattactctgatttgatcattacacactttatacttgtatcaaaatatcactctgtagccaataaatatgtacaatttttacatgtcaactaaaaataaacaggcataaaggtgaattttgttaagcattaaagcagtttgaact

SEQ ID NO: 600059 - DNA, 359 bp, Homo sapiens
tactttcaggaatttacttgttaaagctcccacatgtttcctaaagtgcagtctgtggcaagatcacagcgtggagacgcattggtcaagatgtggcccgagaaatagctaggaaaatgataaataacattcagcaggtcattcagggttcttgagaacagagaatgaccgaagggacttctgtgtactggcagtgcaaggcaaggtagcaacatagagcaaagggtttggagcaaagcaagcagaaatttgagtcctagctccagcattttgcccaccatgtgacctgggtaaagccactcattcattctgagccttagtttcctcacctgtaaaatgaggctgcttcccttgctgga

SEQ ID NO: 600060 - DNA, 169 bp, Homo sapiens
ctgtgtgacgttactgtcgtcgtaccagagatcgcaccagatagggatcatctgtgggataccaccatatttatcccctatttctagttatctggatcgtccaggaatggacattggctagacgtcccatagagatcacccagaccatcataaagatcccatcccatga

SEQ ID NO: 600061 - DNA, 410 bp, Homo sapiens
tcccccacgctgaaagctcatttgtttgttaactctcgtgttttagaggatatttgatggaccgtggaatttaagcgggctaaggagggaagagaggagaacataagtgcgtgaagtgtagagagaaggtagtagggtcaatggcatgatgtttcactatttcctaatctctgctctactcttacatgaccttatgttttgaatatagttttctctctctgcgtgaaatgcttcttttatacacaggttagatgtcatctcttttatacttttatttcctctgctggggccactgataatatggaaaatgctcagtaaatgctgaaaattgaaattctccacttcagtttgatagggaagattatttcaaattgggagattgtgaaagtttgtttatccacagtatttct

SEQ ID NO: 600062 - DNA, 821 bp, Homo sapiens
  misc_feature (3)..(3): n is a, c, g, or t
  misc_feature (12)..(12): n is a, c, g, or t
  misc_feature (19)..(19): n is a, c, g, or t
  misc_feature (25)..(25): n is a, c, g, or t
  misc_feature (39)..(39): n is a, c, g, or t
ttnggctaggtncgaggcnggtgtnaatcggccgaggtnctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttgggccaagcttggtgctggctttggggcctgggctcatttttgacccatttgctggcaggtatgccgtggaatggtgcgggtggccccggatattctgccggctcgaaagactttcttccgcgcgg

SEQ ID NO: 600063 - DNA, 272 bp, Homo sapiens
gcacgaggtgattaggtggagttaggagttaccctcaggcacactcaccgtcatacataggcatccctggcagaggatccacgcctatgacaaggaagaagcgagccttgctattagttttttctcttagctacaatttattttatcttgcgtggtgactcgtccagttatttgacttctggtaaaatagcacacatttacatagcatatcaagacgttcatattttaggctatgatgtgaaaatgggcagtcttatagagcctttccatta

SEQ ID NO: 600064 - DNA, 664 bp, Homo sapiens
  misc_feature (40)..(40): n is a, c, g, or t
  misc_feature (210)..(210): n is a, c, g, or t
  misc_feature (458)..(458): n is a, c, g, or t
  misc_feature (550)..(550): n is a, c, g, or t
  misc_feature (626)..(626): n is a, c, g, or t
  misc_feature (634)..(634): n is a, c, g, or t
  misc_feature (649)..(649): n is a, c, g, or t
ctagagtaacatacttcgctcatatactctcctctagatngaaataggatagccactgcctaaaccagtttaatcacactagctacttcaaaccattattatatttcaaaccacttctattcttttaaacatattaccttctaattaaattaaatgcctttatggtcacttaagcaacaacagaatatattcaaacataaaccatatttngtaaatcaatgatgagcacattaaatagctttaaggggtgggccaaaaagtgccaaaggtaatcaaacttttatgtgactccactgttactttactgcttctaagcagaagctatattcattttcagttctcttatatcaacattgtaaggtgcttacacaagcctgggcagtttagtcacttctgctcatacagatttttacacggaagaaaattttaaagacaggctatttaatacgagcctcgtngtatatatttactaaaataactaaacttgttctgttaatgaaattttactccttgtgcaaagtagtaagtatttcatctcttagtgcatatntttttctattactgctcctgtaatctttaatgatcctgccccaagattgaaatctgaatgagaggtcattttatanaagtttanagaattcttaatcanttaacaatactagaa

SEQ ID NO: 600065 - DNA, 3489 bp, Homo sapiens
tctgccggagagagggttggaggcgtcttcgctcgcttatcgcatacttccgcccgctccttccagttagttccctaacccgagtgaagccacttccggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600066 - DNA, 211 bp, Homo sapiens
  misc_feature (8)..(8): n is a, c, g, or t
  misc_feature (27)..(27): n is a, c, g, or t
  misc_feature (36)..(36): n is a, c, g, or t
  misc_feature (38)..(38): n is a, c, g, or t
  misc_feature (55)..(55): n is a, c, g, or t
  misc_feature (63)..(63): n is a, c, g, or t
  misc_feature (76)..(77): n is a, c, g, or t
  misc_feature (82)..(82): n is a, c, g, or t
  misc_feature (86)..(86): n is a, c, g, or t
  misc_feature (88)..(89): n is a, c, g, or t
  misc_feature (92)..(92): n is a, c, g, or t
  misc_feature (111)..(111): n is a, c, g, or t
  misc_feature (115)..(115): n is a, c, g, or t
  misc_feature (145)..(145): n is a, c, g, or t
  misc_feature (152)..(152): n is a, c, g, or t
  misc_feature (163)..(163): n is a, c, g, or t
  misc_feature (168)..(168): n is a, c, g, or t
  misc_feature (172)..(172): n is a, c, g, or t
gtcttagnttctgcttcagtaaggganttctgaggncnttgctatgataccatcnttaagacnttcacatgtcttnntatantatntnntcntttcaaatcctaatcactntttnatactattacagggctttgatgctgccagnactgtcntttacataggnacttntagntttgcacagtaatagaggacttagaagtacctaactata

SEQ ID NO: 600067 - DNA, 733 bp, Homo sapiens
tggtgtgatccctgtgggccctgagtctactccatctcacatcacatggtgtgtgccctggtgtggacctggagcctgtctcaccaatggagctgcctcaccaaagtgccaacctcagccccaagcctgtggcaagcccaataatgagccctcacagcagccccaccaatgctcccttccaatgtcaccaaccaatggtggtgcctcgacctggtggctcctgctagtcaccaaggatgtcccccaatgcctgacaaatgtggaagtggccctccctgtggcagactgtgtgtagtaccacggcccagtccacacccctagtacctggccccactgacccaatgtcatgggccctgatgggtgctggccccacactcagccatcgatggagaatggtgatgaagggcatttgaggagaactgtgcttgcgtgctccatgtggccatggagcgagcccctggcgccgatggtcaatgcaccgcaacaccagcagcatcgccagctggttcggccttaagaagagcaagctgccagcgctgaacctgccgcacagagggccaccaagaacaatggagggggctggcgggggctccccgctccggagggaagtcaagatggaagcccggaagctggaggccgagagcctcaacatctccaagctgatggccaaggcgggaagacttgcgtcgggcactggaagaggagaagcctactaagcagcgtgccggcaagc

SEQ ID NO: 600068 - DNA, 4005 bp, Homo sapiens
tctgccggagagagggttggaggcgtcttcgctcgcttatcgcatacttccgcccgctccttccagttagttccctaacccgagtgaagccacttccggcttcccgggcgccttccgcagtcctcttccgggtgatggcggccgggtgccccggatgtagccctggcgcaagcatctcttcttttttccacctcgccttccgcggattcccaggtgagtgcgcgagggtgggaccgcccgaatccccgtggccctctaagttgtacacagcccgggacagttggggctcaccacacggaattgggagttcggagcagggaggaacgggtcggcgagagcgccaggtcctgggtctgcccgggcccggcgagctccgagagagccagggtagagagcgggggtcagcccgtggagccgtaggcgcgcagactgcgggggctggagttgggggcggtcacgtggtgaagcctgtctcctttcagccagggtcgggggatccagagggtccgctcctccgtccccgccccgtttaactcgcggatgctagacccaagtcctggaggcctcctggctgccagcttcctttcggcccctgcttttgtgctccctccgctcccaaactgtacctgtcacagaccaggaaaaatgtttgctgtgctgcgtctgttggcgagtcccctcctcacccggttcccttcctctgcatcctttccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600069 - DNA, 934 bp, Homo sapiens
  misc_feature (8)..(8): n is a, c, g, or t
  misc_feature (32)..(32): n is a, c, g, or t
  misc_feature (36)..(36): n is a, c, g, or t
  misc_feature (97)..(97): n is a, c, g, or t
  misc_feature (99)..(99): n is a, c, g, or t
  misc_feature (109)..(109): n is a, c, g, or t
  misc_feature (115)..(115): n is a, c, g, or t
  misc_feature (118)..(118): n is a, c, g, or t
  misc_feature (146)..(146): n is a, c, g, or t
  misc_feature (156)..(156): n is a, c, g, or t
  misc_feature (165)..(166): n is a, c, g, or t
  misc_feature (170)..(170): n is a, c, g, or t
  misc_feature (180)..(180): n is a, c, g, or t
  misc_feature (182)..(182): n is a, c, g, or t
  misc_feature (191)..(191): n is a, c, g, or t
  misc_feature (195)..(195): n is a, c, g, or t
  misc_feature (207)..(207): n is a, c, g, or t
  misc_feature (212)..(212): n is a, c, g, or t
  misc_feature (222)..(222): n is a, c, g, or t
  misc_feature (224)..(224): n is a, c, g, or t
  misc_feature (235)..(235): n is a, c, g, or t
  misc_feature (242)..(242): n is a, c, g, or t
  misc_feature (251)..(251): n is a, c, g, or t
  misc_feature (266)..(266): n is a, c, g, or t
  misc_feature (271)..(271): n is a, c, g, or t
  misc_feature (275)..(275): n is a, c, g, or t
  misc_feature (294)..(294): n is a, c, g, or t
  misc_feature (296)..(296): n is a, c, g, or t
  misc_feature (334)..(334): n is a, c, g, or t
  misc_feature (341)..(341): n is a, c, g, or t
  misc_feature (366)..(366): n is a, c, g, or t
  misc_feature (390)..(390): n is a, c, g, or t
  misc_feature (392)..(392): n is a, c, g, or t
  misc_feature (396)..(396): n is a, c, g, or t
  misc_feature (404)..(404): n is a, c, g, or t
  misc_feature (413)..(413): n is a, c, g, or t
  misc_feature (421)..(421): n is a, c, g, or t
  misc_feature (435)..(435): n is a, c, g, or t
  misc_feature (439)..(440): n is a, c, g, or t
  misc_feature (443)..(443): n is a, c, g, or t
  misc_feature (446)..(446): n is a, c, g, or t
  misc_feature (466)..(466): n is a, c, g, or t
  misc_feature (518)..(518): n is a, c, g, or t
  misc_feature (549)..(549): n is a, c, g, or t
cttttccngcccccgtgcactctccgcccgangcgngcccccggctcgcggggttcgcccccgagcgctgcgtcctgcgggtcacctaacccatttntngcttcctctncctgtnctnagccatggccagcgagagctcacctctnctggcctacnggctccttnnggtngagggggttncnctccctgcnaatngggccgggggtnctggnggggcgtctncncggtatctgtncaccttnctgggtgtngtggtgcccactgtnctgtncatnttcagcatagttgtttttntnaggattgggttcgtggtgggtcatgctgggctactgcnggccctngccatgctgctggttgcctactttntcctggcactcaccgtcctctctntntgtnctatcgcnaccaatggngccgtgcnggggggcggagctncttnntgntcngccgcacactggggcccgangtcgggggcagcattgggctcatgttctacctggctaacgtctgttgctgtncgtctccctcctggggctggtggagtctgtncttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtgggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtcttt

SEQ ID NO: 600070 - DNA, 3260 bp, Homo sapiens
tctgccggagagagggttggaggcgtcttcgctcgcttatcgcatacttccgcccgctccttccagttagttccctaacccgagtgaagccacttccggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600071 - DNA, 185 bp, Homo sapiens
agtagtgatgccatgacgggtgccgtagccgtgatagagttgatgcgacgaagagccgacggctggaaggcggttcgcaggagcggtactaacccgtgtctttgctgagaaataccgtgtggtgcgaaggtgaaacatttaatgaggatatgcacggagttgagagtcgagggaattggccggaa

SEQ ID NO: 600072 - DNA, 2328 bp, Homo sapiens
tctgccggagagagggttggaggcgtcttcgctcgcttatcgcatacttccgcccgctccttccagttagttccctaacccgagtgaagccacttccggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagctgggctgggacctccacttcaagccacaggattgcttaagctccttggccaggtgaaggttctcccggtgacctggggcctggggtcgggagggaaactggg

SEQ ID NO: 600073 - DNA, 225 bp, Homo sapiens
aatattcataagtggatggcagcaacttcttattttaatcctcacacagcctgaggaggtgggctaaatctccattttgcacaagaggaaattaaaggccgggcatagtggctcatgcctgtaatcccagcactttgggaggctgaggcgggaggatggcttgaggccaggagtttgagatcagcctgggcaacacagggagaccccatctttacaaaaagtgaa

SEQ ID NO: 600074 - DNA, 3574 bp, Homo sapiens
tctgccggagagagggttggaggcgtcttcgctcgcttatcgcatacttccgcccgctccttccagttagttccctaacccgagtgaagccacttccggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcaggtgagctgctttctccctcctcctgccttgtccctgcttcccccactcctgtcagttgttccccagctctgccctctccttgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600075 - DNA, 339 bp, Homo sapiens
  misc_feature (30)..(30): n is a, c, g, or t
  misc_feature (33)..(33): n is a, c, g, or t
  misc_feature (37)..(37): n is a, c, g, or t
  misc_feature (40)..(40): n is a, c, g, or t
  misc_feature (83)..(83): n is a, c, g, or t
  misc_feature (244)..(244): n is a, c, g, or t
  misc_feature (266)..(266): n is a, c, g, or t
  misc_feature (312)..(312): n is a, c, g, or t
  misc_feature (330)..(330): n is a, c, g, or t
ctttttttctttccaacattgggcacattncancttnctncccactcttgggcatgtaaggaaataaggcatttacataattnggaaaaatctgggatttctgatgccaaagggttaaagcttcttggatttcatttcattgatatacagccactattttatttttgatcagtggcctttgggcctggtgtcagggtactgaccatcagtgtcagcattagggttttggtttttgtttcttttnggtctttcttttttggcacatntgaatcttgttttgtgtaaaatgaaattactttctcttgttctctnatgatggggttaaaattnaaagagcat

SEQ ID NO: 600076 - DNA, 3159 bp, Homo sapiens
tctgccggagagagggttggaggcgtcttcgctcgcttatcgcatacttccgcccgctccttccagttagttccctaacccgagtgaagccacttccggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600077 - DNA, 2956 bp, Homo sapiens
tctgccggagagagggttggaggcgtcttcgctcgcttatcgcatacttccgcccgctccttccagttagttccctaacccgagtgaagccacttccggcttcccgggcgccttccgcagtcctcttccgggtgatggcggccgggtgccccggatgtagccctggcgcaagcatctcttcttttttccacctcgccttccgcggattcccagcttgagaaacacctctttgccccgtcatgccaaagaggaaagtgaccttccaaggcgtgggagatgaggaggatgaggatgaaatcattgtccccaagaagaagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtcaggaggcagccacactccccagcgaggggggtgttcggatcacaccctttaacctgcaggaggagatggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600078 - DNA, 222 bp, Homo sapiens
  misc_feature (24)..(24): n is a, c, g, or t
  misc_feature (34)..(34): n is a, c, g, or t
tctctgctcccagattcaagcgantctcggctcnctgagtggctgggactgcaggcatgtgccaccatgcccatggtgtattttgtgttttggtagagatggcatctcactatgctgccctggctgatcttgaattcccgagctcaaatgatcctcccacctcagcatcccaaagtgctaggattacaggcatgagccaccatgcctagcccatatgtttct

SEQ ID NO: 600079 - DNA, 2658 bp, Homo sapiens
aagaaaataacaaggttttttttccccaatgttttaaaaaaaatttattatttaatagggggggggtataaaacaggtcggagttttcccacctatgtattaatggttttaaaaccaaagagtgttaaaaaccaacacccccaccctccctggacatgttcgctgaggagttggcggaggaggaactggagaccccaacccctacccagagaggagaagcagagtcgcggggagatggtctggtggatgtgatgtgggaatataagtgggagaacacgggggatgccgagctgtatgggcccttcaccagcgcccagatgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600080 - DNA, 2036 bp, Homo sapiens
  misc_feature (3)..(3): n is a, c, g, or t
  misc_feature (12)..(12): n is a, c, g, or t
  misc_feature (19)..(19): n is a, c, g, or t
  misc_feature (25)..(25): n is a, c, g, or t
  misc_feature (39)..(39): n is a, c, g, or t
ttnggctaggtncgaggcnggtgtnaatcggccgaggtnagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctaaaaaaaaa

SEQ ID NO: 600081 - DNA, 124 bp, Homo sapiens
  misc_feature (1)..(1): n is a, c, g, or t
  misc_feature (112)..(112): n is a, c, g, or t
ntgggattacaggcatgagcagcgtgcctggcaaaatttattattagtagtagtagtagtatttttgagatggagtttccatcccaggctggagtgaagtgacatgatcttngctcactgcaac

SEQ ID NO: 600082 - DNA, 222 bp, Homo sapiens
  misc_feature (215)..(215): n is a, c, g, or t
tcaggtatctctacctcaggcgtaggtgtatacataggcccatagtataaagcctagctttcagcagagatggccagggtagatacatgatcctctggctggttgggaagcacagacaatagggcaagcggtgaaatctttgccagtggtgatagatgtggtctatgcatataattagcatgtaaaaatacaaacactggtctactcgataaggntacgcac

SEQ ID NO: 600083 - DNA, 1010 bp, Homo sapiens
gcagaaggcgccctaatagtgggacaaagtaggtggtacagagcggtccccctacaagcgtgaagattgtcgggcacgctcccccggggggaacaacgtgttcgggaacacaaaggacctcccacgcgggggggttccccccggaggcacactacccggtttgaaggccggtaaagaaggatgggaaacaaggagacccgcctggggggagggcccaccctccctccgggaaccgtgacagcaggggccaatagtcccctgggtggccaggtggagaacaaacactctctttaaccccgggggatgggcccccccctctgctttccctggaaggaggaattcttcgttggccctccttcacgcgttttttttttctacctgcgcgcctatccccccggttttcgtaagcccgcgccgtgctggtaaatattttgggcgaaacaatttaaatagagccaggggggataaaagaaaaggtttctgatggaccaccctcgcgtcggccctgggggcaaagaattgctgattcctctcgaccaagccaatcgtggtgcagcaccctgcggcttaggcttctcagaagaccttcgtggggtcacacagagtacaggccccaccgaggcagttgtcctagcatcagttcgcaccgcgccacacacggggagcgtggttgctacatgatacgcctcgtcgcgcccactccacgggttacattatgaagtggttctctccacttgctgtggtgagcatactaaattatttcaaaatggcgggtacacaaataattgtaagtaggaactaaacttagtatttactggttttgtcaacgagtttatagatacatacaaaaaaacttcggtcggtagccagaagcccgtgcggcaacacccccgagtgtgtccacccgccctagggggggagccaaagttgggtgggttcaatgctaagggcaccggtctttgctaacccccccgcgcccaaaagggaaacccctttacagccaacaagac

SEQ ID NO: 600084 - DNA, 133 bp, Homo sapiens
catagaggatccccgtcgtacagcatcaacattaagcctgagaacttctctgttaactgttccttgccaaatgaaaatcaaacaaacatcccctttaatgagttgaacaagtctcatgctcatacagacgctc

SEQ ID NO: 600085 - DNA, 357 bp, Homo sapiens
  misc_feature (27)..(27): n is a, c, g, or t
  misc_feature (35)..(35): n is a, c, g, or t
  misc_feature (54)..(54): n is a, c, g, or t
  misc_feature (61)..(61): n is a, c, g, or t
  misc_feature (219)..(219): n is a, c, g, or t
aatgtgtgccattataagaaaagagtngggggccngggctcatgcctgtaatcncagcatntgggaggccaaggcgggcggatcacctgaggtcaggagttcgagattagcctggccaacatggtgaaacctcatctctactaaaaatacaaaaattagctgggcttggtggtatatgctggtaatctcagctactcaggaggctgaggcaggagaatngcttgaacctggaaggcagagtttgcagtgagccgagatcatgccactgcactccagcttgggcgacagagcgagactcaatctcaaaaaaagaagagtctgtaaagatgtcttttaggctgggcacacattatggag

SEQ ID NO: 600086 - DNA, 111 bp, Homo sapiens
ggtgcgggacacgacaggttttggggccctcccagggttttcttatgccgatgtggttgcaaagataaaagaaaaaatcaaaaaattttttatttgtggttgttactcaaa

SEQ ID NO: 600087 - DNA, 1128 bp, Homo sapiens
gcccctcgttgttgggtccccctctcccctgcggttgtgtgttgtatccaaccccttgctcggttggtttggatgggtggggccctctctttttctctttggtgtcctccccccaggtttgcgtatgttatattggtttgtgaaggaccgtctttattttgtgggtgtttgtgtaagtgctttccctctgctctcgttttttcggagaaggacgtgtcggaatggcgcgggggttgtttgcgccctcttctctgcgctgatgaatgttttttttgtgggatagggggggggaagctctcgctcgggcgttggttgtttgtaagctcctctcgctctgagatttctgttttgggcgtgatagtgctccccttctgtctcccccactttctctgtaggtctttctctacacgagtgagagggtgtctccctgccacccagttgttctatttgtgctccccccccttgttctcgcgtttatttctccgcgctcgccgagtgcttgtctttcttctttgtggagagagatatcttttttctccaccctctcttcttctccctatttgtgggtatctcctgtccccctctgtctcctctcgcctgttgtctctctctcctctctccctctctccgctctctctctctctcgccccgttattcccgtgtgaaaagagggcctaaaagagggtttttgtggaggggggcgaacaaaaaacacccccctctgtggcgtccctatagaccctcctcgctaaacagagttgttttgtatatacacccccccctgtgtttgtttctcccccccatagaagagaaatgtgcgccccccccgcgtctcttggggtgggtggtaatatctcccgccacacaccaccgcgtgttcgagagcgccgctccctccccgcgggagagagggggccccccccccctctctttttttccaccactctcttcctctttttcccttttctattggttccccccccacacacacacacctggctttttttttattcccaccacactttgaagattttatttttattttctttacctttctgcttttttttatatatatttaacaaaaagaagacacacttcccccacgagcccccaaaaaatggggattta

SEQ ID NO: 600088 - DNA, 162 bp, Homo sapiens
ttggatcattagagcggcgcggtgcccgtactgctgttaggacagttaccaacagcagggcacgagcttctctgcaattaggcaagtctaccagacaagaaatgtacgggcaatcttctatccagagaaatcatccaagccctacctgtatcaaaacatcct

SEQ ID NO: 600089 - DNA, 1541 bp, Homo sapiens
  misc_feature (799)..(799): n is a, c, g, or t
ccgtggttatgagctgccctcgttgtgtcagagggtgtagttttccgtctgttggggggtgggctggcggtgttctatctgatgtgtgttcgctgcctctactattctcatttggtttcaacatacactgggcggtggtcgatgtgttggcgcctcgtggtcgtgtggtggttctaccgctcgccttactgacggttggtccaccgtcgtgtttgtttcccgtgttattagtcccttgtctcacgggagcacagtgtaaatatcaccgtgctgcgcttctgtgtgtatctctgcctctctctgtgtgtctctggtcactcgtggggggggtgtgggggacttgttttgttgctgtctgtattgtcttggtgctggagtctgtatcgtcttcgcggtccttcgtctttcgatcacatccccggcgtgtgagtccacatcgatgtgtatatgagcggagtggtgatcccctgcttcaagttcggtggtcgacaatatctgttcatgctcgtgtggaccgacaccattattttggtgcggaggtctacatcttcctcgtggtgagttgatataatctctctccgtggtgagggtcgtagttgtttgcgaccacaacaagactaattaccactatctaaattacactatggcgctacacccgtatcattctggggctaataactcccctccacgagacccttgtgggggttgcactcactactagagccagcggcgtctcctctaccatggcgtttttgatgcgcaatgtgggctcttaatggcgcgactgtgtcctacgagnggttcgttcctcagctccacttctgttggtctacaacagggggatcaactgggcactactcccctgagggggttccacatgggagcacacacatccaggcgaccacacccacgattgtggccattttggtgatcaaggggaccatattggggcccaccaaaaacagatgggggcccccaacgttctataggggaggcagattctcaacctcaaacgacctctacctctacgtcacactctgtgggtctctctacacagtcacactctctctttgtgcacaacacgctgtctattccagaggtggcggaagaatgttctggataagagattgtaacatcgtcattgaccttgctttgtgtggaatatgaaacccgggaccactcttggacgcgttccaacaagaggctgcgcccatagccatcgagtgtttttcggcgcgaataacacccggcggcgccacaacaggcgtctccaccacagcccattggtagcagcggggttttccgcccttgcatacattcgctccaagttccagcccaggatcgagacacaacgtggggccccacaagcactcaatcacttggccgcacttctccgatccgcgatctatggggcgaatcgggaccatgaggatggccacccaaattcaaggaccaaacatgaggacaacagacctttttctaacagaaaaatattatgtgtatcttgacaacctattttatatacatctacttgcctttgt

SEQ ID NO: 600090 - DNA, 258 bp, Homo sapiens
  misc_feature (35)..(35): n is a, c, g, or t
  misc_feature (66)..(66): n is a, c, g, or t
  misc_feature (107)..(107): n is a, c, g, or t
  misc_feature (110)..(110): n is a, c, g, or t
  misc_feature (190)..(190): n is a, c, g, or t
  misc_feature (227)..(227): n is a, c, g, or t
  misc_feature (249)..(249): n is a, c, g, or t
aaacaacactggtgtgacctcgagggcagaaaggntctgccctgtgaaggtcaccagcaccaacancacggtaggcctgaaattttcaccattgctgtcaagttccnttnggtttaagcattaccactcaggcatttgactgaagatgcagctcactaccctattctctcttttacgtttagttatcagnctttttaaagtgggttattctggagtttttttgtttngagagcacacctatctttagtngtttcccca

SEQ ID NO: 600091 - DNA, 917 bp, Homo sapiens
ggatgccgcgtagcgtcgccgttcactccgatgagataccagctcggctagaggatgaagtcggagggttagcagggacccctgggaggcgactttgcatggtcgtgcaagtctgacagttcgacgggtgcaagaagatgcagagctagagtaaacacgtttctaatcttggagatggctaaaccagtactccatacgaaagcatcatcacagcatcacctaccagtctaggcagcgacctagccagtcacgacaactagtcctgtgagcgcgcgcgaccgaccggctatatgacctcgctaaattggtgcgaagcagcgcctagccagcacgaaagacatgcatatggcttgtacgtattctgaccttgaaggatattgtgtactgataggagagcgcacgggcaggacgcagagtagcgctttacaccgcatactgaaggcacgtcgtctattatggatgggaaagactcgtatccatccgcgaagcattcacctgtacgcgcaatgacacactgaacgtgaagacggtattgtgcaggagcaactactgggacacacgggccagggggggcatacggtgcttacattctgcactaaacgcgatttacaacgcggactttcgtgactaagaatgcctgacgtctgggcaccatcgccagaaactccgtatgcgagaaacattgggcctaccaagctgagaggcgtaggaaccgcaaattagtgagttcaacgtccccggtgtgcggaaaattcgctagcttggaaggtggattgcgggcgatccgggcccgtggccaaggtaggtggagaattccctaatttaacaggtgttcttgacagaccctgttacctagctagtaattgctgatcccaatcagaaagcatggcttggcacagcacagccccgttgtacaa

SEQ ID NO: 600092 - DNA, 228 bp, Homo sapiens
gtcacagcactctccttttcataggcctctagcatatcactttccagtaccaaccactttgcacctcttcataggctttctcctccctgacaggtattcccacacccagagcagggccctgcacagaggagacaccaaagactccaggactcaaggctgctggattccccttaataacagcaaacaacggctgggcgcagtggctcacgcctgtaatcccagcacttt

SEQ ID NO: 600093 - DNA, 575 bp, Homo sapiens
gttggctgttcggagggtacaggacggcggtgataaacggtatcatgatcgtacttggtaccgcgagttgtaacaggaaggtcggtggtactctgtggtccttcgtgtttgtatatcgtacgccaggatgatgctggttgctcggttgtacctcagtcctagcttcatcagacactggggccgtggaatcctgtctgctgctgtcttcctagattcactgaatccacttctgtgtagcaccggggtcagctgtcaattaatgctagtcctcaggatttagaaaataatcttaactcaaagtccaatgcaaaaacattaagttggtaattactcttgatcttgaattacttccgttacgaaagtccttcacatttttcaaactaagctactatatttaaggccttccaaattcttctaactcttccaaaagccttctgccttagttttttttaaattacaccagtccttttagtagcttttggatgcgatttttaaccaacttccccttctagcttcaagtattcttctaaatgggttctggtctacgtaaacaccctcatcttctcaagctttaa

SEQ ID NO: 600094 - DNA, 133 bp, Homo sapiens
ggcgcattgtctgtgaacaagaaggctcaggcccttgcttattctgtggcactctggtgtgtactcatgaggaccaagatattttacagcgtgactaaacaaggagccagaactgctaaagaactcatgtcag

SEQ ID NO: 600095 - DNA, 213 bp, Homo sapiens
agtttccccctccccctttgcctatcccctccctttggtttaagccctgaagccttgattgggagctgaaaggagttgcagctgttggcatgagacccccttctccccgttttggggagggggggaccagcagataaatcccccccttccttgagcggtcgcggtactttgaagttcagccagctcagattttataaaaattaattaaaatct

SEQ ID NO: 600096 - DNA, 254 bp, Homo sapiens
ccccctaagcttcctgggtgaaaggctggcctttgggggcctcccccccttggttttactcctttattcaatcacatgagactcctgaatttcaaagcaggaagcatgtggagatcattttttcagccctctgttttcaggcaggtaaaagggatctgtcattctcattttgaagttttatgtaatgaaatgcaaaggttatgtgacttgttccagattttttggagtaaataaactggaatttgctcctccca

SEQ ID NO: 600097 - DNA, 353 bp, Homo sapiens
acctgggtgtgctatagtgagatagtgtaatagtagtgcatgtgtgtacccatgcaggaggagctccagccagggctctgccttaccctaactgcgtgaccctgggcccgtgacttctctctgggcctgtttgaccatctccagcactggaataagaggtgccattgtggggcgattctgagtgctcacagggctaggtccccacagagttgctcaggagccataagctgctgcagggatcatcatccccatcactgcctccctgcaatctcacataccatctagaacctcctgccccccgaggtctgcagtctcctgaacccagacagccatctacgccaatcaacgatgat

SEQ ID NO: 600098 - DNA, 321 bp, Homo sapiens
ttgcacctgaatcctgtaagtctgaatctagagtatcccctactggtcgcaggcggtactggttctgcagcggagcccaggctcttgatgaggaaatatgttgtgtaaagtacatagagagagtgcgtcatattttgtaccctacgcaagattgtatctggtgagggtgtaattataatcatgtttgtgtattcggttactggtttgcatcgtctactcgtaatgcagcgggctttgcagcgcctactggctttgcagggccgtatccgagctccaacttcatatactcatgtgtcatacgcttatttccttgtcgtgaga

SEQ ID NO: 600099 - DNA, 159 bp, Homo sapiens
  misc_feature (66)..(66): n is a, c, g, or t
  misc_feature (92)..(92): n is a, c, g, or t
caagtcgttgggtataagctctgaacttcacatctgaagaggcaagaaaaatctttgccattgtgncttgtctgtggaagatgatggttgtntgtttctagtttgtatatgttaccatctttgtgatccggtgatttaatcaatctctttgaatacaaa

SEQ ID NO: 600100 - DNA, 1008 bp, Homo sapiens
agtttgggcccggaggaaccgttatggaaaccgttcgtgaacaccagggtcaggactacacgcggctccaagcattcgtaggctcgaggaagaagctagcaatatagcaggggacctgccacccccagccctaaccccgagcaacggctcaatcggcaacgagggctctgtgccggcctccacgctgccggggaagacccatctgacaaggcggacaagacaggcccctccaggcctcaccaagcccacggtttcgcgcgacgcacttggatcagcttccgccgaccacggggcaccctcgttcttcacagcatcccggtcctggctgggggcttgtccgggaagacaccttacccatgtgggcacatcagggttgtgacacagcgccggcccctggctcagggaggaactctcagggttcctggagaattcctagcagtggaactccatgccccgcctcccaacggacctggacgtagagggcctttggttccgccattatgatttcagacagagctgctgggtccgtgccatatccccaggaggaccggcgtggccccctgctggcaggctgtacaccatgcggagcgggtgagatcggctttcgctgcacccagcatctgattccgaccagggcacccccttcagagcctagggacgaacagcagtgtgctcccatcctcagggcattgcactcgtgcggcgatccacttggaaagttctcagttccctgccaggcttctagaagcatctgggccagggctcatggctgagataatttccctaggcttaacaacccaagctaacgcttcgcatcctcgtatttattatttgggtaaacttatgtcaaatgtacttaagtaagagtgcagctcgagagagattcagagatggaacacaccagaccaccagatcacgaagccaaccatggcccagcccctcccagcacccccagccccacgaccatcgttctgaattcgacgaccctacggcctggttgtacttcaa

SEQ ID NO: 600101 - DNA, 901 bp, Homo sapiens
cagcgctctgggggcccctccgcacagtggggaattggggccccaaaagtgggggccgctcctcgcggctgagtggtgacccctcgccgtctggggcgggcccacgccactacttgtcggacacccgcgggaaaaaacccccttgggtacaccggcccgcgcgcccccgcggttgctggcggcccccactggggccccggccgccaacaaatctgcccgaagatcacgaaaaagggggggaaacaagagctattcagcgcccaaaattcgggaaagcgtataattctggcgccccactttatcggcccacccccccgggtgggtaccgcctcctcccgccgcccccccgcgcggtgaaaaaggcatgcccacgcggcgtcccagaccgggcggtaccacagaagtccaccacgacggaccccccccactggcttctgataattggagggggggcagcccccactacaggaaccccgctagccctccccacacagagggcccactccttcggcaggtgaacccccccatggcagaagattttctccacgcaacgagatgctggccaatggccggcgccaaccgccacacaaaagggggcaagcacagggcgccacaacctcggcgaacacccaacaacatgggaggataacgtgtcaacggaggaaccccagtattctgaaggtgcgtgccccagaagagttgcccttcatttcttggaggctggtacgcaccgatgagagcgcgcttccctttttctagaaagcatagaatttacccggggacttcttctacagcaggtcacgccgcccacaaggagcaaaaacggcgtgggtgaacacaaaaagacgggaatttcccggggccaccccaaacaaacccaaactttttcttccacaaaaca

SEQ ID NO: 600102 - DNA, 554 bp, Homo sapiens
ggtgagacacattttgcagaatcctgccaaacaaaggaactgaataggctgtgggcaaagcaaatgagggagagttaaggaatgaagtattttaaatattaataattaattccgacacggttctgtattttccgcaaaagaaattaaccttttaggtaccccactaatgaattttattttccaaagaattattgccctggcaaaagtttttggaattccaggggaaagctgtgcccagcttattccgaaaaccccccaccctgggaaatcccgaggaaaggggggccttcattgacccctcctttttgccaaggttccaaaaaggaactttcaggatgaacacctggcctggtggctttccactttagagggaaatttttggtgccaaagaggctccccttgggggaggagaccaaaaaaaaaaacgtgtaaaataaccaaaaaccccggccttttttggccgggccctattcttggggggattaaataaaaatttctttgttgtgggaaatttcgataaaccccattgccgggataaggagcggggcaagaga

SEQ ID NO: 600103 - DNA, 170 bp, Homo sapiens
ggactgtctgttgcgtggtgttggatgaggctggatgatcattcaggagctgatggccagcacaagggtcggcctcacagaggataaactcgagaaccaggaaacggcgagagctgtcagcggggaaaatccgtggctggaaaatccaggtgcccagacagggttcccgg

SEQ ID NO: 600104 - DNA, 990 bp, Homo sapiens
tcggccggaagtttttataatgtgaccacgcgctcgagggataggaagattagggtctagagaaatcctggttacctccgaggcctggaacttttacggcccttggtgcttaagtaattggatttctcaaccccgctccaggcatttatcccccgtgtaatcctaacctcatgggcttagcaaaggaaacaaaggcattgaaagggtttgcaacttgtccctgacactgagctcctgtagctgtgagccctgccgactgagtgttcctcctttgcctcctctgcagcatccaccgtctctctcaaaatccttgtccccaggagtctgtttttctagcctgcaggccttggttcctagccctgctaagcagatggaatttacagaaggagccgtttcctgccagtccaccttcctgtacctcggggaggtgccatctctgaccctgctggccactctgcagatggggaagagccaagggaggctggtaactcctgtaggaggcagagagaggccctggaaagggattctgagctgagaaccctgcctggatccatagaccaactttctctacttcatgttctcccttgagtgtgaccctttgccaagtcattcctctgatggcttgaataggctcaggctggggtacagagggctgtcctactgcatcaggcctgctggacccagatagaggaactgtgccttccccccatggctcattattgccttacacctagttctacggggaggcatccagaaatggttttcaagggcagacctggcaggtgtgtcagagatgtcacccatattatcttgcacggggatccactggactgaactcttcccatctaggacccttaagtgttacgccatcctattctcgccgtggtttagactagtataactaaacgagaagaggctacgaaagataaaatggcgggtctgaccacgattcgaggggcgaccaacttaaacacaggtggacgaagcaac

SEQ ID NO: 600105 - DNA, 817 bp, Homo sapiens
  misc_feature (3)..(3): n is a, c, g, or t
  misc_feature (81)..(81): n is a, c, g, or t
  misc_feature (92)..(92): n is a, c, g, or t
  misc_feature (107)..(107): n is a, c, g, or t
  misc_feature (113)..(113): n is a, c, g, or t
  misc_feature (132)..(132): n is a, c, g, or t
  misc_feature (148)..(149): n is a, c, g, or t
  misc_feature (154)..(154): n is a, c, g, or t
  misc_feature (160)..(160): n is a, c, g, or t
  misc_feature (177)..(177): n is a, c, g, or t
  misc_feature (190)..(190): n is a, c, g, or t
  misc_feature (196)..(196): n is a, c, g, or t
  misc_feature (210)..(210): n is a, c, g, or t
  misc_feature (214)..(214): n is a, c, g, or t
  misc_feature (220)..(220): n is a, c, g, or t
  misc_feature (229)..(229): n is a, c, g, or t
  misc_feature (243)..(243): n is a, c, g, or t
  misc_feature (276)..(276): n is a, c, g, or t
  misc_feature (278)..(278): n is a, c, g, or t
  misc_feature (315)..(315): n is a, c, g, or t
  misc_feature (322)..(322): n is a, c, g, or t
  misc_feature (325)..(325): n is a, c, g, or t
  misc_feature (351)..(351): n is a, c, g, or t
  misc_feature (354)..(354): n is a, c, g, or t
  misc_feature (399)..(399): n is a, c, g, or t
  misc_feature (411)..(411): n is a, c, g, or t
  misc_feature (414)..(414): n is a, c, g, or t
  misc_feature (418)..(418): n is a, c, g, or t
  misc_feature (440)..(440): n is a, c, g, or t
  misc_feature (442)..(447): n is a, c, g, or t
  misc_feature (453)..(453): n is a, c, g, or t
  misc_feature (462)..(462): n is a, c, g, or t
  misc_feature (464)..(464): n is a, c, g, or t
  misc_feature (473)..(473): n is a, c, g, or t
  misc_feature (478)..(479): n is a, c, g, or t
  misc_feature (487)..(487): n is a, c, g, or t
  misc_feature (495)..(495): n is a, c, g, or t
  misc_feature (498)..(498): n is a, c, g, or t
  misc_feature (506)..(506): n is a, c, g, or t
  misc_feature (651)..(651): n is a, c, g, or t
  misc_feature (743)..(743): n is a, c, g, or t
  misc_feature (807)..(807): n is a, c, g, or t
gtnaggcgtcaaattagtagtgacaatcttttttttaatcttgaaagtccctagttttaaagaaagtagaatccatctggngcatgtctgcntcacagggtatcacncaagantcatcatcaggccaaaaanactctgaagggaaccnngaggntttggnccttgctgtggaaagangctactgaaagtntaaganaacaccctaatgcncgcntcaggnacgaaaccntaccatgccccgcnaagacatgggaccagagaacacgtcaacgtcangncgccccaggaaaaccatccacaaagacaacagaagcnaacccgnggncgacactgccatgaagagtgtgggcnganaccgcagtgaccagtgtctttactggacgcgaacatccctaaggncacggctgtgcngcntccnaagcatacgtgaccacgaaacngnnnnnncccggncctccttancnccacccctnccccnngcccagcntgcctcangtnctccaganccttctcctgagacagcactaggggccacgtcagaccccaggctgcagcccttcaccgtgcccgtccccggtccggtctgccctgctggggctggtgggtatcatggggaccctgtgtagacacggacaccggagagcgtggganaggaggcgtctcagagctccccacccacacgctcaagggtcagcgtcactcatgtttccttctgttcccatggtgcctccaaaagggtttcnaacaaagtcatcattgattaccctggagtatgtgaataagccacacaccagcagcgagatacancaaagctagt

SEQ ID NO: 600106 - DNA, 101 bp, Homo sapiens
attctagaggatcccagagccggcaccgttcctggacgtgcagatgacttctcgcaggttaatgtcatccagttgtcgcagctcaccaggtgtctattgta

SEQ ID NO: 600107 - DNA, 477 bp, Homo sapiens
caacgctacgagtagacatgggattctgcatgacctagcacttgtccagggtggggatatatatgccagcatagctctctcccgcgtcacgaacagttagtacgtgctatgtaactcctggaacgaggcggaagatatctatgaagggcctcaatattgctctgggcgacctcagtgtcattagttgcataaaacttgtcatcggattatgagaagcccacccctagctggggactccaggtataacacattggcaatcagattccaagaataggggttgtactccagggatgacaccatctggctggaccaagaaggggccatgctcagtgaggagcccatctaagtgagctgcagccgggacccccattgagccaaagcaccacagggctgttctcgggatccttactgggactccacaaaccagtagtgaaggtagctatggagccggagccttagaggtaagccagaatactg

SEQ ID NO: 600108 - DNA, 159 bp, Homo sapiens
ctcacgctatacttacccaagcccctgatcccttatgtactcttggcagatgccccaacttatactacttaccagaacctaaggccaactagcatacaaatccctatgagcacacttacgatatggcactgctatatatactagtagacatactgtaac

SEQ ID NO: 600109 - DNA, 368 bp, Homo sapiens
ttcttgtgctgtttagacataaagtgaaaataagatacatccatgctataaaaactattccaactactgattaaaatgaacttttgcggaaaggaaaccttacaatccttgctcaaagttaacctggccaggtgcggtggctcatgcctgtaatcccagcactttgagaggccgaggtgggcggatcacctgatgttgggagttcgagaccagcctgaccaacatggagaaaccccgtctcttctaaaaatacaaaattagccgggcgtggtggcacatgcctgcaattccagccactagggaggctgaggcaccatgcctggcctattttgatctcatttttaaaaaatgttttaatatatactcat

SEQ ID NO: 600110 - DNA, 116 bp, Homo sapiens
tggggtgctggcttggacagttcatcctccgacttggatccgtcacgtaggtcctgacaggtactgctgcaggtattgaggagaacgacctcaatctgctcctggcaaggctatga

SEQ ID NO: 600111 - DNA, 130 bp, Homo sapiens
ttgagcagctaacattctgagcttatgttcccaactgtaacatggggaaaataatggggctgtggagaagataaaataacttaatatatgtaaagtacatctctgtggcccatatgaaattaaatgctca

SEQ ID NO: 600112 - DNA, 403 bp, Homo sapiens
ctgaggtatccccccgccagtctggggcttggcagaaaggattatgtggtggaaaacatttggctcttccttgcgggagtgatgctggggatagggaagagagtggctccagcctgcacgttcaatagtgctataaaagccaacgtcaaatgctggagggtagaggacagtcagcatgttcagcctggggtctgtgtgtagggttatcccttctccgctgtgccttcccatcctcgtgcaatgagcctaggtcttgcagccttgtgttgtaggctgctgtgatgtcccggaaccggggatctgtctagcgttttggccacttcctgggacctcacgcccctttttaccgattgtgattgggcggcaaggccttgctgtctttttctctgctgttccgccttgg

SEQ ID NO: 600113 - DNA, 1066 bp, Homo sapiens
gattacgacgagaacaagataaaaaatcatacatcaatttcatttatctccttcatatcatactctcttcttcctaatacttccctaacaaggccatagctaaacagttgaggttatataggatgtcactttagtaatggcagaagacaagagagaagacactcttattatagtcttaaagccttcgactggtcttagaacctcctggggcttacgacgattcggcaacggctatattaacgaaaagtgtacatacgatttccattgatcacatgtcactgatcataacacgatggtaacgatgcttaacgtggttttttagagaacgatgaggacctctgtaatgcatccatctggaacctaagtatagtcacttcatagcacgtcttatcgtgtactgattaagcttccgatgcttgacattcacccttatctagaataactagagtggaccagtcgttttatcttaagaattaagacatataaataccgcaaaagtatgtcaggatcgaactaacaaccagatacagacggaaaatttatcttgaatacacccagtagagttgtgccgtaggcaagccaaagttctacaatttgccacataaaatccaccagactcactaaactcgttaggctttgctagtaatcaaacatagtggacaatagagctttcgatttcgatggttttctggtctattttgtgctgaaagtcagtgcaagtcaattctagctcttcattaatatttcatgagccacagtgagatggactttgtcctggtgatgactatactgcaggatcaatgggcccagcgtcctctcaacttaagaatcgcctcatctcagcatcctataaacagaacatcactgttgaccagcatttcagctaacggttcatccgatggctaaataattaccaggggcctgtcatgggaacctcaaaagacaatctgataccccgttgttactctagaacgcacgtgcattacaaaaagacaaattcccctgatgacatttcaggtaagcaaaaaaacccgggaaagttaaatgaaccgcaagcgtatacaac

SEQ ID NO: 600114 - DNA, 350 bp, Homo sapiens
  misc_feature (77)..(77): n is a, c, g, or t
  misc_feature (319)..(319): n is a, c, g, or t
gcaagaagcatctttgctttgaagaaggccattgtcaaagtgcaagaccatgtcaggctctgcagaattgcctgacntgttttagtgatttaaatatgatctctgccctggctcacagaaagtgcttacagatttaatcctctgatacataagggttgttctgaaggtagggagtgttcagatattctgaaactctaagattgtttaaataacccatatgttcatctttttgatgcagtataaaacgttcatattctggtgtttagccatccctggtcctaaagataataaaggacaaacataatggtttaaaaagggnaaggtttcttaatatgctaaccaaaaaaaaa

SEQ ID NO: 600115 - DNA, 920 bp, Homo sapiens
gagcgggtttccctttccgggcgggcaggcggcggaccccagtgtctttatccctcttttgcacagtcagcttctgcagctctcccgggctagcatggcagcgtggaagagttggacggccctgctggctctgcgccacgagttgttgtacttgatatggtcgtctgtaaaggatttgtagaagatttagatgaatcgtttaaagaaaatcgaaatgatgacatttggcttgtagatttttatgcgccatggtgtggccattgtcaaaagctggaaccaatttggaatgaagctggtcttgagactgaaacagcatgtggcttctccagattaaggttggaacagatggtctgctacgttcgctattctatgcacttgcttcaggagctttggcagttcgacggttatccaagcaattacagctcttaacaggggacttggcttataattatacgaggaccacgaacaaaagctgatatcatcgagtattgctcacagagctatctggggctctaacttcggccacttccaagtcaacaaatgtttgaacatatgcagaagagacaccgtgtattttgcgtgtatgtaggtggcgaatcacctcttgaaagagaactacatagatgctgcttcagaaattggattgtctactacatactctcttttcttgcctcagaagaacgtggctcctgaagtcatgtgacccctataaagacgatgccgactgtcgcttgtttttcaaccatggacccaccttcaccttgggtctactgaatgagctactgcaccgcctcgccctgatcctgccccctcctgtcatcccacagcccccccgcgcccacgacatcgccctcgctactcacggcctccctcctgtatgaccctccgcaccccccgcacactctcctcgctccctgtca

SEQ ID NO: 600116 - DNA, 131 bp, Homo sapiens
ctgtggtctgatctaagtgatcccgggatggcgaaccacgccaggtcgtgcgagatgaacaggtggtcagcccctgctcggcctgcaggtcggcagcagatcagcacctgcgccttgaccgagacgtcgag

SEQ ID NO: 600117 - DNA, 1189 bp, Homo sapiens
ccgtcatctactctaccatctttgcaggcacactcatcacagacgctaagctcgcactgattatttacctgagtaggcctagaaataaaccatgctagcttttcattaccagttctaaccaacaaacaatcaaaccctcgtatccacagaagctgccatccaagtattatcctcacgcaagcaaccgcatccataatccttctaatcagctatcctcttcaacaatatactctccgagacaatgaaccataaccaatactaccaatcaatactcatcattaataatcataatggctatagcaataaaactaggaatagcccccatattcacttcatgagatacccagaggattacccaaaggcaccccgtcatgacatccggactgaattcttctcacatgacaaaaacatagaccccatctcaatcatataccaaatctctcccatcactaaaccgtacaagccttatccttcactcatctcaactcttaatccatcatagcaggcagacagaagagtggacataacaaacaaacacaagataccgcaaaactcttagccatactacctcaattaaccacacatagagatgaaataatagcagtcacataaccgtaccaaacctaaccataaaccattcctttcattatacacatataacatctaaatcctaaactactaccgaattccctactacatcaaaataacaaactccagacaccacagaacctaaactaatatcatcggcaacctggaacgaagcacagcatgaacgaacaccccttaaatcaggacaaacgacgatgaaccataggaaggccatggcacagaataaccgcgcatatggccaacaggggcatatcgaagaagccacaaacaagaacatacaaagcagaaagaatagcaccataacctcatagacaaataagccagggaaaaaggccactaataaaaacacgaaaaaagataaataggaagcaacagcagaccacaaggacgaaagacgaacacacggagccacatacaagaaaaacataagagacacaaagcaaaagaaagcgcaacgaggacgaatagcagtaaagataaaggacagagctccgaccaagagatatcagcaacacgagcccacaagaggagacaaaaagtaaggagagggagcatcgaggcagagaagaaggaaacggac

SEQ ID NO: 600118 - DNA, 380 bp, Homo sapiens
ttatgggtcggatggacattgcgtactgaaccagcgtagctcgctaacactgcacaggagtagccagcaattgtggaagttcaggccgttggtttgcgtcatattggagtgttcagctcggagacctggatggccctgtgtaccttttctcatgggacagaatagggaatcattttcataactcttgccattaaagcaaaatcacaagtcaatgaagaatagagacatcatataccctctgattttagatcttatgcagttatctctatcactctgagcctcagcttcttcacccatgatccacggttgattatacttacttcttgagctttttgacaggattctatgaaatcatgtatgtacaagccttagtctggggt

SEQ ID NO: 600119 - DNA, 462 bp, Homo sapiens
cacgaggtgttttcgatgcgcgatgtcacgccctcacgtgagaacagaacaccgaccttgatgggatcgtttgtggacacgggtttgcggccgggtgacaaaaaacgtgatcgatactaacagagcttgaccgcgcgaaagaggctcactaagattcactcaacgcttcgtcccgccaacactgccgggcgcgaagacgggcaaaaaggcctgcacggatgtccggatccggcaggcctttttgttttggtttttcgctttcgtgttttcgcaatttttcgcgatttttcgcattggccagtgccggccggtcgcgacaggagcttccagatgttcaacccttgaaggagagtgcagtgattccgatacccaggaaaggcacgccggaacgccaccggctgatccaggagcacctcgagtgcgtgaagtccatggccggcgtggccggcttctcggtgctca

SEQ ID NO: 600120 - DNA, 480 bp, Homo sapiens
  misc_feature (338)..(338): n is a, c, g, or t
  misc_feature (376)..(376): n is a, c, g, or t
  misc_feature (411)..(411): n is a, c, g, or t
  misc_feature (430)..(430): n is a, c, g, or t
agggaaagaaggaagatttgggacgagttgcactgggcacagagactaggaagggactgatgtgtaaaagaatgcctggacatcaggcacctcagaccatttgcccattttacgactagaattatttagatcttgtaggatggaaacattgaaagtgccgttttccagctatttggaactactgtggagtttgtattggggtcaagcggcattgcagaagaaaataagacgcttagattttaggtcaggtgagagttgaagaggtttataagttcttaagaatacaggctaagggagaaggaggaggaatggagggtggaaacttgcccatagtgaangaggcaagcccagagaaaagagtagagacacggagaangggcgggggtttcttgcccttcagaaaagcagagnggttggggcatggaataangggatgggggttcttgccccctaggtggggacttaccacttaacggtgag

SEQ ID NO: 600121 - DNA, 711 bp, Homo sapiens
cataaaccaggaggtggccaggtggaagtaaaatctgagaagcttgacttcaaggacagagtccagctctgaagattggtgtccctgggacaatatcacccatcgtccctggcggaggaaataacaaagattgaaacccacaagctgaccttccgcgagaacgccaaagccaagacagaccactggggctggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggctttgtgatcaggcccctggcggcggtcaactaattgtggagaggagagaatgagagagtgtggaaaacaaaaatgaatacatgacccggaccccgccctctgcccccagtctgctccctcgcagaaacggtgtaactcggtaaatcacgttaagcctgctttgtgtcactcggcttcggctcgggacttcgaaatcagtgatgggagtaagagcaagagtgtgcatctttcacaagattgatgggctgggctagtagataacaatcttgtaaggaaacaagcattcaacaaggcatggccatcatccaaacatttcctcaggcaagttccttttggatacctgttttacttccccctccatgtagaaggg

SEQ ID NO: 600122 - DNA, 515 bp, Homo sapiens
gcaaaggctcgccccaaatgcagcatttcatacgatccatcgccccacatgccaacatgagcacccgtgtgagatctcaggagctcctggtaagccatgggtgcaggacactggtagagagccaaaggtccctccccagacatctggacgctgggcatagatttctcaagaaggaagactcccttgcctccccagggcctctgctctcttgggagacagagcaataataaaagcaagtgtttgtaatcccagcactttgggaggcctaggtgggcggatcacgaggtcaggagatggagaccatcctggctaacacggtgcaacccctgatctatgcgcgtgtagtcccagctacccaggaggttgaagcaggataatcgcttgaacccgggcggcggagattgcagtgagcggaggtcatgccaccgcatcgcagcctgggcgacagagcgagattccgcctcaaaaataagcaaataaattttaaaaataaataaataaggcaagccagtgtt

SEQ ID NO: 600123 - DNA, 555 bp, Homo sapiens
gagatcccttataatgtgactattaatctaatttttcgaatgctggtgtatcagcacacatagtcactttcctctccagatttgagtcaaccgtagtgtggtcagtttatcttcaatattaagttcaatgtcctatttatctaagttcttggtaaaaacttggaccaattctagaaaagcatcctccagggaccgtagccaatcatcacgagttatccaatcactcaagcaggcatctcttcctttcaatttgctctgtactaacacggtccaataacgatttcaaatttcttggtctaccattctaatttctaaccctcttctcatttttccatcagagagaaagggagatttgggtcacaacaaatttaaacatttacaaatataatgaataataaaaaaatgttgaaaaggactaaatgggttctaaaatacagtatttaaattctaaaactcaagtattttacatagattgtttacatagaagtgcagtgaattctcctgagtttagcatgaattactctccccagtgtaacttacttgaaggagaaatct

SEQ ID NO: 600124 - DNA, 338 bp, Homo sapiens
  misc_feature (109)..(109): n is a, c, g, or t
  misc_feature (158)..(158): n is a, c, g, or t
  misc_feature (162)..(162): n is a, c, g, or t
  misc_feature (201)..(201): n is a, c, g, or t
  misc_feature (206)..(206): n is a, c, g, or t
  misc_feature (228)..(228): n is a, c, g, or t
  misc_feature (230)..(230): n is a, c, g, or t
  misc_feature (242)..(242): n is a, c, g, or t
  misc_feature (293)..(293): n is a, c, g, or t
ttatgaacgccatcgtcgatcacaacggcgcgtatatgatcaccgtacaactggctatctgctacgttctgttaatgtacgcccatcaacaatcaccgagctaattaancggtctatatacaccctatgctgccccgccgttcatcgaacttctcacnctanatcgcacccggaagcgttgcttggccctcgctctcccanatccncccgtctcgtgcgcacgacccncnagcgatcgtacncatcggataccgaaacttacaagccaagcgactaaagcctgcgcttcaagncccctacactttaacaccatcagtgcaccacgaaaaacactccga

SEQ ID NO: 600125 - DNA, 128 bp, Homo sapiens
aaaactcctacaccagagacccaacctgaatccaggcgatgttgcctggatataaaaatgtaggcctagtgagctgggctgccttcgcaatgaaggtgcgggttcataaagaccttagttttgaaagt

SEQ ID NO: 600126 - DNA, 159 bp, Homo sapiens
gtagcgactctagaggaccccttcgtgttagtatttgaaagcacgaaagaacagaaggaagggcagagttctgatgaggaagttaagaccatgacatgtcaggtagtggttcttctcctgctcacagaagagggtgagcagtagagattggagcagccg

SEQ ID NO: 600127 - DNA, 281 bp, Homo sapiens
gcaggtgactctcagatcatacctacagcgctgcttatcagaagccattcgcgagtttgcgtcagcccttccccactgcacgcggtgcttcatgggcttcgcgttcatgcgggcccactctgtctttgcctacattttctctgtctggtgatcactcacatctgaggaaaagtttgggctcccactgcaacacatgtattggaactatgggttcatgggcagggccttctttggacaaggagacggaattcgcataaagttccccaaatttgtgcatacac

SEQ ID NO: 600128 - DNA, 262 bp, Homo sapiens
acacaagtactacttcctcgtgggctacagtgaaactctgctgtcctacttttacaaatgtcctgtgcgactccacctccacactgtgccctcaaaggttgcgtatcagcacctctagaacaatcccctttcttccatcaagctgcaccccgccgagactggaaacgcgcgacagcaatgctatgtgggcgacaacgcctcccctcagaggactcagcatcagtctctcatctgctcttcaacaaagaccttctatctcgac

SEQ ID NO: 600129 - DNA, 317 bp, Homo sapiens
ggtgtcgagtaagaagaaagacttcagtagaaagctggtgaactccaaataagttgtacttagtttaatgtgtactaagtttaatttctcagtttggatcaatgttttataattatgtaagatgtcaacataaggggaagctgggtaaagggtacacagaaactctctgtactgtttttacaactcttctataagtctaaaattatttcaacatttaaaaaaaaatggtcaagttccaatacttctgggttgtttcactttcttcttactcattaacataaatgaaaatatcaaccatcattcatttaggaactgca

SEQ ID NO: 600130 - DNA, 282 bp, Homo sapiens
gatgttatatgtttaatgaggcggatgagggttggatgtggcttgctgtgcgctagcgggatgttgcccgggagcggcgtctctcagtgtgagcgggtctgaactcgactgagctgctggagaaagttgaggcttatctccacatctgtggaatccagagtgttttggtgggcctgtaaactttttttgtgctgccgaaggccatttgtttgtgtggattgaaatacaacactgtgtgtgtgtgtgtgtgtgtgtgtgtgtgtgtgtatgtgtgtgtgtgtt

SEQ ID NO: 600131 - DNA, 252 bp, Homo sapiens
gctgatgtcattgtgggacctccccataccggcctgcccgtcttatcttggtgtctttggggtttggggctctgtaaagccaagaaattgcagggttcaaaagaatgaaagtttcttaaccagaaaggaaaagccaaaagagcgaacgggagaaaacacttaagtctttataagttgggtagttaatgtatcccgttacaatacctctgactttaaaaattgtaataatgaacgatttatcaacgtaacatt

SEQ ID NO: 600132 - DNA, 417 bp, Homo sapiens
catacaggatcccagtgcacttcgtaacgcctaatatgatctctgaaatcaggtttgtctaataaatacagaacttagagtacatctatgagttactttatggcaagtcttagcgctattcaacggcacttatactatgcacatatctcattgtgttctctcaacagccatgtcatattaagtaatattactttgtttgatagaagaagaaactgagggtctggaccattggtagtaaagggcaaagttaggaactctgaacagatcagacaaagcctgtgtacttcaagtgttctcctaatgtctgcaatagaaatgtggatggagaggcttctggtcagctattctggaagctaaaaaaccttgtcaatagaataacattggaaattgtgaccacatagccatgacatagccatg

SEQ ID NO: 600133 - DNA, 400 bp, Homo sapiens
tagaaacacacgcttggcaccacgccactgtctccacggcttcactgtctgtgcacgctggggcaccccctcgtgaattttgggcacaaaccacgtgtgcgtgtccacaggagtcccccactcgtctgaaagtcttcttttaggtggagactcatcaacccacactctggggcactcttctagaggtgccacaataagtttaatgattcttcggcctcgttataaaaagagaaagtggagccacgtggttagccttagttttcctctcttgatgtaggttattatgattagctttgtcactgtttcactactcagcatggaaccagatgaattccctttgtaggtagtgagaccaaattgatgatcccttaagtgaacaccaataaaagggtcccattga

SEQ ID NO: 600134 - DNA, 419 bp, Homo sapiens
aaataagtttgcctttcaatcccgtcatcctcttccatccatgttgttaataatatttagcgcttgtcctagtaaccttgggggaaattaaggaccctaccttaccttagccagcgtccttgttacccagtggtcctgttaagaagatttagattgtaccaagaaggaagtcaggttttagccttgaaatagtccctgttctcggatctcctatagctaagggcaaagttaagcatcgaagaagggagtgggcatcaaagttggtgtgttggaatgctactttttaagaacccagatgttcttatttctgggtacctccacatgtagacacaaagagggggataagcctcaacgacagagcagtccttatctcaaacattactgctggaactgtggaacccctgctatgagcagggtgc

SEQ ID NO: 600135 - DNA, 119 bp, Homo sapiens
  misc_feature (41)..(41): n is a, c, g, or t
  misc_feature (63)..(63): n is a, c, g, or t
tctagaggaccgcgtatcgtacacagacagctgggaatgcncaggatcaatatctccacagtnctcccacaacacgtgggaagtattggagtacattcagatcagattggtgggataca

SEQ ID NO: 600136 - DNA, 1067 bp, Homo sapiens
  misc_feature (1067)..(1067): n is a, c, g, or t
ggagagagagagagaactagtctcggtttatatttctctatttccataactttaaatgctttatggggattgcaacgctttacaaggttaaaaacaaaacccaaccttggaatttggccgaaaatattagctgtaaaaggagatgttagatgttagatgtcaaacagggccctgcattggtgacccagaaggcgcgacgcgccacagtgtgacttccatgtagttagcggcgtgaggagtgtctccagtgtcgatggcaagagagatgggagacccaaagatgggggccccccatgtgaaagactcttgggggagaccacgggcgaaaagagaaaacaaaagaatggagacaacgcccaacagaacatatggcacagagatgtgtctaagaccacgcgcacgcccgggagcacaagagatgggtcatgtggcgccacatggggagaagagctgagcaacaacctgggtggagaacgcgcaaggggcgctagcgcatcggcagaaaaatttttgcacccccccgggtgagaaaaacaacacccaatccatccgcgggcagaatgtgcccaaacatataataacaccactccgttggtgttctgtgacatcgagcgtgattgtcccttgacaagactagtggtgcacacagagaaaaaatataggggatagataggacatcaaaaaaaagctgatagctgggaagaaatattaaaagaaccaccaaagatgaatacgagtttccacccacaaaacattgttgataatcaacaacatgtatgtgggacacaactatagagcgagaattacattgttgaccccaaattgtgattcctacagaattatatgacaccaacaaatctaccaaaaaggagacgacatgcttaatcgccatctgactaggaggtcacacctaatcatatggaaagcaatatatagaatcagactgaagaaattatggtgacacgtttaagaagaaaaaaaaacaccacccatcagggagatgtacctcaaacagacgacgaagagccacccactcgcataacacaactaaggagagcaccccaaan

SEQ ID NO: 600137 - DNA, 710 bp, Homo sapiens
cggacatcgaggtcaagactgcacatgaggcactgtcaggcgagaccttcagcagcgagcaaggacgttcagtgtgactcgaaagcatgccacgtatgctgagctgtctggccctgtgactggatgcgatgagcctggccgacgactagctcacggaagtgaagtgtcgtggcctgcatgtgatcctgcaggacttcagatgcacacgcaggcgcatagctgctactaggaaacctactatgcaaccgatgatgccacgcccagtcaaatacgaggataggtcaggctgcaatcaaagctcgagcagacaagctgacgtaagagggactgcaagacaccggatcgctaaggcaggcccaatgataggaaactgaaatgcctggtctgaatcaaactggtgtctgaggacaaagtactgaggcgaatgctcaactgccccatatagacccaagttactgcggaggctgagtagtaccatgagacccagtgcctgatggagcatcggactgatacggacctacacagcgtgtacgttcccagtacagatactcgtactcgatggccctgcccgcgcagtatagctcagcgcttgcgatgccgtgtatgcctgaaggcacgcgatgcacgtcgctaaccccagcagtaggtatctccagctcattcaaggctagtaggaaactccgctccaatcccccaagccgatgaatttt

SEQ ID NO: 600138 - DNA, 230 bp, Homo sapiens
cgtggacgacgggctgacggtgctgggagggatagcggggggctgctggccccagctgtgggtacagagaggtcaagcccaggcggactgccccgtgcagactggaggggacgctggtcaagctggaggaggaggcaattgggatggacactaggcataccaaaagcaagtggggacacacgaggaacacacgagcttttccgcacaccaacgcacatgaacacgcaaac

SEQ ID NO: 600139 - DNA, 180 bp, Homo sapiens
gtggatcgctccttagcgttcgttgaagcatctttcctctctggttcgcggcgcccacacacccccacttccatcggtcccgcctctggggtgtttttttaaaaagataaataaacagtagattttaacataagataagtagatatataatattgacataataaaatagaataaaaagaa

SEQ ID NO: 600140 - DNA, 914 bp, Homo sapiens
  misc_feature (42)..(42): n is a, c, g, or t
  misc_feature (67)..(67): n is a, c, g, or t
  misc_feature (130)..(130): n is a, c, g, or t
  misc_feature (327)..(327): n is a, c, g, or t
  misc_feature (340)..(340): n is a, c, g, or t
  misc_feature (432)..(432): n is a, c, g, or t
  misc_feature (538)..(538): n is a, c, g, or t
  misc_feature (587)..(587): n is a, c, g, or t
  misc_feature (597)..(597): n is a, c, g, or t
  misc_feature (648)..(648): n is a, c, g, or t
  misc_feature (714)..(714): n is a, c, g, or t
  misc_feature (716)..(716): n is a, c, g, or t
  misc_feature (765)..(765): n is a, c, g, or t
  misc_feature (794)..(794): n is a, c, g, or t
  misc_feature (826)..(826): n is a, c, g, or t
  misc_feature (832)..(832): n is a, c, g, or t
  misc_feature (835)..(835): n is a, c, g, or t
  misc_feature (880)..(880): n is a, c, g, or t
aggggagagggggcagaagaagagcctccactctcgcctctncctccgggggtctggcgctgcagcngggacaggccagtaagggcccagcttcaggcccagcggggtcacacccgttacaaaggcagtngccgcgacttccctagagactctgcagccccagccgtaaggcgagggctgcagcctcctccggatggatccagggcggctactggtcccagagctgggggctgagtgggcccgtgccgagggctgtggcgtctgaaaagccggctcccactctagaagctcctggcttgaccaggacccaagccctgccctgcgtanccaggccccagcnccacagagcgcacccccttagcaaacttgagggaatagagcgttttgctagttttcttctccacgggggacacctgttccaccatgagggtnttgctgttaccactaagcgaattctgcagcaggaaggtgagcctggagttgcggaagggcacgtggccctggcgggagcgcagggcagccattacgttccccaganccgacagcgacttgttgaagttctgcgccttccgcaggcggctgccctnggcccccganttgcccacgcgctccgagccagcaaagttcaccaggttcagcttccccgtngtgcggaggcctgttctgcagttcacgccttgcaccgtcacgatgagcagcgcgttcgaacgggancngttctcgttcaggttggtgaactcggtcgtgcgaattgtgttggcaaantcaaacaccttgttgaagttgttcacgcnctgcacttggaactcagttagccctgggacanacagcngcncactgccgtttgggcacagccggattttcagttttttcctgaagntctttccctagcagggcccttaggacttaaatgt

SEQ ID NO: 600141 - DNA, 358 bp, Homo sapiens
  misc_feature (164)..(164): n is a, c, g, or t
  misc_feature (184)..(184): n is a, c, g, or t
  misc_feature (194)..(194): n is a, c, g, or t
ttaggttggggattaaaatgccggtaccgtcagtgcccagccctgttccaaacagtgctgcctggaagatttttgggctttcctgaggcgccaccccgcacctgagccacctccttggactcctgtcctttaccccttgaggacctccctcccttttaccctanctgtttttttgaacttgggnctttcctttnccaagacttccatcactagctcctggagggactggactttgcattttccctttgcgtggagcctcagtgtgaaaggccctgccaatgggtgcatgtcaaaggtggtgggggccccatcaaaaaaaaaggggggtgatgaaattaacaaataaaaagtatgggga

SEQ ID NO: 600142 - DNA, 832 bp, Homo sapiens
gccgctccggccggtctcgtgtgctctgccggtcgcaagtggaataagagatcgccgggctggtcatggacaatggctccggcttgtgcaaagcgtgtgtatcgcgtgtgtgatctgcacgcgtccccgatctccgagttctgttccatcgtcggcgcgcctccgagacaccaatgggtcgctcgattgcatggcgcatgtgggccataaatcgatgtcctagcgtgaagctgagcaaatggccgcagagaacataggctgttggctatccatgagccctgtagaagtaccccagttgatgcaatggcagtccgatcaccaaaatgcggtacgacgatttcggacaaagaatctaggcatcgcacgaccttctctagcaactgactacttcgctgttggtctccctggatgtgaagctatctcgcatgattgccttgtctttggatccgatggcaccactccttgagattcccccaagggaccaatgatgacgaagaagtaatgatcttcatagataattgattcggaggaactctttcatatctacccatccggtggacaatgttaacggtagtggcaattcccatgggacctgttgcttgtacccgtcttacgccttctggcgcagcacccatcgtgtccattgtcagttggaactcttgagagtgatcggcgcggttcatcctccatgaaccgtgttgccccatcctagcggtacgggtgctacggctcccttccctctcatagcccgatcccttgcgtctaggatccttaggcttggctcgggggatcctgaccgtgtactatctcatttgaagagagtccctcagtt

SEQ ID NO: 600143 - DNA, 99 bp, Homo sapiens
  misc_feature (93)..(93): n is a, c, g, or t
atgtgggttaaaacattggggcatgaatttattttcaaagtataaaacccatcccttaaacattttatgtgtcaaataaaatttgtttatgtnacccca

SEQ ID NO: 600144 - DNA, 456 bp, Homo sapiens
  misc_feature (329)..(329): n is a, c, g, or t
  misc_feature (341)..(341): n is a, c, g, or t
  misc_feature (351)..(351): n is a, c, g, or t
  misc_feature (367)..(367): n is a, c, g, or t
  misc_feature (380)..(380): n is a, c, g, or t
atgcctctggctcgactctagcagtatcccctccatatgtcacggccaagacgcccaggctctgtgcgctccagctctgcatttcctggttctggcggtcgtggctgggatgaccccctcttggactcgctgctgggactggaactggaactgtccctcggagggccgaggagctcacctcttgatcactcatagcagtctgggcttgtcgactctggtcgcctatgctgtgtgctactgcacgtggtccgggaacggcggcagcgggtccaggctcatactggccctgtagccagcaagccaggccggaatcgcacgaagaggtggcngctctcatggcnacaaagagcnggccggggtggtgtcngagaggacagctnaaaaatttcttttgtgactccgttcactgctcccaccttggccttgccatatgccaggttcccgagctccaattcg

SEQ ID NO: 600145 - DNA, 126 bp, Homo sapiens
tactgtatacggagttcttcgaatgtatggtagggtggggggcatacatatagtcactccaggtttatggagggtactaactactatataggacttatatcgctatcgaagcgaaggcttctacaa

SEQ ID NO: 600146 - DNA, 760 bp, Homo sapiens
gacccgtcatctaagttagtactgaagtcggagcaggaacagaacagagaagactctgacctcggaagaagtctgagccagatgcaggacgctgctcgtgcaattggctattgggcctttgagtgcctcactgtccgagactacaatgacatgatctgtgtgcactctgtgtgtgtggcccccaaagtggaaatggctcagaaggagtgaagagaatgtgctagcactgaagagcgatggagattcacctggccatgaattacctgagactctaaatgaggtaaatagataggaggacttatgaggccacgatggagacagaggtgatatgagcaggtggcattaactgccagcatccccaaatcacccggaaataccgacagcgtctagtagatatagccccctataattacccacacagtacatagaggaggagctagtaggtacgtacacacactagacgaaacgaacaaagaactctaggaaaagtgcaagccaagtaacctaggacagagggcacaaggaggccatacgagaatgaacgagcaatgcacccaagcgcagggggcacccaatgccaacatgacatggaaaaccgaaaaacagaaccacagaagaacagcaacaaagaagacgaccagaatcacaacaacgaaaacaaaccagcaaagacgcgagaacaacagacataggaacgaacacaacacaacacgacgaacaccgaacaaagaaaccaacaaacccaagaacaaccaaaacg

SEQ ID NO: 600147 - DNA, 307 bp, Homo sapiens
  misc_feature (9)..(9): n is a, c, g, or t
  misc_feature (35)..(35): n is a, c, g, or t
  misc_feature (234)..(234): n is a, c, g, or t
  misc_feature (273)..(273): n is a, c, g, or t
  misc_feature (277)..(277): n is a, c, g, or t
  misc_feature (282)..(282): n is a, c, g, or t
  misc_feature (284)..(284): n is a, c, g, or t
  misc_feature (305)..(305): n is a, c, g, or t
aaaataaanaaaatttcacccttggaaaattccancttttacttttttagcaccaaacagacttgataacagcctgatgctgatctgacaatgggttgatagcctcccccactgcccttaaatctgcttagtaacaagtcctttgcttctgtcattcccctgggggatgcctactccctcctttctgtacaatctgggaaaccgactggtgatggaagagtggtgtaatgaagnggctacacagctgagagacaattttagtcgagagctagngatncctgntntccacacatttacccaacatnac

SEQ ID NO: 600148 - DNA, 148 bp, Homo sapiens
ttttgacaggtcaaaaagaacctttattacttttgacgattgccaataaagctttcgtgacatatgcctgtggagcaggtgctttttgggaaggagcaatttggccgctctgtcgtcgtattgcagcagtagagtagtagtagtaggc

SEQ ID NO: 600149 - DNA, 107 bp, Homo sapiens
accagtgtagcatatatgtagccagaaactgatcaaaccccgcacacctgcccaacctgctactcctcttgccactgcctcttcctccctcattccaccttcccatg

SEQ ID NO: 600150 - DNA, 675 bp, Homo sapiens
  misc_feature (488)..(488): n is a, c, g, or t
  misc_feature (624)..(624): n is a, c, g, or t
  misc_feature (670)..(670): n is a, c, g, or t
catggcgcattgctgaccaaaaggctattaatgaccaagagacagtactaaatgagtctgaccagccagggccatagattaataggaatggcattaacaagctcaggatagctgtggcagcggttgaagaaaggaattagcaactctgagccctttgaagaaactcttacacagatgcacatatacatatcgggaaagacagtgattattacagaatccagactccctctctggcctcatagatgactattcacccgtactttacgtcctagctaccatcccaaagttgtgatgctgcacaaatcctctgtgcctgacacatgccttatcaccactgacttcattcactacgcaactactcacttactcaaaactctgcccaaggctgggctccgtggctcgtgcctgtaataccagcattttgtaaggctgaagcatgcagattacttgaggccaggaatctgagatcagcctggccaacatagganaaccccgtctctaatagagatgcataacattagcttggccctggtggtgcatgcctgtaatcccagctactctggtggctgaagcatgaaaatcgcttgaacaaggtaggctatagttgcatgaagccgagatcgngcactggactgcagcacgtgtgacacagtgagaccttgttcagaanaaatg

SEQ ID NO: 600151 - DNA, 357 bp, Homo sapiens
tacccaactgagagctgcgtatagctgtctcatatcttgggcatggcggaggagacatgttggaccctctcatctcgaggtgttccaggacggtcaggttcttcagcgaaagaccagaacacggaagtagggctgctctcctcagatcccctagaccgacgtggctcgctgagaggccccgccccagcctctgcactcctggagggcaggccagccagcgaactccgacgcgaacgccccatttcctcctgcagcttccagcagaggcccgagaggtccccgcggccccttcagctgaggtccctcagccgcttgcagtgcttcaacatgtctgagagctgcagctcgccctgagtt

SEQ ID NO: 600152 - DNA, 311 bp, Homo sapiens
atctcccgattgcagtgtcacgcatctccctgaatatagggtctccttaaacacatctgagcactgacctggatgagtgcaccttggaaaccctggtgaacaggcaccaaaaaggcattgatcagggcctaggcctcaatacaggggagaaactcatgggattatttaacaaattacttttttttggaatttcaagatttcccgtttattgacttggaaagaagcaaccacccgtgtttggagaacctggaaggacagaacaggggtttctgggtgcccagaaagctctttcttccaattcctttacaagg

SEQ ID NO: 600153 - DNA, 136 bp, Homo sapiens
agcaagaccctgtctttaaaaaaaaaaatagggcatggtggcgcatgccatggtgctagctacccaggaggctgaggtaggaggattgcttgaacccaggaggttgaggctgcaatggtgctatcatagctcactg

SEQ ID NO: 600154 - DNA, 158 bp, Homo sapiens
  misc_feature (38)..(38): n is a, c, g, or t
tcaaaacacttctatacacctggctccgggcctgcggntgagtcctataacaacgcataatgttctgtaatgacttaccttcttttgtgacctttgccatcacataaatggcacacattaacaactggtccagatgtcatgcccatcataatttcagg

SEQ ID NO: 600155 - DNA, 833 bp, Homo sapiens
ggttctgaggggacatgttgaccctggaggtagccataggcccccgagatgatgcactgtctggaaaagatctggcactgggtctccattgcgcatgtctcatgtgcacactcccgtgctgttgccctgaccagattcatcgtgcctcgttgagcagagtacgctcatgctactgcagatgtgtgaagagaggcctttgtagggcccagatggagaggccctgggacctggtgggtgcgcagtgctccttgttactgagtgagcatgaggctgcctcctcctcttctactctagttgaagtcaccctgggggaggtgcctgctgcccgagtcaccatgatcctccccagagtcctcagggatgcctccagaactccccactaccatgaactaccctctctggagccaatcctatgaggactccagcagatcgcaatgaacgaggatggggccaagcaccttccctgacctggagtccgagttccaagcagcactcagtaggaacggtggccgagttggttcattttctgctcctcaagtatcgagccaggagccggtcacaaaggcagaaattgctggggagtgtcgtcggaaattggcagtatttctttcctgtgatcttcagacaaagcttccagttccttgcagctggtctttgggcatcgagctgatggaagtggaacccgatcggccacttgtacatctttgcacctgacttgggctctcctacgaatggctgctgggtgacaatcagatcatgcccaagtgaagcctcctgataatcgtcctggcattatcgcagagaggccgactgtgcccctgaggagaaatctg

SEQ ID NO: 600156 - DNA, 1100 bp, Homo sapiens
  misc_feature (208)..(208): n is a, c, g, or t
agcggaatccatgaagaagtcgattgtcagcatagaagtgggaggctaggtttcattcctctgccactatgaagtatccagcttttcccatgtatcatcaatacttgaagatactgtaccttcccgccacaggtgatctctctgggactctatgacctataggtcgccatggttgggagatcctgcgtagggtagaagctcgcacagnaagtgtgcggtctcggcaccatccttgagactgtttccccgagcttttctcagtctcactagctccacaaacgagacatccagacaccagctatatgggcatctggccagtttctgctccaggtactatcacgtgagcgagagctgctactattttaccttggtgccatttcgttcaacatgttgtttgaaagtacattaacagcgctcttagcacattcaccttattcagcttgggctcgatctagctgatcccacggtttctgctctttccttacgtgaagagttgactgatgcgccgcttcacgctatgctacgggtctactcactggtgacgtgtcactagttccggtatttctcgtggactgggttgcctttgtacgatcttgctgacctgggagctgctctctctgctctgtttgttgtgtcttgcagccttcgagtgaagatgactcaagcaccacttgagagacatgttgccccgatccaaggcggtcttgggccctcactggaacgatcatcgcggggcaaaggttctatccccgtttcaactcagatggcccaacgtcgagcttgatcgaagcctacatgtccaacagcgagtcaaaattgacgaactgtggaataatggccagggtccggtgtttgaaagaattactagacacgacagggccacctttgcaccttttcctcatgtcgtgaaagttagggtcaaggagtgttaaaggtgaagcggccgaatcaacgaagttgcagaaagacctgggggcatatcaggaagaccatgtgcttttaaatatagcatgaaacagaggaccggtttggcctaccatccggagaattctgccgacccccaggaattgccgaattgtttcagaaaagttctgcccccg

SEQ ID NO: 600157 - DNA, 425 bp, Homo sapiens
aaaagaaaaggttgtgggagactgaccagggtaagatcccacctggtccaaaagctttcgggccttactttttttattataaaaattctcacgtcgggtaatcttctatgtcagagctagtgttttcaaaaggtttcacattcccccaagacaaaagtgatttccgtccattataatagggtcacgtgatatgtgatccatagcaattttggatgtgaagaagggaaggcacatcatggacttcataatagtatcagtcggtgcaacagtgggcaacatgtgccttcacactttcaccataaagagacgggttggagggttggccttctaaagtctgcaactccaagaaaaaaaatcgaccctgtggatggccttccccggtcactatataaagcaattaaacttaagacacttggcatccagag

SEQ ID NO: 600158 - DNA, 951 bp, Homo sapiens
aagactagtcgtccgacggtcactgattcatcaccagacaggaggctgcccttcctgtcctagcatgccgcaagtgaaacatcagaggatggaacctagagagatcacctgcgcaatagtagtctaatcaagcagaggctccaagggagtggcagagtccgaactcttgctcagtttcgcagctgtcatcgaagattattaaggcgacggccaaccatgccgcaacacgcaagtagtggccatccccaacaatgctaatattcacagcatcatcacagcacgtgagtgccaagggcaaaagagagtggcagtagtgggcccaacaaattcatcctcatcagctgtgggggagccccaatcagcctccaggactccggcctcaaacccaaacagctatgatgccaaaaggacagaagtgaccctggagaccttgggagcaaaacctgcagctagggatgtgaatcttcctagaccacctggagccctttgcgagcagaaacgggagacctgtgcagactggtgaggcagcaggtgcatatcaacaatagctatccaaacatccagtggttcgaaagatgagttctgatggactgggctcccgagattcagcaagagatggaggccacggagaattgtcacctggagcagcgcacaggttaaggttgaggagcctcgagaccatcaggtctggcaaactctgtgtctgaccggcaccttatcttacatggcagtatacagtcggcatcaaagcctggaggacgcataactgagccctataggggttgggcgcacttcctatttgcatgcaccggggaaatcatggagactttcgtgtatttttcgggacgttgcaggaggccttggctacccgccgttatgccgtcacggacgcaaacccggtaaaacaaggccggataaacccggggaacacacaaatccgaggccctcaaa

SEQ ID NO: 600159 - DNA, 989 bp, Homo sapiens
aaggtcatgtagcccattctgtagatcctacagcagaaattctgcagctcaccctcccccctcgatgtgctgattattgaccagctgggctgcctggtgatcatcggagatcaatacatctatcaggaagtgtggaaactcttccagtcgggatcagtgtgacgcgccagctccgtatgtattactcagaccaccaaagattgacgaggaccacggctatagagcattgctccctgttagtgataaatgccctggtccaacatcgcggcacaatatccaagacgagtcacctggtgtcatgagctgctcatgaacctgttggagttgtttgtgcagctggggctggaggggacgcgagccagcgcgagggcaagcgaaagggccctgctctaaaggcttctagacagtgcagtgtcacttggcagtactcattcctgtacatagctgtgctcacccgacgactgtcatccatcaaagaagctttagcctcggtaacaggaagctctttcgagacttctggctgtattccgtctgattgggattcgctgtgacagggctcaggagtctggacagacaatggtacgagggccgtcaggaaatagggcctaagtccccttgtgcacctatcccacctaaggtggaccagctgtgggccgacctcccagtattaacctcagcccatgacagaatgtcactgtggagcccccgagtcagctgcggtaaccccagcatacgtataatcaagctggggggaccccgctccgaaggagtcggagtcaccaacaaggagttgcaagtacaccagacacgcctgtgagtcagcacggagccaggggacggtaccacacgcaggcagacaaggcagggacacagaccacaaaaagcgaagcggggtagcacgcgagaaaacaccgcgaagtgagaaccaacaagagggagcactgtgggcacacagggggagtctcataggacgacgacggacgcgaggc

SEQ ID NO: 600160 - DNA, 351 bp, Homo sapiens
  misc_feature (14)..(14): n is a, c, g, or t
  misc_feature (26)..(26): n is a, c, g, or t
  misc_feature (129)..(129): n is a, c, g, or t
  misc_feature (162)..(162): n is a, c, g, or t
  misc_feature (187)..(187): n is a, c, g, or t
  misc_feature (247)..(247): n is a, c, g, or t
  misc_feature (296)..(297): n is a, c, g, or t
ggggggggggggangggggggagggngggggggggggggggggggggaggggggggggggggagggagagggagggggggggggggggggagggggggggggggaggggggggggggggggggaggggnggaggggggggggggggggggggaggggggggngggggggggggggggggaggggggngggggggggggggggggggggggagggggggggggggggagggggggggggggggggggnggggaggggggggggggggggggggaagggggggggggggggggggggnngggaacccccccttttttctttccccggggcccctaaattccctccgggcttta

SEQ ID NO: 600161 - DNA, 433 bp, Homo sapiens
cttcgacggtgtctgtattagttaattttttttttttaagagatagtgtctggtcctggtggtccaggcgggagtgcaggcgcaagatcatacttcccggcagtcggaaactccggacttcaaaggatcctcccatcttagcctcctcggtagcggggactacaggcgcacactactacacccaattattggtttatttacttattttggagatggattctggctcggtcgccaggctagaaggcaggggagcgatctcagctcacggcaacctccgcctcccgggttcaagcacttctccggcctcagcctcccgcgtagctgggactacgggcacccaccaccaggcccagctaattttggtatttttggttttagtagagacagggtctcacccggtgggcaaagcgggtctccaactccggacctcagg

SEQ ID NO: 600162 - DNA, 373 bp, Homo sapiens
tctgtacgtctacaggtggagtgggtcacttgaacccaggagtttgacatcaactgggcaacatggtgacctcccgtctctactacggaaaaaaaaaagaaaaaagaaaaagccgggtgaggtggtgtgtacctgtagtcacaggtacttgggaggctgcggtgggaggatcaccttgagcccaggagatagaggctgcagtgagctgtgatcgtaccacatgcactccagcctgggcgaaaacatgagaccctgtctcaacagaaagccctctcattagactgagcagaggaagggaaggagtgtggatatacagaatcatgcatttatgccattttctgtattacaaatctagcaagatcctctaacagtc

SEQ ID NO: 600163 - DNA, 157 bp, Homo sapiens
ggcacgaggctacgatccatcccacgacacgcttaaaaagattaaagccggttatcactcacctgctacagcatggccttttaaagcctataaactctccttacaattcccccattttacctgtcctaaaaccagacaagccttaagagttagttca

SEQ ID NO: 600164 - DNA, 150 bp, Homo sapiens
atcactgctcccaatacaagcaatggtctgaagcctctgttgtggctctcactattcatctttccctaagtcatcaagctccacatcactgaggtcaatgttatcctccacgggaagctcgccatccctgccgtcccaatgctctctctc

SEQ ID NO: 600165 - DNA, 356 bp, Homo sapiens
  misc_feature (222)..(222): n is a, c, g, or t
  misc_feature (225)..(225): n is a, c, g, or t
atgatgtgtggcttagatgcttgtcctgtctggctcatttctggccgcttgttggtctctgtgcaggatgaaggcatctggcgacccaacgcttcctgtggactctgatgaggaaagggtccttgtgctcagtctcctgctcctggtcaccagcttgccctgtctgtttcatgctcaatgtgtgttaaattgaactgaaagagaaatacccggcaccagcgncanccaaacatcatgcagaacacattctaagaggtgaccttttccttccctccccttcaggaaaattccccggtgggcaggagcacttgggaatttgccttgtggccccctttggtcccttgaccaaagcttca

SEQ ID NO: 600166 - DNA, 205 bp, Homo sapiens
gatcaatttgtatattctaaaatatgtaaagctttttgtatgtcataatatctcagtaagtaattaaaaattaaaaatttggcacttctattgtttaaaaaaggaaattaattttctattttatggcaatttggttattatttttaaaaaattcctggtgtttaaaatatgtgtagataccctttgtgtgcgtctatcgtgtgta

SEQ ID NO: 600167 - DNA, 855 bp, Homo sapiens
  misc_feature (799)..(799): n is a, c, g, or t
  misc_feature (801)..(801): n is a, c, g, or t
ccatcactatcccagtcaactcggtggcacctgacaacgactggtctgatttccatcactatggatgcaattttttgtttctggagtgtcacacaaagggaagaatacagtgtgtatgcagagttcggaggctgttaccatgacatagcacagagggcatcttttctcatcagctgaacctagaactccgtgagcccttccatgcctactctgcaggcgtcccccaactcaggggagagttccgatatgtaatgactgcccttcctccatctgtgattttccgcgctcctgtaacttgttactctcagatcagatctcctgggcccgacccccaagcctcctgcattccgtcggcgtcggcctctttcccgctctgctgtgtctgcctagctgtttctcacccttttccttcctcgggtcagcgtctgcatcaagagtgagtcttcaatcgtctgccggatgttttcatgatgcgggccaattttgaagctcctggacttcgttcgcgccctggaattgggatcttctcacgtgccctgtgggttttgatctcaggtgttcgtgggcctcctcccacgctccgtttcgctggccacgtgggtggacggctccctctgaccttcctcacctgacaatacccaggcgctccctccacccccttctatgcccacccggccagatggaacgttctttttttcccacctttgtcagcaatttggggcacaggtctattgctgcaatgtccttaatgcccaacaggttaaagacaacaataacaactaagggatccgccccaccngnttaaaggttctcagcccctccgaggccctaaggaactctccttgccctctccct

SEQ ID NO: 600168 - DNA, 119 bp, Homo sapiens
aaggaccctgtggaatcctcctgctgctgtcctaccccttgtctttcccttacagcacctctcagctaccaggtggctctgtgtgtgcctgtaccacccccaccacccagctcaatgga

SEQ ID NO: 600169 - DNA, 141 bp, Homo sapiens
aggcaattttctcgttgtctgtttagggggaactacagcgcttgtataagtggcgcaccctcgagaacaggaactctgtatcgtatacctgtaatgttaccgttctgtatttacacttcctgactaaggtcttgagctggt

SEQ ID NO: 600170 - DNA, 189 bp, Homo sapiens
  misc_feature (117)..(117): n is a, c, g, or t
  misc_feature (162)..(162): n is a, c, g, or t
  misc_feature (188)..(188): n is a, c, g, or t
ctcgcgctggcctccacggcgagtaacgccgcgcgcccccccggcccctattggcggtgagctgtctgttggctggcgttggtctctttccccggtccttgcttttcacttcctggncgcccaggcccaggccatcccattcggtagagtggagaggccttngaaaccatggtctggtcctgggagcnc

SEQ ID NO: 600171 - DNA, 405 bp, Homo sapiens
attcaagctcaaccagcaactgacgtctgtggcatgggcattcggtgcacccagcattgcagcggcggctggaacgatcgacaaccctgggtgaccttgagccgtaccgtgtcgagtgtgcttgaaatcgactcgccttcggccaccctcagcgccgggcgcaacatggtgattactgggcagaacttcaccaatcgctacagcgtggtgtcggccgccaatgacctatcgattactggcgaaaacatcctcaaccaggcagctaccggtggttccggttcccagagccaggaatacggtggcacttacaaaatctccaaaggccagtacaaccagatggttgccgcggtgcaggcctataaccgtgcgcacccgcagggctcgccggtggatgagggtcgacgc

SEQ ID NO: 600172 - DNA, 485 bp, Homo sapiens
ggcaaatgaacttgtaaacctaactgagttactatgtgaatcacatcctccctgattgaacaatcagctaactgtgaatgaatttcctgtccttaaagctgacggtatcagaatatattagtgatttttagaaatcaagtgccaaaagaacatcttttagtctcgattcctctcttgattaatcatcttcaagctgaaggtactgttgttcatacttacgcagctcatgctcttgaagcggctctttactatgcgagggcctaacaattgccactctctttacacgcgtgccagaaactcggcaccgatatgtgttgacgattgctgactaaacaaagccgttttcaaagtctctgcacacttcctggactctgtcacgaaaattgaactatattgatgacaagctatcagtgagaagttatactctcctacaagaagccataatcccctacatccctactctcatcactcagcttacacagaag

SEQ ID NO: 600173 - DNA, 646 bp, Homo sapiens
  misc_feature (572)..(572): n is a, c, g, or t
  misc_feature (646)..(646): n is a, c, g, or t
tggggtggagcacggggtacttaatggagggtacatgaacaagggggggttccctaggcccctcccctcttacagggggtctacagggaaatcggggaggaggggaaatccatgtggtgggtgggggagactggagtggtgggcaggggactccccagacagtgagagggtctctactactaccctctggtggctgctggctgggggctgggtgggtccagggggtctaacctcctgggagcgccaggtggggccatagaggtccaccacccggttgctggtaggccaaatccgtggtcataccgaggaaaagtgagctggacaaagtgggctcgttggaagggcaagtgccagccccaagggctcaagagggtgggaggagtgggggtgctcgcgtgtggaagctcgagagggagacccaccggggtgcctcaggtgtagccacaggagtgccctggaggggggccctcgcgaaggccggtttacaccacctttctggatggtcactcaatatgggcgcagggtttctcataaacgggcaggtcagggtccaccagtggacactgtgggcngtgggggacccgggaagggcacatgccaggagagctacccggtaacacgcctcaggggattagacctggcgccn

SEQ ID NO: 600174 - DNA, 264 bp, Homo sapiens
tgcatggcggatgacgtgtgctcataattggtggctcggacaagatcacgtatgactccgacagatatcagacacacacatctttgtgcaggctggtgagatgtacattgagtctgtggtgatacttcagcgattgtatattagacaacaagaaacgggcagccatgattatttgtacccgacaggcaactgggagctgaagggagaggcacggtctcttttgatggaccaccttcaggtaaagcgtctacgaatggttggtgg

SEQ ID NO: 600175 - DNA, 174 bp, Homo sapiens
  misc_feature (37)..(37): n is a, c, g, or t
  misc_feature (69)..(69): n is a, c, g, or t
  misc_feature (90)..(90): n is a, c, g, or t
  misc_feature (126)..(126): n is a, c, g, or t
ctggagtggaaccagaagggaagagagaagataagcnagaagcaaggacaaattaaaccatggcatttnagcctccttattcctccagcntcttcagaaaaagggacaatgcctccggagccagcntggtggccatagacaacaagatcgaacaggccatggatctggtgaaga

SEQ ID NO: 600176 - DNA, 279 bp, Homo sapiens
  misc_feature (245)..(245): n is a, c, g, or t
tgaaggtgctccagacacacaggcccacccagcaggaaacactgttccataatatttcataacaagataaaagatactcagaagatgacggaagctgtgaaagaacagcataaatcagaaatagaaaagcccaggccaggctcagcggctcacaactgtaatcccacctacttgggaggctgaggcatgagaatcacctgaacctgggtggtggaggttgcagtgagccaagaccgtgccactgnactccagcctgggcgatagagcaagactcagtct

SEQ ID NO: 600177 - DNA, 1480 bp, Homo sapiens
ggaatgagagtggaggctgcggcctggtgctatgggcagaggctggctgggtctgcttcttccctgtcactgccgcagcagcttgtgggtgcaatggcggcctggtggctggcggaagtgggctgcccccacgagttcctgtcttgcaggacagctggctggcttgcccgcaggcacagtcctactgcagcagcctgtggtccctgcactgccccatggggtcctggtgtgcttgagtgctgcctgcctgggcctgactcacaccgaggacctgaggggcacacgacatcacgaaccacagacgcgaggccgtcttcacacctggtggaccgacggccagacgtgccagatcaggggccccattcccgtcgtaaggcaaggcacatagtgaaaaaagtggtagattgcagtgtgcattggagcacctggcccatcgcgcaagtcacattcgacttgccctagcgcggacagaagcatcgtcaacttcatgggaccatctttgctcgcgcgcaatcgtctggcatcgtcgcttgccccccctggggaacagcacccaggaggaacgtcacccagtccactggcacatcatcggagacccgaaacagcagttggcgcgctgtacatggaccgcccaaccacacggaattacggggactttagaggtaacgatccggatccaggggcgactcgcactctttgggaccagcacaacagacgcggcgggtcttcaagtattggcccacaggtagcgacgtcattccatttggcaagtttccccaaacggggctgacaacaacaccttgcgttcacaagtctagggggaggaatcgcccgccggcggttcgaaaccaattacagaacattcataatgggccgcaaagtcttatgtacacaatcaacggaacacactgtagggtccgcgttttaccaggcatctagcagctgcggcacggaaggaacactgaatcgagacaacttcagacgagggccaatgcaccttggacccggcgttgaagcgatgtgcgctccacagcaagtggttcatcgactggccatgtatcagaacgggctagccaaaccttgtgagcaggtctagctacgccagtctcaagcttgacgacaagcccttgtggcacgctgcaacgcacattgttggtgccaacccgccttcgatgacacaggcaacacacagcggtgggataaccagacaacagaacgacagtgggcactaaccgcaagaatacaacacacaagcggcagaaagtacacgccggacaccacgacaaccaaggaaggccccacgagccccccggcgcacacactaacgagcagtcggcacgacggcgggcgcaaggacccccgaaaggaaccaccacaccgccagaccaacgacgggccgaacgacaaacccacaccagcaccgacggcacaacagccaagccccacaaccgcgcaccatcaccacaacacaggccaagga

SEQ ID NO: 600178 - DNA, 333 bp, Homo sapiens
tcggtacccgggtgctgctagaggctgacgggaggcagaggctgggcctggaggggtcatcaagatcaggagctgggcctggagaggctgcataagaagcatgagtctgtgcctggctgaggtcgactctgagaaagttcagggcctgcagagaaggctgtgaggcaggagctgggtcttaagaggccattgtagcgatggagctgtgcctgtggaggctgttgtggggcagtaggctcatctgcggagactgccatgacgtagggtatgggcctaaataggccattgtgagtcatgagcttggtctgtagaggctgactggagaaagttctg

SEQ ID NO: 600179 - DNA, 658 bp, Homo sapiens
  misc_feature (585)..(585): n is a, c, g, or t
aattaccacttcaaacaaaattacatttagccttgtttactttaaattgtttgactcctggtacggatggcaagaccccagcagaacgacactggcaactgctagaggaaaagaggcaagtttatccaaaagtgttatggaaatccccagaagaaggacaatggaaaggtccggtggatttgctgacgtggggacgagggtatgcttgagtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacatgaagctgagaaactactggagcgccagggtcaggcaacccctgactccatgttcttggccatgctagctgtagtgtcctgtgcggtatgtttcccctgtgtagaggcacatattgggcatatgttcctaatccacttgtagtacgactggtactcntgagcgacactttctctgagatatcatatgatcatggagcgtgggcaccaggatccctcttcgtctgacacgg

SEQ ID NO: 600180 - DNA, 491 bp, Homo sapiens
caggcccctagcaaactctttataccaaacgtctgatgaacagttattgaactagagtcttgagtttcacagacttttccaggcagagtggtgtgatctcccctaagtggatagatgcctttaatacttgtcatcttttctgttgtactacaaacacaaaccaaaccaaacatcaacaacaacaacaaaaccacttaagaatatttaactttctgttcttccgatggcagtttagcaagcgcctaagaggagaagagagggggaaatcccagcaggctaattaatattcacagaaagcctgttggttttggtcacagatctttgtctgtacccgtctggactgtcggactgggttattggggaattgagatttcctgcctttcagtctagggcctcttggaggtggtgactgctgcggatgaaaaaaatcagactgtcagcaagaatgctgtttattatggtgttgaaatcacaaaacctcgggtttgctc

SEQ ID NO: 600181 - DNA, 298 bp, Homo sapiens
cccagcagtagcgtccatcctaggacgtctaactatgtcactccccaactaccatgtcatattagaatcctagaatgctgttgttttagtctattcttatactgctataaagaaatacctgaaactaagtaattaataaacgaaaagaggttgaattggctcatggttctgcaggctgtacaggaagcatagcagcttctgtttggcttctgaggaggcctcatagagcattcaatcatggcaaaaggcacagggggaacaagcacctcacatgaccaaagcaggaggttattggcat

SEQ ID NO: 600182 - DNA, 629 bp, Homo sapiens
  misc_feature (35)..(35): n is a, c, g, or t
  misc_feature (105)..(105): n is a, c, g, or t
  misc_feature (179)..(179): n is a, c, g, or t
  misc_feature (234)..(234): n is a, c, g, or t
  misc_feature (245)..(245): n is a, c, g, or t
  misc_feature (253)..(253): n is a, c, g, or t
  misc_feature (318)..(318): n is a, c, g, or t
  misc_feature (380)..(380): n is a, c, g, or t
  misc_feature (393)..(393): n is a, c, g, or t
  misc_feature (514)..(514): n is a, c, g, or t
  misc_feature (537)..(537): n is a, c, g, or t
  misc_feature (545)..(545): n is a, c, g, or t
  misc_feature (575)..(575): n is a, c, g, or t
acatttctacagctagcaggcataacaaaagactnaaaaggactcacactacatccaaggcgcaatgctttattgcgcgccgcatcccaattacaccacaagccnaaacgcacttccagccgctttcctgctctttgctactttcttcatttccacctttgccccaagctcatctgccnttttcatggcaccaccagctgatgccggcccaatgcatgccaatggctctcctgnagcagtgcagnatcacagnaatcttcaatagcacacatcgcgcccacaccatctttgctcagccagctcacattgccccaagtntccaacatgcctctcttcatcctttggcccaccgtgttttctggatagaggattaaagtaangacctgcactggnacagcctgctgtattatctccaaactcatgaacatggaatccatgcaggccttcagtcagtcctttaatgcttccccacaccttcactgcgtccattactttccttctgctcgaaattaangatgccctgcactgggccgctcncccttcancacgcacacggccttcgctcgccataactngctaggacacgccgcaggtcctggatccgcaggactgcaacgaaaaccccacaa

SEQ ID NO: 600183 - DNA, 934 bp, Homo sapiens
gttgttccgcaacattcctcacactagacgagaggtgtgtatgaaacccaactaccgacacaatagtacaccacacacgtggggggggggagaatactccagagacactactgttttgtaaattaggattagtagtggcgatacactatagtatagatggtgtggtaatacaggatgtacaatcttgtccggcagatagtaatataaagactacagttctacactagatctccacgagttttactaaacggcccactagtgtgttgtttcaacttgggctaaatatcttctgtgtgagataatagattattaaatagaggttctctgatgattttacacacaatgggccgcccaacagtgggacacactctcatatctctgtggtgcgcaagacgattgtcgccccgtgtagcacagggagcgcgcgctctccctctgtatatgtggcgcaaatgtgcacactgtgaaatagaggatccccgcaggggatattaccacacagatagagcgcatgaactattaataatatacattttgtgaacgaaatcttctgtataatttgtgtcacacagagtgtaagatgtgcttgtggttacacatctccgggccatacacgggggggtacacttctacatctcagggtctattttttctggagagtgtggaggaaaataattttaccctcttaggacacgccttctgagagactctttgacatggagtaattgcattttcattttatgtggaaagagaatggggatcctctatgttgtggattaactacctcttccccataagagagaaacattcagagaggtttttcatttgctgtaataagaaattgtgaaaccaggaaaagttatagggataaaaaaattatttttttaaatttgcaaaaattttttttatccagtagaaaattaatcccttgtta

SEQ ID NO: 600184 - DNA, 517 bp, Homo sapiens
  misc_feature (3)..(3): n is a, c, g, or t
ctnacactcaaatatgcatgtcattttaaaaaaaaaaaaacctataccacacacacacatataaacacaaacaccagcatccttctccatatcttaatacttaacatgtacagaagctcaattacttgtcaacacagtaaatcccaaaggggcaattggtaactatatttatccaaaagtccaaaatggcaacggggagggatgggagtaaagctaacagtctcaggattcatttctaccaaataggagttattcaattcttcagaactttaaaaggtcccaaatcctcctttctataacacggtagcaaactatttttctcaaaaataggtgagtcacatcctatacggaaccggttcgggcagataccatcccttgatacacttggaaagacctacagaaatgtctgggaacctacagtattccaattatgccaccacccctctacactctgaggtcgtatacggcttgaaaggaccatgaacctacagccccactcagggttccccaaaagtgt

SEQ ID NO: 600185 - DNA, 929 bp, Homo sapiens
  misc_feature (2)..(2): n is a, c, g, or t
cngtagaggatgcagaagggggccggccacccgtatttgaccctttacggcctttggttgtcaaaactggcctcacaggcgttgcaatttatgttgcgctcttaattttcgcgctaccgaatattttggccccgcctctcggaggcgctctatgtcccaaaggctatgttacgggacccaacggacttgttgttccacgagcgctcgctcacaggctgtgtttgcccacaccgcggtttgtctctttgtgctccccctccctcaggacgcctcgtctggacacccaggaagggccttcataggtgccgagcagaccacagcggtctctatacgcctaggttcggaccgaagcacatatcccttggtcttggcgggctacctccaagtggcattcttccggtagcaacccatcgctttgggatcaaatacccaattcatctccgcggtctgggagcagcccatcatacgccaagagtccgctccttggcgccataaagcgatgtgtgtccattcttccccgggtcgccaaacaagcgcagtagagaccccccgttgggggacccttttctcgagagatgccagttccaggaggcgcactctgccccaagagcacacagcgttggagaacgccgtgcacaagtgcatacagacagggcacctgcccggtggccgccacaaacacttgggcaccccgacttgctcacccatcaatatgcctcaggctattgtaacgcagcgtcgattcctcgcggacacacggtgcggccggctctttatatatgaactcaaccgaggataggtggaaatttatatggagtgtctggccagggcaggttaactaatcaactcccgttcaaattttctgggaaacaggtcaaaaaacctccaagaggggggaaaaaaaatattttggaaaaacaccaacatac

SEQ ID NO: 600186 - DNA, 960 bp, Homo sapiens
  misc_feature (57)..(57): n is a, c, g, or t
  misc_feature (65)..(66): n is a, c, g, or t
  misc_feature (68)..(68): n is a, c, g, or t
  misc_feature (87)..(87): n is a, c, g, or t
  misc_feature (95)..(95): n is a, c, g, or t
  misc_feature (108)..(108): n is a, c, g, or t
  misc_feature (123)..(123): n is a, c, g, or t
  misc_feature (143)..(144): n is a, c, g, or t
  misc_feature (150)..(150): n is a, c, g, or t
  misc_feature (159)..(159): n is a, c, g, or t
  misc_feature (165)..(165): n is a, c, g, or t
  misc_feature (176)..(176): n is a, c, g, or t
  misc_feature (198)..(198): n is a, c, g, or t
  misc_feature (201)..(201): n is a, c, g, or t
  misc_feature (241)..(241): n is a, c, g, or t
  misc_feature (251)..(251): n is a, c, g, or t
  misc_feature (312)..(312): n is a, c, g, or t
  misc_feature (316)..(316): n is a, c, g, or t
  misc_feature (320)..(320): n is a, c, g, or t
  misc_feature (344)..(344): n is a, c, g, or t
  misc_feature (352)..(352): n is a, c, g, or t
  misc_feature (364)..(364): n is a, c, g, or t
  misc_feature (368)..(368): n is a, c, g, or t
  misc_feature (374)..(374): n is a, c, g, or t
  misc_feature (378)..(378): n is a, c, g, or t
  misc_feature (391)..(391): n is a, c, g, or t
  misc_feature (395)..(395): n is a, c, g, or t
  misc_feature (416)..(416): n is a, c, g, or t
  misc_feature (430)..(430): n is a, c, g, or t
  misc_feature (432)..(432): n is a, c, g, or t
  misc_feature (450)..(450): n is a, c, g, or t
  misc_feature (454)..(454): n is a, c, g, or t
  misc_feature (472)..(472): n is a, c, g, or t
  misc_feature (522)..(522): n is a, c, g, or t
  misc_feature (527)..(527): n is a, c, g, or t
  misc_feature (536)..(536): n is a, c, g, or t
  misc_feature (678)..(678): n is a, c, g, or t
attttttttttattgttttaataagttgatgtggtaaggaaaggcgtggtgctggancaccatgnngntggacactcagggcctcanccacactnaacctaggggtcntccaaatcggtttcngcggcaaagaggtaatcaanngctgcntattcacantacgtnaaataaggaanccctcggatgagcatgctgaanccnggaatcaactggtcaaaatgatgcaggaactccaagcagncataatgaanagcttataattctgcgataggccgtgaagaaaaagaacaagatgtcccgaagacagcgcantgtncgcntctgctggtcggtcattgggggtncccctganctccgaactgtnagcnaatgtntgtncaacatcacagtnagcnctatgaacaaatccacattanaatggaagttggananaataactgggggcaaggngctntgcacaccaagcttaganaggagcaaaaaaaactcttgttccagctggagcaattgtgtatccaaggncactntgtaaggcngtgatgtgatgtaaatgtacagcagcagcaggaggaagcatgagtgggaacagagctgaggtgccagctggtcgtggtccgccagcagggagaggagctcaacaacaagaagaacgctaggaaggggtgtatctgggctgangcactttggcagcacttggaacacacactggaacctgggcaagaaatcacaggaagtgttttcggctaatttcaccaaaaccttaaggcactggggtcaggacactggcttgaaggtgacctgttgctgcagaagagaaagccaacaggtgaagaagcatcttcaacagtgggtgctgtccttggtcatcagcaaccccccttagggctgaggtcatatctccatcactaagcctgtgaaccaggctcctgtttccttccccagcagcagaatctgccccca

SEQ ID NO: 600187 - DNA, 180 bp, Homo sapiens
tcaacgctattatacttctggaatcgaatggcagggaatcgaacggacgggaatcgaacggaatggactcgacgggaccaagactgcacactggacacaggtctcgaactggaatggaacattaatagtgaactggaactgtgaactcgaactgaaactggagtctaacaggaactggaa

SEQ ID NO: 600188 - DNA, 937 bp, Homo sapiens
  misc_feature (6)..(6): n is a, c, g, or t
  misc_feature (453)..(453): n is a, c, g, or t
  misc_feature (502)..(502): n is a, c, g, or t
  misc_feature (509)..(509): n is a, c, g, or t
  misc_feature (532)..(532): n is a, c, g, or t
  misc_feature (538)..(538): n is a, c, g, or t
  misc_feature (551)..(551): n is a, c, g, or t
  misc_feature (555)..(555): n is a, c, g, or t
  misc_feature (569)..(569): n is a, c, g, or t
  misc_feature (575)..(575): n is a, c, g, or t
  misc_feature (592)..(592): n is a, c, g, or t
  misc_feature (640)..(640): n is a, c, g, or t
  misc_feature (664)..(664): n is a, c, g, or t
  misc_feature (718)..(718): n is a, c, g, or t
  misc_feature (725)..(725): n is a, c, g, or t
  misc_feature (756)..(756): n is a, c, g, or t
  misc_feature (794)..(794): n is a, c, g, or t
  misc_feature (806)..(806): n is a, c, g, or t
  misc_feature (815)..(815): n is a, c, g, or t
  misc_feature (831)..(831): n is a, c, g, or t
  misc_feature (839)..(839): n is a, c, g, or t
  misc_feature (883)..(883): n is a, c, g, or t
gcagtnacgtcgttatgacacacactgaaagtcgcataactgtggcctcgagggccactcacttgtttggacttagttatggtcacagtttcacgacaaagcaacagaaaccacaaacaggcacacgcatgttagccagcccgttggaagctgtcgcagaccccggccggtggcctgggcctgaccacgcgcctgtctggtgcagggcaccagggtgttagggtccccatgcttcctcagggggtgggcatgacaggcaggtcgctggtgacaaggcagtggacgtcacttggggaaggatggcgggagagggctggacaggcccccgctgcccaccgcctggcgcatgccaacacacttaaagcacttctcggaggcttctcggagaatcaaggcgaacgctcgtctccttccctaggaaggtgccaattcttcctcccgccccactctctncagagccccgagacccttagggtgttctggctgggggtgctaagcagcngtgtctncgacccccagaaccttccctgcncatgancccacggcatgcncggnagggggtgggcctnttaggnagattggcacagctgcncccacaccctgcctggctgggccccagaaaactggggttctccaagtnagcatggggtgctgggggcctgcncgggttccttcaccagaacagaagccccccaccccctcttccatttcagttganggaagangcagaggaggaaaaggccctggggaggggtnccctcgtgccttccattagccccttgggttccactttnttgggggcagcncttaatttnttttttcttccgtttnccagcctnggaaaggggctggcagggggccccaaggggcggtgcggcctgcnggaggagggcaggggttcccgggttgggggggacagggatgttttgtgggcagg

SEQ ID NO: 600189 - DNA, 749 bp, Homo sapiens
agcggagtgcaccgggcacgccgcgccaggctgggggcaggcaccgagcctccgtgggaggtccctgaggcagcttcgcctgctcgccctggctccagtccctcacctgccgtagacttagctgagcagccgtcgcactgggcgccccccgtccccattcggcagcgcccgctcgtcggctcttgcccggggtagtttgtatgggacgcagcaatctccacgctgcacgactgcgaggctggtactgctactgggctcctgcgtaaacgagtacaccgagacatttgccacaatgactgtcatcccacttgactttacagtttgctctcctgggacgcttgtgggtccgcgttgaccatcccaatgcaagagcacgcacgaaagaacgtcacactgagagtatctggagagcttcatcgttgcgaggagtgatgcgcaaaatatatcccaagactggtcagactttgctctttgagtgggaacagaagcattcgctggcttctgaaaaacccactggagccctgtgacaaatagtggggtccacggcagatgcaaaacgcttctcttcacccctcaggcataatagatgctgcgccttcgtctgccgaatttgacagatggtgaggctagcgagtcagcttctcagctgtggatttaaagctgtcagtgatatctgcaaaaatacctgaatattacaagatcacgaagagctttcccttgttaaagccgactggtgactattttaagaa

SEQ ID NO: 600190 - DNA, 674 bp, Homo sapiens
ccaccaacgattacagccgtcctcgtttgtatttcatgctcgggctggcgttaattcatacgttactggccctctgttcttacaatcaacatgactcggaggagtgaggtggcttcaaggatctgggcgttggatggcatgagctacctgtaagtttagtctgctgcccgcttggtagtagtgaccagtcagtgtcagcatcagtagtcccaaccccagtactctgttatactagcctttagaacagaacttacttcctataccccatagctatatagggtcacctacgggctagcaaccctagtctagtagccagattagcccggtactgaccctgcaggaagcaaagaggtagagcttaaagaacaaccaaactctgccagggtcccagaaagcccaggtccagcagtctcagcacttaggccccttgccccttcacaccatcctaggggcaggggctgggcctaccctaggtaggcaggggtagggtaggagaattagggagagggtgcaacgagtctggcccctatgcctcgggctaggctaggtagtactatccaagagcctctgctcacattgttggcctctggattctggcccttcttcattggctgttgcttaggactggactgttgctgagcctgtgtcctgcaaacccagatgtctgtaggtgc

SEQ ID NO: 600191 - DNA, 271 bp, Homo sapiens
caacatagcactgagagtcctagccagtgcacttaggcaacaaaatgaaataaaagacatctaaattggaaaggagaaataaaattattattattatttttttattgagatggagtctcactctgtcacccaggctggagtgcagtggcacaatcttggctcactgcaacttccgcctcccgggttcaagcaattctcctgcttcagcctcccaagtagctggaattacaggcatgtgccaccacgcctgactaatttttttgtattttta

SEQ ID NO: 600192 - DNA, 167 bp, Homo sapiens
atatcagcatgcgtgatcacgccgacgcctacaccccgggacagtacttttacccccgcggtgttggcagcggaagctggagcgcatcgcgcgcttggagaacaaggtgaagacgctcaagcgcggagaacgcggggctgtcagaataccgccggcctcctcgggga

SEQ ID NO: 600193 - DNA, 549 bp, Homo sapiens
  misc_feature (30)..(30): n is a, c, g, or t
  misc_feature (66)..(66): n is a, c, g, or t
  misc_feature (84)..(84): n is a, c, g, or t
  misc_feature (387)..(387): n is a, c, g, or t
  misc_feature (393)..(393): n is a, c, g, or t
  misc_feature (464)..(464): n is a, c, g, or t
taatgtaggacttaaaaaaaggagccactncattgctaatgaaaagaatgcaaaagtttcgtaggncgagtctttcactgagtntaaggacccggagctgagaagacacggggtttatctgcatcaaatcacgggagtacgtttaatgaatgccaaagctattggatttaaccccataatgaatgtctatgttgatgttataggaaatgaattctttttcttctttctccttcatcaccgacgtcctctttgagcgtggagcgctccaccagcaccgtgtggactgcgggtccgaaaggaacttgcgcatctgctccagggcgctcttctcctcccaaggccgcctcccaagctgcggcgcgcctcgccgccgtcctccagcagcangctgcnccagttgcgcaggtgcttctgcagcaccgacacgtccgccacattctgcacggccgacacttccaaattcngccgagccgtcctcgccgccgtcgccccgggctccgacatggtgtcgcgctcgggaccttccaggagcgatgagaaggcggtcgc

SEQ ID NO: 600194 - DNA, 353 bp, Homo sapiens
  misc_feature (244)..(244): n is a, c, g, or t
cttggttggcctttacttgagactgatttttttcactgaggccacatgatcttcagagattgcaagacgcctcaaaacatcagccgaagccgcctttagcacagtcatctcaccatcatgttcacggactcgtgactcaacagctgacaggcgatcttgaacatcagaagtacttgcagaagaaatactatcatcgacacggccgcacaaaccgtccctcctgcggggaaagcgccgggctccnggctcagaagggcgggcacttcattcagcggaccgacagagtggccgacgctgagcctgacccgctcgctctctaggtcgcccggctcggctaccggctcccgcctccg

SEQ ID NO: 600195 - DNA, 776 bp, Homo sapiens
  misc_feature (21)..(21): n is a, c, g, or t
agcggagtctagaactgtttnggctgaaaaaaaaaaaaaaaaagggcagaaatgagaggcggccagttctaagcctaggccccaatagaccttctatctttctggccatcattttggtaacctagctggccaccaccaggtgaacaaactggggctggccagctgggatgtggaggcatgtgggtatagtctctccattatccccactaaccattacccccattaaccaataagccaccaaacccgtgaatgaagttactcggggacagtcacctggcagcctacggtaactggagacacagtttcagtcactcaccactggcagagttcaattaacagagtggaggtcgggtataaagaaaggtggaccttttattccaaacctagcttcggggaagtatggcagggcttcctaccttcagggtacggcttcaatttgggagcataaggcaggggtttataaaagaggactgggcatgcattgacttgcccgggaaggagcaagcagggggggtccacgtgactgcttcagtgccctttctaccgggtgggttgagcagccaccactgggggcagaactaggttgtaaagaggtctggtctcagaatactgtccaggtgggaacgagaagtttggtaacgcagggcattccttgggctggtaacatggacgtgtggtccctcaagggaaatcccctgggaagaaggaagattcctctctgggagctttaaataagccccaagttagagaagcaagtctgaaggagtcaggtaaag

SEQ ID NO: 600196 - DNA, 988 bp, Homo sapiens
cctttatcatccttaagaacagttctggtgacatacatagttatctcattttacacaaagggaagtcgggcatggtggctcatgcctgtaatctcagcaactttggggaggctgaggcagaggaggattacctgaggcaaggtagttagagaccagcttagccaacatagtaggacccccatctctttaaaaaaaaaaacaagaaagaaaaaaacaaaataaaaaggtaagataaaaaagtgatatatatattttaggtcgaggatttcaccacattctttaagcctttgagttgagcagctgtaaatagtgattttgcctattaactgtatggtgtatgatgaacttgctcaagcgactttggtaaagaaattagggatattttgaggaatgagtacactatgcattcaagatgaaatgtgcctttcactatgtcatttctagagaaaacaagtggttgtaaatgcagctcataaattgattcacaaaatggccacaaattaaaggtctactactagaattgaacagtttggaagatataacaccacaccactgttgttaaaagaggggacacggacaactgtgtatagggcacgcgggaacaacaggtttttagcgccccaaaaaggaaaaatttctcccccttatatggccgaaaaaaatttcttcctctccacagacaacacctgttgtggggggggaaagcccagacggacaaatacacggggacaatctcttgggggtgtgcaccgcagcaactccactgttcgcgggtaaagtgcatcgtcacgccttgaccgcgagggagaatcccacgggggaccgcaaagaaccgcgttgtagaccccgttggtacacaccagccgagaggaaaggcttcaggcggaggacgagaacaaagaacccggctcggcgtgaacactcttgtccctggatggggaaccacgcgaaaaccgctgtgtacccgagaagtcgagcaatacacggc

SEQ ID NO: 600197 - DNA, 799 bp, Homo sapiens
gctgccccaaggcgggcttgggtgccccctctggcaggaagtggggccgggtgcacccgcgtggcggtgcatgcggtcggggtgcgctgctttcccgcgcctgcaggagcggcctgcgcccctccccccgctagcgccctgtgccccagggtccctgcctgtgcctggtcctgcaactgtgctgtgtgctgcatgacacgttgcacgagtcaccctctgtggccgaggtcttggagcctgatgcctcgggggtttagccctagccgctaggcgggtagtgcaaagtgtcgggttgacaagggtctccgtggaacctacttcttcctgctcgccaacttgctagtgagaccttaggcaactcaatggacttctctgggctaccttaataacgcggggaccggggcaagaaacaccaagggaaccccccaagaataatttacctaggcgcctttcctgcagagtacttaagtataatgacggagcacagtttgcaatgcacaagtgtatggaggagacaaggcttgaagggccaagcgggccttattacaacagtgagggaataggggtaaggccctaaaatgtactactccaagaccaggcctcaagatagtcagaaacagtgatcgcaaagacaaacgtcacttgagccataactggaaaaagggcctcaaggcctacaatataagaaagtagaaagaatagcctgaggcagactaaacaagtaccaaaaaacaacagaataaaaagcacgcacaaaaagaacatgaaagaaaccaaaaaaaccaaaccagaaatcaag

SEQ ID NO: 600198 - DNA, 285 bp, Homo sapiens
ggcactctagaggaaccccacgcgtcagagaaacctttacagctctcaacggccacgtgttatgatcttaacctaagtggggcattcagcacgaacactagcatgtcttaagagtcatgtcattagctgggtgtggtagcgcatgcctgtaatcccagctactcgggaggctaaggcaggagaatagcttgaacccgggaggtggaggatgcggtgagccaagatcacgccaattggactccagcctgggcaacaagatcgaaacaccgtctcaaaacaaacaca

SEQ ID NO: 600199 - DNA, 213 bp, Homo sapiens
ccaatgttcagtgaggaaaaaaaggggaagttgggggtaggccgatgttgacctgaggagttaatgtgctctttggggagataccttttatagagttagaaatagaatttgaatttttaaagggagattttggcttgggaaggacatgtaggagtttatccctgggtaggctgttgtaaagaaactgttgaaaataaaaagaagccatgtgga

SEQ ID NO: 600200 - DNA, 198 bp, Homo sapiens
  misc_feature (13)..(13): n is a, c, g, or t
agcggggaacaantccactttggctacaacctagcaaaagtgaacaaataggattacatgaagtgaaaaagcttatgtacagcaaaggaaacaatcaacaaagtgatgtgttccccgctagcggggaacaatcacttagcggggaacaatcaagtgatggttcaggtgatggttcgagtgatggttcaagtgatggtt

SEQ ID NO: 600201 - DNA, 322 bp, Homo sapiens
  misc_feature (24)..(24): n is a, c, g, or t
  misc_feature (37)..(37): n is a, c, g, or t
  misc_feature (49)..(49): n is a, c, g, or t
  misc_feature (61)..(61): n is a, c, g, or t
  misc_feature (92)..(92): n is a, c, g, or t
  misc_feature (101)..(101): n is a, c, g, or t
  misc_feature (109)..(109): n is a, c, g, or t
  misc_feature (117)..(117): n is a, c, g, or t
  misc_feature (128)..(128): n is a, c, g, or t
  misc_feature (156)..(156): n is a, c, g, or t
  misc_feature (273)..(273): n is a, c, g, or t
  misc_feature (319)..(319): n is a, c, g, or t
taagcttatagtgggagcaggtcnctgtctctcgttnaggttgttaaanggcttttatccnactgccccagctctttgtcatttgactaaanggagagaanaccggttnctctttantaatcaccaanaaaactcctttttcacagtctgtcttcnagaactatgatcacgaccaggatggatacatttctcaggaagaattcgaaaagattgctgcgagttttccattttccttctgtgtgatggacaaagacaggtgagggtttgtacttnggaatatgtggttatgagcccattggtgagaataggtttataggtntgt

SEQ ID NO: 600202 - DNA, 364 bp, Homo sapiens
gcccaaccagtctgactgtgcccagcccgagggctagcatgctcagaccacccccagctcatgaactcctggggagcctggacagcacattgccattccaccaactcatcattcgaaaccaagacagcctggcacctgccacctgcttctgtctgtgccactccctgcccagccatggagagtctcataggactcctccctcccatggagaccttcttggctagaaaatcacacatcctgcttccacaaagtccctctgctcagggcaccagcacctttcccctggagcagggcactctgcacaaaagcatcaacgcagtcctcaaggtcccagcccggctcagcggcatgaaaacacgctcaa

SEQ ID NO: 600203 - DNA, 378 bp, Homo sapiens
  misc_feature (378)..(378): n is a, c, g, or t
ggcgcgaggctggtgagtcggcagtcctgtggacagcctggctgggactggtttccatgtgttgcactggattatggaatccaccatgctgctgcatcccatggccagggtgtggcgtccagtgtgggcgagatggcagcttaaggaacggccaagggccttgagacctggggggcacaggatcaacccgtggcgtctcccggggcattggtcaagggaaccctgccagtaacctgtgcttacttgtgggcccaggaggttgggccaagtctggtgcaggccgtgcccgcgaggctgctgctgcagttttggggtgctcttctggcgaccatcctcgcttttgctcttggcgtgtctgtgcttgcctcctatgggggn

SEQ ID NO: 600204 - DNA, 284 bp, Homo sapiens
cggcggcagtcacaatgcctatgcccctatcccacccaaatattttaaatacacacaaactgcacatcgtctaaatatcaccaagtgaacataaaactctacacttgggtgggaagacaagccgagcgcaaggacccatcacctcctttcaaacggggccacgccgtgatcacaaaaagtacccaactggcagctatcagtccatctatcttctctgggaagaaaaggctcaaacatcgggcagcttcggccaagaaaactcctggaacacagtttggggactg

SEQ ID NO: 600205 - DNA, 849 bp, Homo sapiens
  misc_feature (45)..(45): n is a, c, g, or t
  misc_feature (84)..(84): n is a, c, g, or t
  misc_feature (89)..(89): n is a, c, g, or t
  misc_feature (103)..(103): n is a, c, g, or t
  misc_feature (127)..(127): n is a, c, g, or t
  misc_feature (138)..(138): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (183)..(183): n is a, c, g, or t
  misc_feature (191)..(191): n is a, c, g, or t
  misc_feature (201)..(201): n is a, c, g, or t
  misc_feature (210)..(210): n is a, c, g, or t
  misc_feature (234)..(234): n is a, c, g, or t
  misc_feature (337)..(337): n is a, c, g, or t
  misc_feature (345)..(345): n is a, c, g, or t
  misc_feature (371)..(371): n is a, c, g, or t
  misc_feature (395)..(395): n is a, c, g, or t
  misc_feature (433)..(433): n is a, c, g, or t
  misc_feature (436)..(436): n is a, c, g, or t
  misc_feature (466)..(466): n is a, c, g, or t
  misc_feature (474)..(474): n is a, c, g, or t
  misc_feature (483)..(483): n is a, c, g, or t
  misc_feature (570)..(570): n is a, c, g, or t
  misc_feature (625)..(625): n is a, c, g, or t
  misc_feature (649)..(649): n is a, c, g, or t
tggaccttagaattctgcttttgtccctgctgggcccccaaagtngggcattttttctctctgttccctctcttttgaaaatgnaaaanaaaaccaaaaatanacaactttttcttcagccattccngaatagagaanaaaaccttatggaaacagnaatntnaattgtgtaatcattgttcnaataaggnaaatagaagnccttatgtntgtgtaacaagaatttcccccacnacatcctttataactgaagttcaataacagtttgtgtttggtggtaaaggattttctccatggcctaaattaagaccattagaaagcaccaggccgtgggagnagtgaccntctgctaactgttcttgtgggtcttntgtccaggaacatggggtaacatncctcgtatgtgttagagggtggaatggatgtgtttggngcngcatggggtctggtgcccctcttctcctgnattcacanccccccccngggcccgcttttactaagtgttctgccctagattggttcaaggaggtcatccaactgactttatcaagtggaattgggatatatttnatatacttctgcctaacaacatggaaaagggttttcttttccctgcaagctacancccactgctttgaacttccaagtntgtctagtccccttttaaaatgtaaacattttcagaaaaatgaggattgccttccttgtatgcgctttttacctttactacctgaattgcaagggatttttatatattcatttgttacaaagtcagcaactctcctgttggttcattattgaatgtgctgtaaattaagttgtttgcaattaaaacaaggtttgcccaca

SEQ ID NO: 600206 - DNA, 248 bp, Homo sapiens
gtcagtatgactggatcatcaggtaggggcaggtaacctggtgcaggtggttcacacttgtgctaatcccagcactttgatcagtgccacggtgggacggactcacccgagcccaggagttagagaccagcctgggtaacctagcaaaaccgtctctgaaaaaaatttcaaaaattagccaggtgtggtgacacacacctgtggtcccagcaactcgggaggctgagctcgccccacagagagagcgt

SEQ ID NO: 600207 - DNA, 1283 bp, Homo sapiens
  misc_feature (45)..(45): n is a, c, g, or t
  misc_feature (84)..(84): n is a, c, g, or t
  misc_feature (89)..(89): n is a, c, g, or t
  misc_feature (103)..(103): n is a, c, g, or t
  misc_feature (127)..(127): n is a, c, g, or t
  misc_feature (138)..(138): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (183)..(183): n is a, c, g, or t
  misc_feature (191)..(191): n is a, c, g, or t
  misc_feature (201)..(201): n is a, c, g, or t
  misc_feature (210)..(210): n is a, c, g, or t
  misc_feature (234)..(234): n is a, c, g, or t
  misc_feature (337)..(337): n is a, c, g, or t
  misc_feature (345)..(345): n is a, c, g, or t
  misc_feature (371)..(371): n is a, c, g, or t
  misc_feature (395)..(395): n is a, c, g, or t
  misc_feature (433)..(433): n is a, c, g, or t
  misc_feature (436)..(436): n is a, c, g, or t
  misc_feature (466)..(466): n is a, c, g, or t
  misc_feature (474)..(474): n is a, c, g, or t
  misc_feature (483)..(483): n is a, c, g, or t
  misc_feature (570)..(570): n is a, c, g, or t
  misc_feature (625)..(625): n is a, c, g, or t
  misc_feature (649)..(649): n is a, c, g, or t
tggaccttagaattctgcttttgtccctgctgggcccccaaagtngggcattttttctctctgttccctctcttttgaaaatgnaaaanaaaaccaaaaatanacaactttttcttcagccattccngaatagagaanaaaaccttatggaaacagnaatntnaattgtgtaatcattgttcnaataaggnaaatagaagnccttatgtntgtgtaacaagaatttcccccacnacatcctttataactgaagttcaataacagtttgtgtttggtggtaaaggattttctccatggcctaaattaagaccattagaaagcaccaggccgtgggagnagtgaccntctgctaactgttcttgtgggtcttntgtccaggaacatggggtaacatncctcgtatgtgttagagggtggaatggatgtgtttggngcngcatggggtctggtgcccctcttctcctgnattcacanccccccccngggcccgcttttactaagtgttctgccctagattggttcaaggaggtcatccaactgactttatcaagtggaattgggatatatttnatatacttctgcctaacaacatggaaaagggttttcttttccctgcaagctacancccactgctttgaacttccaagtntgtctagtccccttttaaaatgtaaacattttcagaaaaatgaggattgccttccttgtatgcgctttttacctttactacctgaattgcaagggatttttatatattcatttgttacaaagtcagcaactctcctgttggttcattattgaatgtgctgtaaattaagttgtttgcaattaaaacaaggtttgcccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaactaaaaaaaaaaaaaaaataacaaaaaaaaaattgggtgggggcacattcccctatttacccttttgcgaaatatttaaaaaatcaattgccgatcgttaaaaacaacagtaactgaaaaaacatggggaattccaaattaaaagccttaaaataaaattcaatttttccataatggctaattaaaaaaaatcatcaaaaaaccaatattacaaaaaatgtaaaatccttaataaatcaagggaatattctaacattaaaaataattgaaaaaccagtttaaaaattagaaaattatcatttttttaacaaataggcaaaaatccca

SEQ ID NO: 600208 - DNA, 111 bp, Homo sapiens
aactctgttctgaaccacggtgattttgtatgagcctgggtagctcaagatgggccagacatgaggtcgaacatacagtagctagtcctgctgcctctgactctgaggcag

SEQ ID NO: 600209 - DNA, 1465 bp, Homo sapiens
aagaaattcgtacgttcgacgtttcgatttttcacagcctcagccctaggaaaaatggttcatgggataaacagctggtatttgttattctaaaactcaaattgtggctcacattaaattgccacggcattctccgaagttttggattttggatttaacatttgacaggatttacgtgtgttgttttaatttttttaaaaacctgaaccccgtgtgacttattggggtttgtgggctaatttttacgcagaaaacttctttcacgtgcgttagaaaaaaacattagacaccgtgaaatttagtgttgttacacttttgtgggaagaggtttataatctctgtgaattatctcacacaattacactccattgtgcacaattcacaacttctcccctatgtgtctcacacgtctgtgtcttccccagacacacagtctctttctcacgacaccccactctctatctatgtcgcgtgacagtgccccgttggcacacacttgtggcggcgctgtgtcagacaccccacccctctccttcttgtcgcgccccttttgtgccactttgtgccactgtgtgtgtcacctctctccaccagagccctcagatgtgcctgtgccgcggtgtgtgctctctccgcgacgacacctcttcacacagcacaccctctgttgcgcacgccgtgttttttgtgcggcgccctgtgtgtcgccccccactctttctacacagcgtctctccgagtggacacccccaccctccactgtgtctccccaccgcagcgtggtctctcctctccccctcgtgcgagcgggacacccctccgcgacattccctgtgccaacttgtggcgcccccccttctcctttgtggtgtggcgcgcccggctattcacacgtggccctctctattggcacccccccttttcgcacacgacgctcccccagggtggccccctatctttctacccccgcccaccctcttgcaaccccccccccgttgtcccttacccagcgcacatctgtgctcccccctagctgttttcccccccttctttggcccacctttcggtgggccttcacacagggcggggacctcctcacgtttctccctggggctaccccccttggacgctttcgcggccacccaccaacgccccgcggggatccctcggcattacccccttttttcggtgttgccccgggggaacattccccctttttagcaccatctagtgcctctccagctcagccgcatgcgggggacggaccgcgcttttagctcccccctatctttgggcggcgttgtccccgcgcagcatctccttctatgccccgcggctcttaaatcgtccgcgccccctcggtatttgccgcggttgaatatagtctccccccccctggggccattgcgagcctcctcctctcgagcacgcctacatctcgatggctgtctttgtacgctagggt

SEQ ID NO: 600210 - DNA, 222 bp, Homo sapiens
  misc_feature (114)..(114): n is a, c, g, or t
cgctatcgatggcgcgttgaggcggcgcatatgcatctaggctataatatccggatatacgtagccggtaatgtaaacaacggtaccctctagaatatagctagcatggcaatnaaagcgctgatatcgatcgcgcgcagatctgtcatgatgactcattgcaattggatccatatatagggcctgggtaataataacctcaggtcgacgtcccatggccat

SEQ ID NO: 600211 - DNA, 304 bp, Homo sapiens
aggacccttatatgctgtctcatattttctaggtgactactgctgatgtggtggaattctgatttttaatgtagacttgtagccagcaatcttatagaactatttattcattctaatagttactaaataattctgcttcatattctatgtagctaaatcaaaacaaatgtgcctctatgagaaactatatagcaccaaggttaacaggtgaaatctggaaagccataaaaactagtatcaaaactgtagtaaattcctctactttcctttccagattacaaatttaatatccaatattctagcc

SEQ ID NO: 600212 - DNA, 922 bp, Homo sapiens
actcactcatcgacctccccaccccatccaacatctccgcgatgatgaaacttcggactcactccttgtgcgcctgccatgatcctccacaatcacccacaggacgtattccctagcccatgccactactcacacagacgccatcaaccagccgttattccatcacatcgcgccagcatccactcgcagcacgtacaacttaatggactgacactcactcacgacataccatatcaccgacccaagtggccatgccatccaagtagtatcgtatatactcctggaccatctatacgctgacccacatacaggagcctgcacggccctacactctatcaacagagcattccaatatctactacctcagctaaccagcaaagaccacgtgccacaccagcacgttccgggccccgttcaactttccttccaccgtggcccatcatgaccaacacgccttcacgttaccgtccaacaaactaggcccccagtgtaccacatacacgaggacccatataaacattgaaattccccatatatcccccaccagtacatcatggcaaaggaagaccaccccacaaaaccactttaactttcccgacacttactaccacatagagaacgaaggaggctgaccacccaactcacacaggtgcagttcaaccacaccattctgcacgccaaccacaaccaacccaatgagcaaaaccaccacttcaacatctttctacacacacatggagtccccacacagaaaaacattttccctctcgcaagaaaaacatttacacaagcaaccacgcctttcaatgtggacaggacgcgaacaacatcgactaccagggtgcgacaaagacacccccccgctttttacaacggtgcgtactatgagttcccacaccaacacaacgcgttgtgtgggcaa

SEQ ID NO: 600213 - DNA, 631 bp, Homo sapiens
  misc_feature (370)..(370): n is a, c, g, or t
gttacgtgatgtcaatgatcatcaggttactcggaacatatggaccccttggcaagactgatgtatgagcagtccagactgtctagcctttagaataagggcccacatcaatgcaagtatagttccgccaatgtcgacttgtgttctaagtcgctatgcacgttgataccaaggccgctgactcacactggagtgtaatctgcccacataatcttgggcaagtccatgtaggacttggtctgtatgagtaagtgtcactagggatgtgagtcatcttcatgcagttctcaaggtgcatgttgcacgctagtgggcattctctagaccgtcagtggctgttccgcaggttcgcaggaccattgcagctggnctagcagctcaatgtctcgtcatgacaatcttggcaccatgtggattgctcatgttgaagtcccagcaggtggcagcctctatcatgaagtcagtgcagccgtaacatgcatagatagtatcaatgcgcatgtcactagtgatacctatatccttgaaatctttgaaccgctctgattcgacatcttggatagcggcccttatagtcaccagctgtgtcagcacggcaacccccacagagtagatgccctattggcattag

SEQ ID NO: 600214 - DNA, 1215 bp, Homo sapiens
  misc_feature (30)..(30): n is a, c, g, or t
  misc_feature (119)..(119): n is a, c, g, or t
  misc_feature (370)..(370): n is a, c, g, or t
  misc_feature (404)..(404): n is a, c, g, or t
  misc_feature (440)..(440): n is a, c, g, or t
  misc_feature (474)..(474): n is a, c, g, or t
  misc_feature (484)..(484): n is a, c, g, or t
  misc_feature (625)..(625): n is a, c, g, or t
  misc_feature (631)..(631): n is a, c, g, or t
  misc_feature (643)..(643): n is a, c, g, or t
  misc_feature (649)..(649): n is a, c, g, or t
  misc_feature (655)..(655): n is a, c, g, or t
  misc_feature (657)..(657): n is a, c, g, or t
  misc_feature (1187)..(1187): n is a, c, g, or t
  misc_feature (1206)..(1206): n is a, c, g, or t
ccaatgagatgcacttactaatatctgcantgtacaatgcaggcagcagcagcgccagctaaagctgagctctggtagagttggattggatgtttacagtgacctacctcttcagtgtnatatttcctcacggtcatcagctacaggctgtgagacagcctgggggagacaggatagccatgtttcccactacctcccaaaccactggctggtgcaccagcctcctggccttaggtcgcagccacagtgacgtgacctcctacaatccctggcaagctggaggagcagccctgcaaccaagcctgctctaagataaggctttctgtttactaacctggagctgctctattctttcacccttgttcccctntcagctgtctcgcgcaagtactaattttgccatnaaatacgcattttgttttgcaaaatgagaagagctnataaatacttcaaattttctccgtctgtttcacncctttccatntctttctaaaattacagtaaaatattaactatacaaaatattgttgtatttatacaaaacaacaataccataaaataaaacactacatagttgaagccctctgaggatctctccatatcaaccagccaaaacgaaaacccngaactntacgtttctttncccttngcggtngnttaatttttctacatctgaatatatccttacacgtttttaaaatttatagaaatatcacactgaatacatttttctgtaacttgcctttgcactgcattgtgagattcagctatgttgatctgtttaactccagctgatgtatgtaatgatccctgatgattattctgtcgtttgactataccaaaatttattcaggtctctgataatgagcatttagattggtttgttttcccatttatgaatttagcaattatgtgtttctaattttttgttattataaactatggtgctacgaatattcctgtatatgccaccttcaaaattgtaaaatttcaactgttttaaaatacagtcatgtcaggatacattctgagaaatgtatcattgggcaatttcattgctaggcacacatcaatgtatgcaaatctagatgcatagcctactacacacctagaccacatggcgtagtgtgttgctctgaccaccatcatatatgtagttcgtcattgaccaaaatggcattctccgncacgtctgtattaaaattntttagtgga

SEQ ID NO: 600215 - DNA, 572 bp, Homo sapiens
gctactcctggactctgagcaatcctccgaccactgcctcccgagttgctcggaccacaggtgcgcaccatcacacctgataatttgtcaacatatttgtagtgatggggtcttgctatattgcccaggctggttccctaactcctgccttagccattttttgtttgtaatattagcaaattatctcctccatccctcccttgggcaggagacagctatgagtgttaaggctcctccaagggccgccgagatacagagggagaggcacctgacgagaggcgcttcccagcctgggctgaagggcgaaatgagctctctcagctcaagccaatcctaagaagcagattcccctcaggtgacagcagcgtgagtaggtggagcgaggacaccaggactcgtcccagcccggaagcaggcaaaaggggccccgaaggactgcctcgaccctgtgtcccccgaactgctcagggtagtacccaaagagctaggaagatgtccacactcactacaaaacagaagggctagggggctccctcatcttgaacatgggaggtgcagggtgcttagtttgc

SEQ ID NO: 600216 - DNA, 275 bp, Homo sapiens
  misc_feature (262)..(262): n is a, c, g, or t
accttgatgagctagtcattgtactcttactcaataataattttgagaaaatcagcgagctatacagctttgtaaaatagttaccgctgaattcatcgtaaagaaaataacctttgcaaaaatctaccgtgtagctcataaaaccacgaacaaattagaccttgcgataaaggctatttacgaaagaacgaacactgaattaatccacatttacgaattaatcagattaggccattcatacaaaaagaatcttgcacagatngttttacagacag

SEQ ID NO: 600217 - DNA, 836 bp, Homo sapiens
atgttgtcgctggaggaggacggcttacatgtttgtttctgtagaaaataaagctgagctacgattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaggagagagagggaggagagagaataatatttatatgaattacatggcggaagaaattatagtctcatacatacggatacgatgtgttattagaggtggtagatgtatgatgatgattgatttattatagagtacataaacattaggacaaaaacacgagcagccagagaggagaggaataaagaaccacagaaaccagaggaggagaagacagcaagaagggacacagagcgacaccacaacacaaaaaagcatagagagggaaagagaagagacaaacgaaaggacgacacaggacagaacgacacacacacacaaccgacgaccaacggccagaagacatatcgacaaacgcatagacagcacacaacagggcgaacggcgagagtctagaatcatgcagagcacacccgagagcgaacagagaacgtgcagcagcgaagacggtagcagagcatatcgacagtactctggcactcgatcgcatgaccgcaagagacatagatagcttgcagatcactccgaccgaccaatagatgagagaacgcagctaggagcacgaggaagcagaaggaagagtagaaggccgggagcacgcacagacgacacgaaccgaaaagaccacaagcacagatgaaaaaacgggcgaaaagcacaaaccga

SEQ ID NO: 600218 - DNA, 153 bp, Homo sapiens
tcctgagtattgcatctgctgctataaagctggaggctatgcatgctataatcaggaagaaaatgaggaagcaggccgggcgcggtggctcacgcctgtaatcccagcactttgtggaggccaagggcgggtgaatcactgaggtcagtgagt

SEQ ID NO: 600219 - DNA, 394 bp, Homo sapiens
gtaaaataaaaagagagaactacgtacaaagctaacataaccattcatcatctaactagttatatatatcctaactactacaagcattccatactactcaactataaactccagccaccacgaccctcactactatctcgcagctgaaacaagctaacatgactaaaaccgcttaataccatccacactcctctcgctaggatgcctgcgcgggataaccggctttttgccaaaatgggccattatcgaagaattcacaaaaaacaatagcctcatcatccccaccatcatagccaccatcaccctccttaacctctacttctacctacgcctaatctactccacctcaatcacactactcctcaattacccacataggatgaataatagcagt

SEQ ID NO: 600220 - DNA, 634 bp, Homo sapiens
aaaagttcaaaaattagctgggtggggttacgtgtgcctgtaattccagctacttgggaggcggaggcaggagaactgcttgaacagtgtggagatgtttttgtcttgtccaaataaaagattcaccagtaaaaaaaaaaaaaaaaaaaaaaaaaaaaaaaaaaaaaaaaaaaaaaaaaaaaaaaaaaaaaaaaaaaaaaaaacaaaaaaaaaaaaaaaagtaaaaaaaataaactaaaaaagaaggaaaaatatgaattacagaactggagttgtttaaatttacagggcgctagtttttaagcgatctactggaaaaaccccatggttttcctaattaaaaacgttgtgaaactctccgttttggcaaacgggtttatctgagaaaccctccctaatattcttttccaaaacttggccactcttatgcttcatggaaaactgccgcccaagtttgggctaaaacgcggcaatttctttgaaaaccctctcttttttataccatgtggctcatctgggaaattccatttaatcgcacaaatatcctggtatctctttggtgtttccccattggaacaagtccctcttttacgtggtttctaccccgggcaccttttttggggtgggcccctct

SEQ ID NO: 600221 - DNA, 316 bp, Homo sapiens
agcctcgcttgtgcctccactcctggattcaagcggttctcttgcttcggcctcccgagtagctgggattacaggcatgtgccaccatgcccagctgatttttgtatttttggtggagatggggtttcgccatgttggccaggatggtctcgatctcttgacctcatgatccgcccgcctcggcctcccaaagtgctgggattacagacagatgtgagccaccacgcccagctgatctctatatttttatagtctattttgggatgcctgatctctgtatttttacagcccattcctgctcagctataatggcgtg

SEQ ID NO: 600222 - DNA, 830 bp, Homo sapiens
gctctctctctctctctctctctctctctctctctctctctctctctctctctctctctctctctctctctctctctagcttggtgtgcgcgtgtgtgtgcgccatattcaggtggccaacagagaaacgagtgcaccacataccgcgcgcggcattagctccacaaaagaagaaaacaaaacaagaaaaacccaagagaacaacgtgcttggagagaaagacgagcatcacacaaaacgaagagggcggacatccacaacagacacgcataagacaaacaccactcaagatctacgaaaaaaacggtgggtgtacactctctctgttgccagaggaaagacgtagaatcatgtaccacaaaaccagaaagcagaagaatacatgtaacccaccccctacaaacacacgtaatctcggaaccacgaacagacacaaccataaaacacaacagaacacaacagacacagaacagatagccgacacagccagaataaaacaacacagaacagggaacagaaaagacatgaagtacaaacagaagagacgcgtagagacggacccttcccaccatatccacgtcgttgtactggtacgaacccacggcccacacgctgccacaaggacgaaacacatgaaactatcaacacaactagccgcctccgtgaggcaaccagacagattgcgcgcccgcccagaagatgacccccaaagcggaactgacacaccctgcggcacaatcaaccagcaaaaccgatgcagaccgaatgtcattcatagaaccgaggcgaccccaatgcgtgtctaggcaccagacaagaccacacacacg

SEQ ID NO: 600223 - DNA, 317 bp, Homo sapiens
  misc_feature (281)..(281): n is a, c, g, or t
  misc_feature (308)..(308): n is a, c, g, or t
  misc_feature (313)..(313): n is a, c, g, or t
ctcattttgttttgaggaaacatatccaagaaagctaaatgagttgtacaaggaaagcagtaggagaggtggcagagcagttcctggatctcacacttaacaatctagtgatttgttaaccttttatcaccctaaaagaggaaatgtttagaaatattttggggctgggattacaggtgtgagccactgctcctggccggtatcaattattttagctgtttcataatcattaattgttatgtaagaagaatgtctgtgtttttccaggggatgcatacttnagtgtgtagaggtaaaatgacatgccnggganttgc

SEQ ID NO: 600224 - DNA, 623 bp, Homo sapiens
taaacctttccttatgagcatgccggtgtggggttgacagggagggtaataatgactggtgggtggatggtaaatatggggctggtataaattggtcagttcagtggtttaaatctggacgcaggcttaatgcgggaggaaaatggttttcatggtacacttatatcctacacattaagttcttctataagggtgatcaaatgggtccaatggggttgtgaggagtcacagtaatatgtgtttggggaatttataagtgtaagaaggagtagataggaagctttgaaacgcttacctaaaaaattgggtgggctggctttaagaggcgctaactaatgggggtgtgtaaaaaatttggttagacactcactccttctaacagagagttattatacactaaagaggcgacccccaaaagagagcgcgtcgtacacacacacctatgagggaccccaacagcaagggagacacctactttctcacccagcagggcgcgccactacacagacgacgggtgtacacataggggggcgaacaaaaatgtgacacagacgcggagccaaccacacacaggaaatacgcacatcactgtgggccaccgaacccccaagaaaataatacac

SEQ ID NO: 600225 - DNA, 751 bp, Homo sapiens
  misc_feature (590)..(590): n is a, c, g, or t
gcactgagctgagattgtgccactgcactccagcctgggaaacagaacaaggccctgtctcaaaaacaaaaaaaaaattaacttggtgtggtggtgcatgcctgtggtcttagccactctggaggctgaagtgggaggatccctctggctcaggagttgaggttgaagtgatgaagtgagccatgatcactccactgcactccagcctgggtgacagagccagaccctgtctcaaaaaacaaaaacaggctgggtgcgttggctcacgtctgtgatcctagcactttgggaggctgaggcgggcgtattgcctgagctcaggagtttgagacagcctgggcaacatggcaaaaattctgtctctactaagaacacaaaaaattagctaggcgtggtggcgcatgcctgtaatcccaggtacttgggaggctgattcaagcgattctcctgcctcagcctctagagtagctgggattacaggaatgtgcgacaacacctggctaattttgtatttttagtggaggcggggtttcaccatgttggccaggctggtctccaactcctgaccttgggtagtccacccgcctcgngctcccaaagtgctgggattacaggcgtgagccatggctgcccagcccgttcatgcattcgatgcaaaatactgagctaggactgcactgggctagtagagagaagcaagggaaccagaccaggaaaattggaggacccagcagagatgccgagaaggaaa

SEQ ID NO: 600226 - DNA, 358 bp, Homo sapiens
  misc_feature (62)..(62): n is a, c, g, or t
ctctagctcggtaccccgtgctgaagaatgttgcttgtgcttgggcttattgtgcttcctgngtctgtaggtctatagccatctttaagtttggaaagttttttgttgttgttgttttgtgtttttgagacgggagttttgctcttgttgcccaggctggagtacaatggcacagtctcagctcactgcaacctccacctcctgggttcaagcaattctcctgcctcagcctcccaagtagctgggattgcaggcatgcaacaccatgacccactaatttttgtatatttagtaaaaacggggtttcaccgttttggcctggctggtctcaaactcctgacctcaagtgatcaaccca

SEQ ID NO: 600227 - DNA, 403 bp, Homo sapiens
tactgtccagtcaactgatttcagcaaaaatgtttgggttcaccagcgagttgttgtgtgaggcccccaaaatggaggtgatatcggcctcagggttcttcctggaggtggaaaagtggtcaaagtcctttgtggtgaaatggccctaccccaaagtgggagacatttaaaatcgaggggaaattggcctcagtgctctttttggaggcaaaaaaccagtaggagtcggtggttaaatggccctgtgtgaatgtggaaacccagcaaattggaggtggaattggcctcagggttttttttggaggtggaaaaggggtcaaagtccttggtggtgaaggggccctgcccaaaaggttgttcccccttggccggtgaaaaaataaaaaaaagttggccccttgca

SEQ ID NO: 600228 - DNA, 345 bp, Homo sapiens
gcaacacaggaaatccctctctactaaaatacaaattagccgggcgtggtggcggcgctgtagtcccagctactcgggaggctgaggcagaagaatggcgtgaacccgggaggcagagcttgcagtgagctgagattgtgtcactgaactccagcctaggcaacagagcgagactccgtctcaaaaaaaaaaagggtcttcagcttattgcttggccttaagaatttctgaagcgttatgtgagcggtgactctgattcctctacagttaacatgaaatacacgcttaaccagacacatttctatgtgatgccatcccactgagtgatctctatttgtgcaaacc

SEQ ID NO: 600229 - DNA, 389 bp, Homo sapiens
ccgttcggtgggcaggctctgatctctctcttcagagaatagtaggtcgaatgcgcttgctgcggggcaggggaaatccaaggtgtatggccatcgccaatgacaaaaatgtgggaaagcctcgtggccaagcggtggccaggggagtccttcacatgcgtcgagatcaaaagaacgaggattgtctgaccctgtagatgatcacatgaagacgagcgaggttggctccgagcagtcaccatacacagaatggctgtatcaaattggataaagttgattatcttgccagtccctaaatcaatctgcacaagtatcgttcaccttgatgacaggatctgggtaggggatggttcgagcatcatgagtcaccaggtgagggattcccttca

SEQ ID NO: 600230 - DNA, 909 bp, Homo sapiens
gttttgaaaacctgccgcaactggggacgtcgcgagtttcgaccccccagaatcatatttgggggttattcccagggccaacccagggggtttctccagccccgttgacgggaggtccgctgccactcctccgctttccaaagtgacccgaattgggtccccctgacgagagagttttttttcagggccgccaaatattgggccccgcgacccaaagtttttgcgggccttcccttagtggttccttcaattcctttccgggggggggagactctgaaaagtaccctatctatctcacgtaaacctcgtgttttggggccttcgcccattgggcaaagaccaaatcatgggggggcgccccttccggattcttgaagccctctggcccaagtaaaaacccgcgtctcctcttagattttataagaaggatgcttggggcaacaccaaggcctataattatttccccgcccagtattttcttagaacaaccccctggccacacatatagctgctggggacggcaatacgacctcggtgcagcatcttggggtagaacacaccccctctccctcgtgtccgctctcgggcctgctctgagggccccccgcagccacacttacacggggtccccctcctatgtggccgcccccccccccttgtggtgttgtacccgccttcctccttatgagatttttcccgaagcgccatcgttcccgggaggcaccgttggccggctcttgccttcttcactctctggtgatgtggcgccccatctcgttggtttttttctccccccatttcccccaaattttagagttaagggagccccgtgtctatttccgggggggccccagggaaaacccccgggggtttttgcgcctcaaaaacaaaaccccctggccccagaga

SEQ ID NO: 600231 - DNA, 182 bp, Homo sapiens
ggggggtttttgggggggggttgttttttttttttccccggggggggaagtttccccggccaaaagggttttccccccccccttttttttaaaactttccccccggcgggggcgggggcccccccccccccgggggttttttttttccgggggcccaaaaaaaaggtttcttttttttttta

SEQ ID NO: 600232 - DNA, 134 bp, Homo sapiens
agtaccctccccacctctgggttcattcagatctctctgtctgaactccagacccagagatccacagcccccttggtaaatctctacttgaatgcctagcagccactaaatatcatattcaaagcctaaaccca

SEQ ID NO: 600233 - DNA, 564 bp, Homo sapiens
tctggtggttgcggggatgtgtttccactggcgtagtcggtcagatacttctggtccttttgggagtgcatggatgtgacgcggttcagtgccacatgttagccaagtgctagtgtaattcctgttcacagtcactacaatccactatggtgcagctacaataggtctatgttaacatgctgaagcttgaatcatacaaatcgtctcctctatatatcaagatatattcctagtattcaactgttcccaaccaaataaaaaaaaaaattaaggaaaatacatactaaacaaggaaccattccatcagtggttgtttagaacaagtaatgtactcatcaatatataatcacccaacctttattattctcattgcactactgtcaggagacatgttacagccgctaaggacaatgtacttcaggtttgaaacctgggcaagaagccacacgactgcatgagacaagccgtgagaggcactgctcaggaggaaacgctgggtctcttcaccaaaatcagattacagcatattctgggagcacacgcccttgtagcgtccgtagcggg

SEQ ID NO: 600234 - DNA, 240 bp, Homo sapiens
gagctgctcgctccattcatgatgccctacgtgtcttcgtgttacgtgcgacacgggccttattgcggacggtggtgctccagaatcgcgttggcctacgattacctgcatcttcaccgaacactgagtggtatggaatcctactgcgttcgtgcttttgcagatgctatggaggtcattccatctacactagctgaaaatgccggcctgaatcccatttctacagtaagcagaccgtcg

SEQ ID NO: 600235 - DNA, 303 bp, Homo sapiens
aacttaagctaatgaataagttatctgagtccagtgaaaagacaagcatttaacagtgtacatcctactttagataactcagttccttctaaaactgacgcaaaggataattccttcgaagtgtttaccccagatgtctgaaaggaattccagatggtcaaatcaacacaccatgttcctaaacttggtgttatgaattcatcattagaagatgtatcatttattttattctttctggtataattttgattcttggagcaacattttcttatttatatacatgcatacaaataaaaagcagac

SEQ ID NO: 600236 - DNA, 340 bp, Homo sapiens
tgttctgtgctgggtagggagatcactgctgataggaaaggacggagggagaccccagctcctcttccagagggccaaatgcggaagaagtgcttcaagcaggaacgtttcttgtgctgcacaacgtcactggagaaggcgctgtaacatcacatcaacttaacataggggtgcacgataaaacctgaaataacacaaagaggaacaaaacgaagcaactgaaaattactggatcacatcctcacatcaaagaaaaaaatctaaaaccatcactacaagttagctacaaataatactggaaacactgcaacaccaaaagctatacaatccagcacaagaa

SEQ ID NO: 600237 - DNA, 150 bp, Homo sapiens
tctcgtacttcgagtactcagggacatttaagagttggaggtgcaaatatattccaaaagtgcaacagacacagtgtatccccctgcttctgttttgtatattttgctacttggtttttcttgatcatagctatttgtgcttgatcttta

SEQ ID NO: 600238 - DNA, 81 bp, Homo sapiens
gaccccaccccccaaaaaagctacttcttcattccgtggtacgattattttttttaactaaaggaagataaaattctaaaa

SEQ ID NO: 600239 - DNA, 346 bp, Homo sapiens
  misc_feature (176)..(176): n is a, c, g, or t
  misc_feature (183)..(183): n is a, c, g, or t
gttttttgttgttgttttttgaggcagagtctcactcagtctcccagggtggagtgcagtggcacgatctcggctcactgcaatctcccatctctcaggctcaagcgattcttgtgcctcagcctctcgactagatgggatcacaggcatgcgccataacacgtggctaatttttnatttttnagtaaagacagagtttttccatgttggccaggctggtcccgaactcctggtctcaagtgatccacccgcctcagcctcctaaagtcctgggattacaagtgtaaggcaccaagcctggcccagaagtattttttttaataaacttttatatgtaaggatgact

SEQ ID NO: 600240 - DNA, 1232 bp, Homo sapiens
ggatccagactccatggtgttgctatatgtggtggtagaactgtccagatgaaagcttcattcaacaccatctgtgagaatgccaccgttgtcagacggtaccaaggaaaggcagatgcccccgatggccttggtggtacacatggccccagacatctgtgactatgtggacagcaggtaccagcagtggatggagaggtttgggacctgacacccagcacattggatcctggaatgagaactgtgcctcagtatcacaaccttcgcagccacaagattcaaaccacagctcaaacatcatccacaccggacatcttcccccatgactcaccaggtattccagctgataagaaggagggccccacccatcagtgatgcccatggattcagggtgaatgcctccatcacagtaccagaatccgatcccaggagggagatggcagaagaggatgccatatattactatgcaatcctgaggaattcatagttgaggctgctgcagacttcccaacattccagcagacgcgtgcaggagtacaggaggagtgcgcaggacggcaccagacaccagcagagaaaagcaagtcagtaaccagaaatcatctaccattggaaacaggatctgacatcccgatgcacgactcgaatgtcagatgcccacacatgtcacacataagccccagaacgtcttctgcataacatgaacatgatgaatgaagggcacatctatgggacaaactgtgccagacaataacgagaagaccaggtggaaaagggtaccatgaaaaaacctgggatgcaggtgcaacggaggacccaacatgacacggacgatcagcccacacggggatagacaaagaaatcatgctgccaaagatgacagcggcactaggagactccagggaaaaaccgttacaacaattgcacgacaggatgcacacaacccagtcaaacatggacctacagaccacacacagaggccagaagccgaaccacactacacgatcggccacaacgcctcccgcacgtggccacaaccccaaacctccaggaaaaaagccaacaaggaacatgacaccgaacaaagacaaccaaaggaagcacacacacaaaccatgaagtaccaaccagaagaaaaagcacaacaagctaactagaagaccaacaaagagatacagaacaacatgagagaatactgacagcgtcccggataacacaaaacaacagcagat

SEQ ID NO: 600241 - DNA, 120 bp, Homo sapiens
acgaattgagctcgctaccgttttgtgggcgcggggcgtcgtgcggggtccgtttcgttgagaggtcgttgcctgtgtgtaggcgtctatagccgtggcccctgtggtatgtgccccacg

SEQ ID NO: 600242 - DNA, 535 bp, Homo sapiens
ttaaactgtacccagatcaagaagccatacattacctgtaagcccttcttattctccagtgaccgctatcctaacagcataggttagttttgcctgttttatcctttacagaaacaaaatcatatagggtctgtgtttttgggcctgactttttcactcaacattgtttcagaggttcatctatattaagcatagcagtggttcatgcagtctcattgctgtctgggattccgctttgtgactataccatcacaatggctgggatccattctgttggagggcatctgggtcatttccaatctgggctattgcaaatatactggtatgatattctaggtcatatcctttgggtaacatacacactgattgaggttgggtggacatccaaaaggggaattgttggttaaaagggtcgtgggcctctcaaattttaattagatcctgcccaaagagtttttccaaagggcttgtaaaaattttaacactcccacttccgggggtatgaaaaatattctttggtatgaggatgtatttt

SEQ ID NO: 600243 - DNA, 338 bp, Homo sapiens
gaggactccccgagtaacttatagtgcatatacagtcaagtcaggtatctacaaagtatcaatgatacagtgttttaatgacagatggcagatttgatacacgacaatggtagggtctatagaaataacagctccgtcaagtttttagaaagaattctagtaatttgaaaagcctttacactaaaatactccacttacatccattcagaaatgccagtactgcactgcaatcaagaaggactcttcaaagagagaatcagctcaaactggtcagctctagattagaatggaagttcttggtgccggcttttcttgatttggaagcttcagtcactcac

SEQ ID NO: 600244 - DNA, 295 bp, Homo sapiens
gaggatcacggagaggcaagatcccgggtggggtatcaaatagtaggtcgttcttcatcctttctatctttggatacgcattagccattcccacctctcccggcagtgcccccactacccttcccagcctcggtaaccatccttctattatttatgtccatgacttcaatggttttgatttttagatcccacaaataagtgagaacatgcaatgttggtctgattgtgcttggcttatttcacttgacataatgaccatcaatatggttgcagatgacaggatcttggcctcgtg

SEQ ID NO: 600245 - DNA, 196 bp, Homo sapiens
gagcccagacttggcaaatggggggaattttcataaaggggatgaaaatttccttggccaggggaattattttcccctgggttttttttttttctataaagggattcagaatttttctggttctataaaattatgcaaaggattggggcaaaactgcctccatttgttggctattaaagggccccttggcccttta

SEQ ID NO: 600246 - DNA, 124 bp, Homo sapiens
  misc_feature (30)..(30): n is a, c, g, or t
  misc_feature (116)..(117): n is a, c, g, or t
gggcgtacgccatggcgcccagcggaatgnatggtcttgaagccccacttcacaaggactggcagcggctggcacgtggttcaacagcggccgtaagatcgcagacgtaaggcccnncaagcaa

SEQ ID NO: 600247 - DNA, 624 bp, Homo sapiens
gactattgctaactaacccatgggactcccactaccttcatgaggctcagatgaggtgaagggtccctaaaatcgtgccaactagtcaggaactcagttgtcaataatttctttatttgtgatacaagcaggcgtggggaaagagaaatgaacagacttggaagcttctccgaggccctagagaagacctctgggttccgaacaccagacaccaggagtaaggagggtagttgatgatttcccactctttctccagcccctgctcctctgtttctccccttcacccactgcagcttcctcaggtcctgggtcccgcgccatcatctcttcgaatgacctcccttctattcctgttaataaaggagcatcagctaagtgaatatggtgatttgcatacacttacattgattcagaaattgtgtttaattccacacaagaaaaagaatgtggatctttttcactgggaaaaaaagtcgccatgtatcatcttaatcatgttttcctgggatataatctatacgtgacgcccatttaagccttcattgcatctatgcacgtggtttgctttcctcttgtgtgaaatagtttggaccacacgggtttgggccacagcccaggaagact

SEQ ID NO: 600248 - DNA, 461 bp, Homo sapiens
gtctagtcttcctttgtatgacttcgtaggttgtgattgatcattttcttttcaccctgtaagtgaatccctgaacttggttccctctgaagccagtcttggttaactaattctattttactataactttaaaagtgaaagatattctctaaatttatagcaggtgccttatttcctttgaatcaaatcattccataccagaatttcccttggtttactatagataattggctttaagatattcttgtttttaaacatacaatgttttaattattttgttaaattgctgtagccatcaatcatttcacatttgtaaaattacattccctttgtatcatgtaatttacctattcagtgcattttatattcaggttggattatgcatatttgggtcaatgaaagttgtgtctgtttgatttatggtttaaaaataaagttccctggatatttgatgctgttgt

SEQ ID NO: 600249 - DNA, 149 bp, Homo sapiens
ctatccgacatcacataggactggtgaggaaatcctggctcccacaattgctccttcgtccagccctgcacgtctcaattaaaataatgctttcttttttcttttcttttgtttgagacggagtcttgctctgcgcaccgggctgtgtg

SEQ ID NO: 600250 - DNA, 256 bp, Homo sapiens
gtaaatagttggtcattgatggagggaaatcattgtttatgataaacatatggaagagggtgaatttgtaaatgatcacaatttttaatcaaatcatacgagtcttataaaagattttaaaaatgtgttttaatgaacgaggcttttaaagtcaaggtacagtagaaattttaaacgaaatatgattatattagtcggcgaataggggatatagtccgaattgtcggctgagaaggatcaactgaccaagcaattt

SEQ ID NO: 600251 - DNA, 190 bp, Homo sapiens
ctgggtgcagtggctagcctagcgacagagcgagactccatctcaaaaaaaaaaaaaaaaaaagattacttatggtttgaaaggctttgacccagtgtaaaaaaaaaatccacattatccatggccctccaaaattcggaggggctcaaccctctcagaatgtcggtggtgtagttggcccggttgaaaa

SEQ ID NO: 600252 - DNA, 968 bp, Homo sapiens
  misc_feature (79)..(79): n is a, c, g, or t
  misc_feature (195)..(195): n is a, c, g, or t
  misc_feature (243)..(244): n is a, c, g, or t
  misc_feature (248)..(248): n is a, c, g, or t
  misc_feature (258)..(258): n is a, c, g, or t
  misc_feature (275)..(275): n is a, c, g, or t
  misc_feature (305)..(305): n is a, c, g, or t
  misc_feature (327)..(328): n is a, c, g, or t
  misc_feature (330)..(330): n is a, c, g, or t
  misc_feature (347)..(347): n is a, c, g, or t
  misc_feature (353)..(353): n is a, c, g, or t
  misc_feature (355)..(356): n is a, c, g, or t
  misc_feature (366)..(366): n is a, c, g, or t
  misc_feature (369)..(371): n is a, c, g, or t
  misc_feature (380)..(380): n is a, c, g, or t
  misc_feature (399)..(400): n is a, c, g, or t
  misc_feature (415)..(416): n is a, c, g, or t
  misc_feature (426)..(426): n is a, c, g, or t
  misc_feature (469)..(469): n is a, c, g, or t
  misc_feature (496)..(496): n is a, c, g, or t
  misc_feature (509)..(511): n is a, c, g, or t
  misc_feature (555)..(555): n is a, c, g, or t
  misc_feature (642)..(643): n is a, c, g, or t
  misc_feature (932)..(932): n is a, c, g, or t
ggcctggaggggctgggaggcgtccggttttcagcagaggattttgcagttcccaaggggacaggaaatggagcctgtnatttcggttgcagagagggggatggccgacactcttattttctgtatcgtttcttcctcccagttagtgcgctgcaggatttgtgaaaatccatcttgaggactctcctagataanatcaaagacaaaattaaagagagagacaaagaaaaagagagagaaaannaganacataaagtnatgaatgagatccaganagagaatggagaagtaaagattttgctganaagtgggaaggagaaaccaaanncnaatatagaagacttacnaattancnngcgtaaagcngannnagacaaagncacacaaagagaatgacanncggaagcgtccgacnntgtatagccnatctattcagaccatctgctcaggattgctaactgatgttgangatcaagccgccaaagcgcatcctacntgataacctaccnnnttacgttgggaagcctttggctaccaagacctatgattcccccnttccagagacccgtgagtttccctttgtctcattaaaggagccacgagttcagaataacctcaaaaggttggacactttggaatttnnacaactcattcatatagagcaccagcctaatggaggtgcatcggttatccatgcctacagtaacgaactctcccacctgtctcctatggagatggagaggtttgcagaagagtttgtgggtctagtgttcagtgaaaatgaaaactctgcagctttctacgtgatgggtattgttcatggggcagctacttatttacctgactttttagactatttttcatttaattttcccaattcaccagtgaaaatggagatattgggaaagaaagatatagagacaacgactatntccaattttcatgctcaggtaaaagaacgtattctc

SEQ ID NO: 600253 - DNA, 369 bp, Homo sapiens
atggaatattactggccataaaaatgaaagtaataataccatttgtggcaatatggatggacctagagattgtcatattgagtgaagttaagtcagacagagaaagacaaatatcatgtgtatatgtggcatctaaaaaaaagactacaaatgaacttacctataaaacagaaattgagtttcagagatagaaaataaacttatggctattggaggtcaagggaggagggataaattggaaggctgggatggacatgtacacattactatatatcaaatagataactagtaagaacctactgtataaaacagggactcttctcaatactctgtaatggtctaccactgatgagacgtataaaggggtag

SEQ ID NO: 600254 - DNA, 162 bp, Homo sapiens
cgcttgtcagcatcagaacaatttcatcaatatcagacatcttcaaatcagaatcttccaacactttcttgacgggcttcatagtagacctggaacatgatccttgttgagctctatggatactggtgctggtttgtgtggtctcagaatattcatgtcctg

SEQ ID NO: 600255 - DNA, 2740 bp, Homo sapiens
attgtaaactagtttttggtttgcaaaaaaaaaaaaaaaaaaaaaaaaaaaaaaaaaaaaaaaaaaaaaaaaggtcttttgtaactgacttctttcacttagcaaatggaagggtttttgatggaatcttagctcagatgtcgccctaggcttggccttctggaactcactgttctcttgcttccttccaccctgcctccctacccgctttgctacaagaagacagaatgtagaaacccccagttgactttttgagtagaaatgagccatgttctatttagtggtagaatgtttgctgggttagcccaggacttcagatggagtgcttcctcctttttaataccttgtgactgctgtgttggcaagcagagggttaaatgctgcaggaggacatgggagagtttttgctttgagggtccactggagcaagagaagcttgagagtctgtctctgagatcccagaacagacatgaagatatggtaccgattcccttggtgctaaaaggaactccaggggaatttcaggaaacccctccttttctcgtctttattctcaccccgtccccccgccacctctctccccaagttcacactcaggagggaggaatcttttaccttttccgttctgggcagcagcctgtagggaatgttatcagtgttgggactgggcacgggaccaagccttcctggtgcctggactgcaacctagctgagagctgacatggcagggcgagttgtgtgtgagttggctgcccctaggctcataggcctagcacaatagagaccctgtcaatggagggacactatcaggcaggtcactatcaatgtgacagacactatcaggcaggtcacattggtgcagatccttggaggactcccccccaccccccatgagtggattcctccaggtcaggggctggctgggactgtggatgctggagtaagtggaattgtgggtgcactctgcttcagcagtactctccaaggagaatgattgttttaataaattactgttttaataagggaggtggaagagctttttaatcacttgctttttaaaaatttttaattttattttaattaattagtttatttattttttgagacggagtcttgctctgtcgcccaggctggagtgcagtggcacgatctcggctcactgcacctctgcctcctggattcacaccattctcctgcctcagcctccagagtagctgggactacaggcacccgccaccacgcccgactaattttttgtatttttagcagagacggggtttcaccgtgttagccaggatggtgtagatctcctgaccttgtgatcctcccgcctcagccttccaaagggagggattactggcgtgagtcaccgcgcctggcctttattttttatttcttttgagatggagttttgctctgtcacccaggctggagtaccggtggtgggatctcgcctcactgcaacttgcgcctcccgggttcaagcgattctccagcctcagcctcctgagtagctgggattacaggcgtgtgccaccgcctccagctaatttttgtatttttagtagagaccgggcttcaccatgttggccaggctggtctcgaactcctgacctcaggtgagcgtcctgccttggcctcccaaagtgctgggattacaggcgtgagccactacacccagccaatcagttgcttttaaactacttaaataaaaagagccaacccaaaatcttgtgcatgcttgggaaactggcagtggaatatgagaagtttttatttgtggtgcacacaggtgactcgggctgttgtgtattggttcttgcctcgatctgtagcaagcaatctgttgtttcttgcctgccttttgggaagaaatgaaaaaagaagcagcacgagtctccatacatcatgattgtgatggcactgggcctgagaccttttctgctgtccaggtaaaaatgtgaagaccatggttttgaggtttcttaataaattcaggtgttaagtgccaagtgatgctcccagcccctgagctagagcaactatgctgttcatgtccccaggaatggaagtggaccctagttaggtgctggtggccagccatgtgtacctagggcagggccaggtcctgtgtgtgtgtgtgtgtgtgtgtgtgtgtgtgtgtgtgtgtgagagagagagagagagagagagagagacagagagagagatagagagaaacataaaggtgatcggcactcagacatcctgtgtggtccacctcacttctcaagcaggtgtctttccagtctacaactcgttgaccacaggtggaattcataagctctgttccctgtcctgcttgggtcctccagagaaagaaatgttgaattatcatcttggtgatggtcaactctgaaagcctaaattttcatgatcaccaaagtgtttggatttaaaagggtggctcactccgtaattccggcactttgggaggctgaggcagaaggatcacttgagcccagaagtttcagactaggctgggcaacaaagcaagacccggtctctcccaaaaaaaaaaaaaaaaaaaaaaaaaaaaaatcaaaaaaattagctgggggtggtggtgtgctcctatagctccagctactcaggaggctgaggcgggaggatcgcttgagcccaggggtttgcggctgcagtgagctgtgattgcaccactgcactccagcctgggcgactgtgagaccccgtctttaag

SEQ ID NO: 600256 - DNA, 1040 bp, Homo sapiens
gcccaagttggaggctgatctggagaagaagattcaaggtggcaaagctcggctataagaaacaagaccggaggacggcaaaggatgtggtggagaatggtcgatggacgttgctgaccagaccctgtctcttgatggagcagctccgtgggggaggcgcttaatggttccacaagactctggtgagaactacatagagcccatggctatgtggtcactccaccacaccatgaatctactaaagcagcacctggagattactggtggggcacgggtacgtacccggatcccgtcagaatccaatggaatcctgcatattggacatgcgcaaggccatcggaattacaactttggctatggacaagggcgaaaggaatggctatctgttttcttgcagtttgtgatgaccaccacaccctgagaaggagggacagcaccaagattcttcacggacatctgtgacatggtagtcctggcttatggctacaaatcttacaaagtcacattatgcgtctgactattttgaccagggtaatatgcgtggagctgcggacgctgcatccgcaggggtctggctgattgtgtgccagcagcgaggagaggagcttcaaaggccataatactcctgtcttcacctggagagaccgttccatggaggagtcacgtgctagttactttgaggcatgcgcaagagaaagtgtccgacgtgcgcgaggacacactactggattacgctggtgatgtacggacggcagaaggaaccgagcctgccattgatgtcaagtatacacgaatggccggcacgggggaacgggggctacccacttagattaacgcacgctgttgatgcgtcccgcgcttcttcgtctctctgcgccacgagtcggcgcacggcgatacacacaagggaccgaccgagtctcgcccggagtgggcatcggcccacgcaaagagctggtcaaagcaacacactgcaggcgggggggacacaccacacgggcaagggaccacacaatctgcggacggtcacacaccactct

SEQ ID NO: 600257 - DNA, 676 bp, Homo sapiens
gctttacacggtatccacaaggttcgaaggtgtaggaaattgggatcggatcccatttcaaacagggtgagccatggcatgatcccacaagcccaaaattacccctccttaaaggatcaaaaatggaggtgcagctgggtgacaacactctaaagtaggggatcctctgtttgcagtaattgggcctaggacctgttcacaggctttaaccaaagcgcacaaaactatgacctctaaggtttcattggaaataaagtgttctgtgcaccatccatttcagtaaatgatttcactgggttcgcaatccaagggttcacttcatgaggtctgatgttagagctaagctacccttggcagtgtgctttggtgagcatatcaattcacaaatgtggtttcttcgggaaataacaatctcctttacagatagagcgtccttacgggctttgaaacgtgcaacaaagaatgcctgtgctgagcagaatgtagcagatctaattgcataatgattgagaatgtcgtttcaatgatgctcatttcctgtgaaaagcttttaagcgcatgtacatccataatcctagtttgagtgaacacaagctgaatacgcagcactgttgtttataactgttattttaaactttcgggtcccaggtctgtatcgctataagtgtttactagc

SEQ ID NO: 600258 - DNA, 338 bp, Homo sapiens
ggccagtgttcttatgattcataaaaccttacatgatctgggccgggcatggtggttcacgcctgtaatccagcactttggtaggctggggtgggcagatcacttgaggtcagcagttgaagaccagcccggccagcatggtgaagccttatgtctactaaaaatacaaaaattagccagacgtgatggcatgcacctgtggttccaggtgcttgggaggctgaggcgggagaatctcttgaacctggaaggcggaggttgcatgcagtgagccgagatcgtgccattgcattccagcctgggggacagagtgagattctgtctacaaataaataaat

SEQ ID NO: 600259 - DNA, 160 bp, Homo sapiens
accctggttaattggcactgctcctctcacctcaatgcgtaatctcctgatgctcatgaccagccttcggccatactctctgtagtccacgggcttcacgtccatcacagtggccttaattcgagactcgtcgttgtaggtctccactttgaccctgact

SEQ ID NO: 600260 - DNA, 789 bp, Homo sapiens
gcggacttcgacacctacgacgatcgggccgtacagcagcttcgcgcgccggtgggagagtgtcccgcggcagctgctggctgtggccatggttcccgtacccaagaaggagttgtcccacagagctccccctacacagtataccgtagtgaaatctacctttcaatacggtccagggcgacatagatgctatctttaaggatctcagcatcacgagtgttcggctagtcagagacaaccgacaccgatgaatttcaaggattctgctatgtcgacattcgatgaagtggattcccttacggaagccttgacatacgatggtgcactgttgggcgcatctggatcatcttcgtgtggacattgctgtaaggcagaaaaccagatgaaggtgtgctttcgtcacttcagaaataggtggtatccgacgtagtgcatcatgatgcggcttcagggagtgacttcttactggggcaggggaggtagtcgcccaggcgaccggcgtaacaggcccccccatggggtcggtccgctttcagagatggccctcccctccgtggatccaacatggatttcagagaacccacagaagaggaaagagcaccagagacctacgactccagcttagacctcgaacagtcgcgacgcccctcaatcaagtagccaatcccaactctgctatcttcgggggtgccaggcctagagaggaaagtcgttcaaaaggagcagaatgagcctgcggtgggaggaatggggcgtgggggtagatgcaggccacaggctggtgattcc

SEQ ID NO: 600261 - DNA, 132 bp, Homo sapiens
taagtcggtacgcgttactgactcacagttcagcatggctggggagacttagaaaagaaacacaatcgtggcagaaggcaaaggaaaagcaggcaccttcttcacaaggcagcaggaaagtcagtgcgtatg

SEQ ID NO: 600262 - DNA, 1092 bp, Homo sapiens
tatgtcctcatggtacccaattctaatcgcaaggcattccgtaagcttaccgaacgaaaaattctaggctatatacaactacgcaaaggcccgcaacgttgtagagccccctacgggctagtacaacccttcgctgacgccataaagactcttcaccaaagagcccctaaaaccgcgccgacattctaccagcatcctctacatcaccgacccgacttagctctcacacatcgctcttctactatgaaccccccctccccatagcacaaatccacctggtttatccgtcaatctaggccctccaattaattctatacctagactttttagcctagtctcgtacaatacaaattcctcgtgatcagtgatgagcatgcagaacgtacagagacgtaacgtcgcgctaatcggacagcacctgcgaatgccagtagaccacaaaacagatctcgatattgatgtctagccaaagtccgtgattcaaaactagtacaacatcagtaataactggttgccatcaacctctcacagccccttatcacagatacaatgaatctagcctctgtctgacgtcccgtgtacatcatgacctctagggccataaatatgatgatatctaccagcacatacgtcaataggacacataccgaggccggctatcgaactcgcgcgaaggggagtccgaggtagtctccggcttcagcattcgaatgacgccgcaagggccctgcgccctactccttcatcagccgaagtaaccgaccggtcattgatacatgacaagagccccatttacataacaatactgcgtaggaaccactatatgaggcacgctagacttgaaagtgctacgaaactaatctggtcaccaaaagcctagtgtagacacacctgatcttattgcattgcaagggatacccgaataccagaacaataaacactccttggaacaggctacaataacgacgcgcagataaatagccaccataagccgcaccccgacgaaaaagacgggccacacacccgagacaacaacgccgaaggcacaaggataaagagcgcaacagcaccgcctagcaccgagaacacacg

SEQ ID NO: 600263 - DNA, 383 bp, Homo sapiens
taaaaatgaattggatttaaccaaaattaaaaacttttttgggtaaaagtaaaccaccaagaaaatgggaagacaacccacagaaggggggaaatttgttaaccaaaaaccggataagaacccaggcggcggtcaaaatgtttatgtccccccccccccaattcatatgggaaggccccaaccgcaagggagtgggattagggcaaaaggaaaaggaggggggcccttggggcactgtgggggggcccatgccggaaaccccagcactttggaaggcggaggcgggaggattgcttgggcccaggagtttgagaccagcctgggcagcaaggggggaccccatttttacaaaaatttttttaaaaaaagaaaaggggcccaag

SEQ ID NO: 600264 - DNA, 123 bp, Homo sapiens
ttactactccggaaaaaaagaaccatttggatacataggtatggtctgagctatgatatcaattggcttcctactgtaaatatatggtgtgctcacacgataaaccctagggtcgacgcggcc

SEQ ID NO: 600265 - DNA, 473 bp, Homo sapiens
  misc_feature (253)..(253): n is a, c, g, or t
cctttctctctgggtatttggtggttcttttgatgctattataaatggtattactctttgatttgcattttctatttattggctgttggcacatgggaataaaatgaatttttgcataaaaatgaaagtcggagggtatggggtggtggcgggggcgagtgcattaatgcgggtcggcattgaacatcaacagctgttaatatcacagaaaggcagcggggatgaggtgctgcgaaaaggaatggagcagcangctgatcaagcgctctggcgtccgaggggcagatgtgtggggagcacaaagaatggagaaagacgatcttcctggtgagagtgtaatcagcaaaactgctactatgggaaattctacatatggatcaagatgctccaggctcttgaacagatcaactctaaggaaaataaagggatgcacagggaaacctgtggattaaaagagatttggaagacaaaaa

SEQ ID NO: 600266 - DNA, 174 bp, Homo sapiens
gtccaagcgtactaccccagctcctgtcaaagttgtgactgccactttgcgatagattaagaaggccccgtggactgttggtcttgaagagtggcagtgtgtgcatttgaggacctctgcagaccatcatatcaaaggaggtagagctgttttgggtactacgctttggcaggc

SEQ ID NO: 600267 - DNA, 674 bp, Homo sapiens
ggatcccccccccccggggagacaaaggcaagagggtgctgtaaagggggccgaccagtgggggtcagccccccctgccccaaaggagagaaccgcagataccccccggagaaagagtgaatcccgctgccaagctcacacccgggggaagtacagatatcccgccaaccccgcgcagttagaggagctcctaggataacaaccccccctggtggcgtgccgctttttacattggtacacgccgtcggttgaaaaacagtgaggggcaggtcaggagaaacacgtgttcgctggcctttgtgtgaacaccctcccataagggggtgtgtggttcaggaaaagttctgaaccccccctgtgcccgggatgttctcatataagccggctagtaccccagcactctctcgggcaccccaacgtcgagcgcacctctcccatcagccgggccgtgagtcacacagggaataacagaaagcattggcaccacaatagccagccttagtcccacaaaagttcactagtacggcgcggaggaggagcaaccagtgtattgaccacccctcgcatcctcggaggcgtgcgtgaagcggtgcggtgacccgacaccgcccgcccaccaaggcttaagtgcccccctgacaggcagagccagcccccccgcccacaaagacaaa

SEQ ID NO: 600268 - DNA, 126 bp, Homo sapiens
gccatttaaagcccaaaggttgcccggggcccttaaaaaattaaaaaaaattttcccccttaaaaaaccccttttgtttaaagggttttttcccttaaaaaaaaatttttagccattgggggaata

SEQ ID NO: 600269 - DNA, 493 bp, Homo sapiens
ttattgtaatgcatgtagataacttattatcagcataaaactgttatggagatttcaacatggggtcttcagctcctaaaatgaagcgaagctttgcacgtccattgtccaataggaaaactattatactctctgttcagataaaggcctttaaaaaacgtaatctctcttgaaacggacttttaaacgtctacagcctgcaagggtccccccaggtggtgttgctgtccttctccaattgcgagtctgttgaatgggatcatcttcatagcggatgatattcatggaactccgccggaatccccaagtggcccaactagtgccatcatcataaccattaggagtggatgctcttgagtgagtgccaccttggccactgactccatcgatatggccagcgtgacacttgttcatccaccaacccgatccattctggtcagcacagttgccttcaagctcatcatttgcatttgtccaagtacctgacttgcac

SEQ ID NO: 600270 - DNA, 210 bp, Homo sapiens
gacttttggaaattagtgcagtgccactttcagatctcttagaacaaacacttgaacttataggacaaatatcaattgaaacccatattggttagggagcaagagacataccattacatcttcttatatccacatgtgagcatttcacatatagagatctatctctcattgaagcacacatgtagtctcgctgtgcctcggtgttgaaga

SEQ ID NO: 600271 - DNA, 525 bp, Homo sapiens
  misc_feature (24)..(25): n is a, c, g, or t
  misc_feature (28)..(29): n is a, c, g, or t
  misc_feature (135)..(135): n is a, c, g, or t
  misc_feature (144)..(144): n is a, c, g, or t
  misc_feature (259)..(259): n is a, c, g, or t
  misc_feature (283)..(283): n is a, c, g, or t
gggatcggggggggttgagagggnnggnnggctgccgcatccctttttttggaattcattcagaagtaacttactttttttctatgcctggggacattattttctatacgggtgggggtggtctgattacaactnttcaatctnctcaaattctttcccctcatctgagtgcttctttttcttttgtgggtacttttcacgaagcagaatggtggccactaaaaaaatcacctcaaccactattgcaagaaatggtttnaggggcaccaggggggggggccanccacaagctcaatgtggtcttcactctcgggtaaaggggaatagtccatcggcacccataaaaaccccccctctttccttccaaaaggggggtaatcttgcagctttggttgcattaccgttatgggccattggtcacatatttatgcattgggaacaccaagcgggaaccttgtcacctcccattgcttatttggccgagggcgaattttaaaggaatacgatttgggacatttacgaggt

SEQ ID NO: 600272 - DNA, 343 bp, Homo sapiens
ggatcctatgcgcgacgcttccatcaagattttgctctgggggcaagaataaaaaaaagagaggctaggtgtggatggctcatgtcctgtaatcccagcactttgggaggacgaggagagtggatcacgaggtcaggagattgagaccatcctgacctatatagtgaaaccccgttctctactaaaaatacaaaaattagctgggcgtggtggtgcatgcctgtaatcccagctactcgggaggctgaggcaggagaatcgcttgaacccaggaggcggaggttgcagtgagctgagattgcaccacttcactccagcctgggcaaaagaacgaaactctgtc

SEQ ID NO: 600273 - DNA, 473 bp, Homo sapiens
  misc_feature (17)..(17): n is a, c, g, or t
ggatacgggagttcctnccttgctctcgccccgtactctttctggtgttagatcgagctaccctcgtaaaagcagtttagagtggtaaaaaaaaaaaaaaacacaccaaaaggctcgcgagccacaaaggggatgaaatttctttcgtggacatcctccgggtttctcccgttacggatcgtctggcgtccctagagtccttcgtggaagctttttaattccctaagagggagaaattcaggtcaccgggcggaaatcgtggctggataacacgggacgctggggcttgggacatggggacgactggactggcgctatgaattcggctaaaccttacaaacgcaacgctgggtctctctgggcgatataaataacgcttgggcctgggacggaaacaggctggccacaatggcacggggacctggggtgccaagggttctcataccctctggcgggtagactggcagcaaccg

SEQ ID NO: 600274 - DNA, 178 bp, Homo sapiens
actctctgatgtggtctcagtggtggtgattgaagaagtgaagccgggagtacttgtgtagaggtagtctcagtggtgttgcattgatgaagtgaggcccggagtaatgtgtgaggtggtcttggtggtggtgacccatgaatgtgaggccaggcgtactgtgtaacgggggtctcag

SEQ ID NO: 600275 - DNA, 277 bp, Homo sapiens
tggagctggttttctcaccataaacaaaaatcgagccaaaatagattagttaatatatgacccaaaactggccgggcgcagtggctcatgcctgtaatcccagcactttgagaggccgaggtaggcgaatcacctgaagtcaggggttcgagaccagcctggctaacatggtgaaaccccatcactactaaaagtaaaaaaactagtcgggcatggtggtgcatgcctgtaatcccagcaactggggaggctgagacaggagaaaaccaggctccag

SEQ ID NO: 600276 - DNA, 770 bp, Homo sapiens
  misc_feature (118)..(118): n is a, c, g, or t
  misc_feature (238)..(238): n is a, c, g, or t
  misc_feature (248)..(248): n is a, c, g, or t
  misc_feature (524)..(524): n is a, c, g, or t
  misc_feature (528)..(528): n is a, c, g, or t
  misc_feature (624)..(624): n is a, c, g, or t
  misc_feature (627)..(627): n is a, c, g, or t
  misc_feature (633)..(633): n is a, c, g, or t
  misc_feature (638)..(639): n is a, c, g, or t
  misc_feature (653)..(653): n is a, c, g, or t
  misc_feature (656)..(658): n is a, c, g, or t
  misc_feature (664)..(664): n is a, c, g, or t
aagtattatgtaacaaaacactgtaactctggtaaatgttctgtgtgatgttaacattccacagattctacctttgtgtttgttttttttttttacaatggttttaaagccatttcantgttccagtggtaagataaggaaatgtgataatagctgtttcatcatggtcttcaggagagctttccagagtggatcatttcctctcatggtactctgctcagcatggccacgtaggttnttggttggtntggttggtcttttttggagacggagtctcactctgttacccaggctggaatgcagggggcaatctgggctcactttaacctccatttcccgggttcaagcaattccccgtgccttggcctcccgagtagctgggattacaggcacacaccaccacgcccagctagtttttggtattttagtagagacggggtttcaccgtgcaagcccagtggccacgtaggtcttaaagcaaggggcgtgaagaaggcacagtgaggtatgtggctgtctcgggnagtncatgcggactaaatagacctggattaaatttcaagaaggttggggattttctctttgttggacccttctcttttagagggtaacatattatgtttngantgccangatgnntttttcacataatntgnnngtcccnggtggaaattataatttacccaatttaaaggtgggaaatgttttggtgggcctaacggcggggaggggggggaaggacaccttcataaaggggggaactcggttga

SEQ ID NO: 600277 - DNA, 188 bp, Homo sapiens
ttgaacgggttctttgtgttctatttccttcagccttcgtctgattttagttatttctctgccttctgcctagctttctgaactgctgcgcgcaggcgcgcatgggcggactccctcctagcagctcgaccatgcagagcactgccaacgcttgcgccactaggcccgctcgcttcttacacacgctc

SEQ ID NO: 600278 - DNA, 633 bp, Homo sapiens
ttctgatccagcgtagaatggatgtgcccagtgactctggtactcatattggtatgttaataatcagggctaaaccgaggtacatgattatgtgtaagttcagggcttgacccccacccccttctaaactatgcctcaatttagaagtgttaatctaattctgcagtaggatcaaactatttctgtatcatatgtaatcatctgttatagtgacagattccagctggtgaggtagagaaaggcatatggaagagacggttaagcgtttttacaaaagtgcttctgaagcactagctacaagggagattctagtgtatctcaaaatgaaagtcaagaatggtatatgtatctgtagccacaatacaggtctcatataagcgtagtactagctccgtatattaggtagtcaatctaacttcaactttcaagaagttcataagcttaataaacttagaatgtcaacttgataaaatgaaagagaaaacttcagcttgaagtagacaactgtaatattattactactttgattaagttacttttgtgctttaagcaaactccaaaagttagcagagtcctccagtattcaatataccagcctctggacggttgggcccctgaaatccctggtattag

SEQ ID NO: 600279 - DNA, 110 bp, Homo sapiens
ctaccggatgcttatggaattgtgctggcgtaagggaattctcttagcacaggacgaattccttagcaccagcacaattccttagcacaggacgaattcccttagcacca

SEQ ID NO: 600280 - DNA, 993 bp, Homo sapiens
tctgttgtaaattagtggttaaggttatctatattgccacttttccagcgctaaaggctgtttgggaaccagtgtagcttgtaccgcgggtgattggcttttttttctttgggcaaaccagttattcaagtttctggtctttaaaaaaattctgtggcggtacggtaaccgaggaggttccagcgcggtggaattaccccgcggttggtttgttttgcgcaaggccaggcccagaggggcacgtggccgccgggagggacgagagaatgtcttttcgaggcggaagggtcgtggaggctttaaatcagaggtgttggaggtaggcggctttcaaacccgagggcggcagcaggcaacccaatttccgaagggtggagcgccggcggtggagaaggcagggcggggcacatttccaggagggccggcgggcagggacacgggaatctctggaccacaaggggtgttggcccgggagagcgggttttaaacgcaaaaggggcaaagaacccaaggggaccctcccaagaaacggttggtagttccataatttaagggaagagttcccctgcaatcccctttgttgaaggcattcacccatacggtgctgcataaatttgttccccccgaggattgacaacaattacagcggtggcgttatatttccaaaagtgctccccttgttttagctttagaaagacaaccgaagggacccaattgtgggcaacaacgtggctttggaacaattttttttgggcgcaactccaagaagaatttttaattttttcccaggttcaaacgtttgtccagcagcacaattgaagggggttcaattccctttaaaaaaaccttcagcaggaggttattattatttgagacccatataataagtgggtgccacgtagcgaaaaggttttttacctcgacctctccaggtaagaaaaggcctccagagggtggtgacggaggcccagaggagaaatcgatcggtgtccg

SEQ ID NO: 600281 - DNA, 216 bp, Homo sapiens
cacgaggcggggccccaagatgcacttaaagcgtgttgcagcgccaaagcattggatgcttgacaaactaacgggtgtatttgcacctcgtccatcgacaggtccccacaagttgagggaatgtcttcctctgattgtcttcctcaggaatagactcacgtatgcgttgactggcgatgaggtaaattacatatgtttgcaacgtttcatcaaaat

SEQ ID NO: 600282 - DNA, 192 bp, Homo sapiens
cgactctgaggatccccttcgtccactcagatctgtgtggagcctcggcgtgtgcatgcacacgccgaacaaccaaactcgcggacgtatgggaggtcgggatggacgaagttgttgctgcacacgccgaggccccatactttttttaacctttccttatgagcatgcctgtttggagtttcggcgtgtgca

SEQ ID NO: 600283 - DNA, 229 bp, Homo sapiens
gagaacgcgaacgccccgacgagcacagagcctcagactctttgccgatccgtcgcccggtcgcacagctcctgcgcgtcgcaagacatcaccaatggatgatgatatcgccgcgctcgtcgtctgactaacggctccaggtcatgttgcagaggcacgggcattcggcgaggcagactgagtgctcgcccacaggtgccggtcgttccccatccaatctgtggggcgc

SEQ ID NO: 600284 - DNA, 514 bp, Homo sapiens
gagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataccatagggcaggctgcctaatattgttttttttgaagattgaacaacaattttttttttttccactcgaagaacaaccttacttttgctggaccaggtttttttaaggggtgtcctcttaaaaaccccccctgggtcctttgggggggg

SEQ ID NO: 600285 - DNA, 316 bp, Homo sapiens
agtacctcgacgcccatggtggcctggcacggcgtcacgcccggcgcatgcagcagcggctaaacctcaagtacgctgtggacatcgatataggtgcacacatcgcgcccgggctgcgcatcgcgcacctaccgggggtagtgatcacccggcacgtgcgcatcgggcgcaatttcttcatccggcagaactgctcgatcggcatcaagacccttggcctggaggaatacgcgctgcgcattggcgacaatgtgagcatgggcgccaatagctgcattgttgccgatcgcatcgatattggcgacgacgtggtgat

SEQ ID NO: 600286 - DNA, 346 bp, Homo sapiens
atctacaggacctgacagcatcctaaccaggacactagtcttggagcctgtaaagtttcacctccctcggccaggcgcggtggctcacgcctgtagtcccagcactttgggaggccgaggcgggcggatcacagggtcaggagttcgagaccagcctgaccaacagtgaaacccccgtctctgctgaaaatacagagattagccgggcatggtggtgggtgcctgtggtcccggctactcgggaggctgagacaggagaatcgctcgggcctgggaggtggaggttgcagtgagccgggatcatgccactgcactccagcctagcgacagagcaagactctgtctc

SEQ ID NO: 600287 - DNA, 265 bp, Homo sapiens
ccggggttgctgagagtgtttctgaccagatagctgatgtaccttgacagggagacactgagcaggtgcgccttctgccataggcagcccagctgctgagccagaaccgaggagcccatgggaaatgtgctgaccacggagttcacgctgacgccccaaatcttggaagttgtgtccccagaagcagaaagcaaatggaggctgtcggaactccaactaattgcgtgaatcccaccgccgcgggccttgcttccgcccagcgcgc

SEQ ID NO: 600288 - DNA, 385 bp, Homo sapiens
tatctgaaattggtatacagatgatgatgcacattcaggatcagcaaaccaaggagatctgtgcgctgggtgggttctcgtgaagaaggaaaaagaatgccatgcggattctggtccccgccaaagtggcctccaagaatgtcatccctgccctggaacgggtggagcccattaagaagcacgaggtcccagcaaagtctgatgtttactgtgaggtgtgtgaattcctggtgaaggaggtgaccaagctgattgacaacaacaagactgagaaagaaatactcgacgcttttgacaaaatgtgctcgaagctgccgaagtccctgtcggaagagtgccaggaggtggtggacacgtacggcagctccatcctgtccatcctgct

SEQ ID NO: 600289 - DNA, 252 bp, Homo sapiens
  misc_feature (204)..(204): n is a, c, g, or t
tcgtaccatgatttgtcgtatggacagacctgatgaacgagagtcccagtgcactcctaggaaggtgcagtgggacacggtgaagatggcagctgacactggagggggcctgtgcgtcccaatgtgagtgatgctggaattccaaggtggcttgaccactccaggccctgtgggttcacccaaggcatcagccaagctctcctnctagctccagcccctagtgctggtgagaagctgcttgaaactgagact

SEQ ID NO: 600290 - DNA, 538 bp, Homo sapiens
tgaacaatgtcgctgtggatcccacctcattctgcaaaatttgacgcatgttactttcatatgatttctctaactctgcagcagcccacttgcttgcagccttagcaagtgccttgttagttagcctactgggtttgtgtaacacctttgatgaagaaactgctgaaccacttgagggtgaagtatctcttgatgttttcaaagactggacaggcctctctttatctatgtcaggatttacttcattctgccgtttgtgggaggcaccaagacgcacggactttctatgttgagactgatggaaagagtatgatttgctcctttctggagagtagcttctgctactgacactggaaccagatctgctgtgtggagaatcctttctgccaacaggtgattctctgaaaaaagtattgtcccttttataaggagaccgctctctcgcattaatgggaagagtagaaactttttcttctaaagccatctctcatgtccctgtattcaagttgcctgcttgcagaatgatcgtctcttgtcc

SEQ ID NO: 600291 - DNA, 613 bp, Homo sapiens
cgacgcatcacacagtgtctattggctggccggtggtagagagtggaattttccacttctggcaaaaaattgtatttaccaaagggtacttcatttcactgtgggcttttggtctgggtcatgaagcattttatagaagtgatggcagccagggtgtactaacatccttggggcctcgggaacgtttggccagagtcggttcacgaaaacaggaaaagagatccttctagtgtattcccatttctcgctgtcatgaggccacagacggtttcataaccacaaactgagctgctaacctcagtgaggaatgtccaaagactccattcctcccacggctgaaaaaataggtcatcgggtgcgtggggaatctgcacatttaattgtcattttttaaaagcagcaaagagcaggccttctttggttgttctcagacatctcgtctcagtggaaccttacgagaccaggagttaagacttgggcttcaaacaggttcgcttgcaaagaaaagtcctgggtgtgaaccaggacacgtaaaccagtccgaggcagggtgggagccacaacgggtaggggggtaaagaaaagggtcccgatccttagtactcaatgggac

SEQ ID NO: 600292 - DNA, 677 bp, Homo sapiens
ccccaaacccccccacaacatcctcaacaaacacgcccgcaccggcgagaatgccccaaacattacaaaaaagaaaaaaacataaaaccaaaaacctacacaccaaaatacacgaccataaaagacaacggcaacgaccggccagttctagcggtgaacttacgacccaccccaattctaggtataacacccccaaaaaacgacacctaaaaacatcaacacaaaaaaacgccccacaacaaaacacactcacagagtcactacatgaccccttacatctcgaaactccccgactatcattccacccactattgcactaaacagcctctccccaatcaaataaattatacagctgcccagaaatcgactatccacatggccgtgtaaagcagctcctataatagcagtagagaagtactccctaatagcagtagcggtcacaggcaaagctaaaatcattcctaaaagctgacaaattcgaggacgtgaaaggcgcccttccgctctgactacaatatgcgtaagactcttcagatctcctaaaccagtaaactcgctactcctttgaacaccgctaacgcaaagattaagtcgacgtctgagcgactcttaactaatatgagcaaaaacccgcggacaaaacctagttaactctacaatcccccatcgactaaatt

SEQ ID NO: 600293 - DNA, 191 bp, Homo sapiens
  misc_feature (31)..(31): n is a, c, g, or t
  misc_feature (65)..(65): n is a, c, g, or t
  misc_feature (122)..(122): n is a, c, g, or t
  misc_feature (163)..(163): n is a, c, g, or t
gcgctcgacaggcggagccgtgagaggcggnccagccgccccgcggggcggtcgcggccgtgacngcggctccggtgcccggtttcccttccgcgcccggctccccttccgtcgcccatccngccggatgatgaggggaagatgtccgatgtcaggactcaangcacgagctgaagctcttggcgtacatc

SEQ ID NO: 600294 - DNA, 124 bp, Homo sapiens
gcttggtctatcctgtatgtgtggtagggtggggggcatcatatagtcatccgaggtttcatggatgggttcttctaccatactggaaagaacctaagctacctggtggatccctctaaagtct

SEQ ID NO: 600295 - DNA, 369 bp, Homo sapiens
  misc_feature (303)..(303): n is a, c, g, or t
  misc_feature (323)..(323): n is a, c, g, or t
  misc_feature (349)..(349): n is a, c, g, or t
  misc_feature (359)..(359): n is a, c, g, or t
tagctcggacctctgatgcaaggtcgggatacaggtgtgatccactggtgccagcctgagagttaagttttaccttttcactaaagggtggtcacaggactggtcctatttggatttgatggggacagagcagtgtggcccatatttccattactgtattagaaattgcagagaagagcacctgaggacaggaaaggagaaacttgtattattatttccatagagcagcttattgttctgagtctcttctgttataaagcgaaagaaatgaagtgaactcttttcctgtagcgtcttgcttcntttggccaagtgtgactgtnggtggtagcacggtaacacaggtggntgctgacacnctttaacagg

SEQ ID NO: 600296 - DNA, 677 bp, Homo sapiens
  misc_feature (508)..(508): n is a, c, g, or t
cagacgacatgaataggtcggccaggcttggcggctcttgcttctctccaatggccgatggaccatcgcttgggtctccaaggaccacttcgctgggtcatgactcagccggcgcgtgtcgccggacaacagttcattcactacgcagaagcaaggcagggcagtatcggagtaaacgcggtccagttgtgatattacttgcccttttcataaccatgaggtaatattcaacttttgtggataccccgatgaacattcggttcacgcgacttgggacacaccctcattgggattttgaccaaaaaccacgaagccaggaaaacaatttgtatccaggcgtttaacttggcttttattcaaaattgttcagccctggattactatcctatacacacgcagatggggtcaccttcaacagcttcacaccagcgaacatctaacaagtaaccaaccaggccatacattgggcctccatttctgcgccttggcctaattccaagcgacaaanagaaccacttggggtccatttcccttaggaagaaacagcgcttgcaaacttttggccaaaaatccctgcaagacacgcccgcaaggcacactggacgacaccacgtcgcaaacattggtactttcagaacccaaaggttcacaggcaaccaaacttcacatggccttgc

SEQ ID NO: 600297 - DNA, 950 bp, Homo sapiens
  misc_feature (6)..(6): n is a, c, g, or t
  misc_feature (25)..(25): n is a, c, g, or t
  misc_feature (27)..(27): n is a, c, g, or t
  misc_feature (32)..(32): n is a, c, g, or t
  misc_feature (34)..(34): n is a, c, g, or t
  misc_feature (50)..(50): n is a, c, g, or t
  misc_feature (54)..(54): n is a, c, g, or t
  misc_feature (58)..(58): n is a, c, g, or t
  misc_feature (67)..(67): n is a, c, g, or t
  misc_feature (69)..(69): n is a, c, g, or t
  misc_feature (97)..(97): n is a, c, g, or t
  misc_feature (133)..(133): n is a, c, g, or t
  misc_feature (136)..(136): n is a, c, g, or t
  misc_feature (157)..(157): n is a, c, g, or t
  misc_feature (179)..(179): n is a, c, g, or t
  misc_feature (231)..(231): n is a, c, g, or t
  misc_feature (237)..(237): n is a, c, g, or t
  misc_feature (244)..(244): n is a, c, g, or t
  misc_feature (246)..(246): n is a, c, g, or t
  misc_feature (253)..(253): n is a, c, g, or t
  misc_feature (266)..(266): n is a, c, g, or t
  misc_feature (268)..(268): n is a, c, g, or t
  misc_feature (274)..(274): n is a, c, g, or t
  misc_feature (281)..(281): n is a, c, g, or t
  misc_feature (283)..(283): n is a, c, g, or t
  misc_feature (286)..(286): n is a, c, g, or t
  misc_feature (291)..(292): n is a, c, g, or t
  misc_feature (298)..(298): n is a, c, g, or t
  misc_feature (301)..(302): n is a, c, g, or t
  misc_feature (314)..(314): n is a, c, g, or t
  misc_feature (321)..(321): n is a, c, g, or t
  misc_feature (331)..(331): n is a, c, g, or t
  misc_feature (339)..(339): n is a, c, g, or t
  misc_feature (349)..(349): n is a, c, g, or t
  misc_feature (372)..(372): n is a, c, g, or t
  misc_feature (404)..(404): n is a, c, g, or t
  misc_feature (423)..(423): n is a, c, g, or t
  misc_feature (429)..(429): n is a, c, g, or t
  misc_feature (474)..(474): n is a, c, g, or t
  misc_feature (496)..(496): n is a, c, g, or t
  misc_feature (577)..(577): n is a, c, g, or t
  misc_feature (731)..(731): n is a, c, g, or t
  misc_feature (851)..(851): n is a, c, g, or t
  misc_feature (876)..(876): n is a, c, g, or t
  misc_feature (886)..(886): n is a, c, g, or t
  misc_feature (933)..(933): n is a, c, g, or t
tcactnaaaacaacacacatttatnanctcananaatttctgggggtcangaanccangagtcactnanctgggggttctggcttagggactttcanggggctgcacaaaaaaagtctactgggctgtgatcncanccgaaggccctactggggcanaggatccacttccacattcacncacgtggctgttggcaggaggccttagttccttgccatgtgggcctctccanagggcnccttaanangccaacnggcttccccaaantnaaaaanccaactnangtnaaaannagggcnaannaacaaaaaaaangccaaantgtctttccnaaccaaanctgggaaatnaggaaccaacacttctgcctcantctattggttacccaaacccaccctggtacanagtgaggggactgcacaanggtgtnaatactgggcatcactggggccatcttggaggtggaccaccaaanaaacaaacccttgtctcccaantcctgcagccttggcctttggccctcaggataagattgagtggaggctgcctttgggatagggttgctagatttagcaaanaaaaataggggacaaatttcagagaaacaacgaatgattttttagaatatgtatgccccaaataatgcatgacaaccctaatttggagaggagtaggtgctggggggcagggaccctttggggagaggtgctgcgttctggtcctctaggattntgtgtgcacctcaggctgaccccaagtctttgtggatgtcgatcctgacctttccactccagtcctcaacttcccaaagggacctaggcagagaggtcaaggcagaaagagctaggaaangatactctggggtctggagggaggnggtgtctcanctcagtccaggtgaggctcagaagctgaggttgaagggaggtagganaaggaggtggaggggca

SEQ ID NO: 600298 - DNA, 909 bp, Homo sapiens
gcaagctcaggttgatgccccgtcgactgtcagaactacattgtccgcctagagatttattcgaaagttctgcactggtattgaccctatcagcagctctgctcgtacactctctcggtatagtgcctgacccagacccagaaaggagggtggagccaggatcctcaaacagtgcactgggagcatttcagctataaactgtatcttcctgctgtctcataccagttgccctgggagatccaggtattgtgggcatatgtggtctcctgtccaacccgcaagctcatgtctcaggagttcgattcctataccagtgccagtctatacaggattctcagcaagttacagaagtatcttgtgacgaactcttgtgaactttgtggacgttacccaggaagccacagcctccaaggggccaaggccaaaatggactggaaatgggcattcgaccttctttcccttcaagagtggcacttcacgcagaggagtactctctcagcacatgctcagtctctcccatccttatctgtgcctcttactacttggagttctcaacctagagactatgtgaggaaaagaaggtaatcagatttcagttttccctatgagacactctgaggcagccacttatcttggtaggtagaacttcacctggtcattgacccggagagcatttaacgcctataggttgacctacgtgtacggaatcttgcctatgaaggcggtccataagaaaagcctaccacttttttgtgctccctaccaggaacacagcgcgcctccagattcccccggcccgggggccacccgttttaacggcccattacgtataaacagcgggggacacaaatgggacgccgatggggcactttggcagcacccaataggttaatttgggccacccactaa

SEQ ID NO: 600299 - DNA, 934 bp, Homo sapiens
gacctctgcgtcactagtcgttacttgctggttccgagtgcagcctgggaagtaggatgcggtccctgtgacatgcagctctaccctggctgtgaatccggaggaagtggaggtgctggagccccgacgagagcgatttctgatgcgagatctctgtcgtcccgagtctactcaaacgaagatgacgtctgatgggacatcgcgttcagcatgtatcgcgctgagtcgcaggtgtctggtgcggtgcactcgccgtgacatctctggagccaaggcatgattgggtagtactgtgtacagacttatgcttcaaatcccattatctaccaagacgcatgtggacgcgccgtcgtgaagtacgcatctgctctctagctggcatcctagaaacctcgggctacgtcggacggagagtgcacgtggactgcctcaaatgatgggtgtccgataacatggccggtaggagaaggcccgggagattggtgaaggatgtgcagatatgcttggtggaatgctggtccggcgcgagtagagagaagagctgcatgtcagtcgtgagctgcggtcggcggtttccagccaagtggattctggtcaaactggtgtgggaagattttgggcttgaacgaaccctgtgacgtaagtcctaaaaccagagagaccttttcgtttcctctatctccctgtctatgcttctgtctcacttaacactacgtttgctgtcatatggtctgtggttgatgagcctcagtaatgagtttcgacttgttaggcgtgatcaagttcgggacgtaatgtcgtattgcctaatgcttctcacatacagggaatttcgggctagagtagtagctcttgcaggaagatcccactttgttcccgcgggttgggggtccttactaaatttggacggtggtgggtatttcatagcgttgac

SEQ ID NO: 600300 - DNA, 508 bp, Homo sapiens
  misc_feature (508)..(508): n is a, c, g, or t
tgtctagaatccggagtagtcatagaggagttacgagaggtaccatgtagcactgaggtcagatttcgagactcatataggacatcttaaacaggcatgagggactggatacagattattttcagtgatctctccatattgattaagggatgccttggaggcattaaattcttgtcacttctaggctgctattcaccagaactgagtaaaactaccatggcactgtagaagtccccaggaaaggagtgggagatggagtattgcggaataatgagagattttcaagaaatcaggattctctgaggaccagatctagtttggtgatgactaaaaggtgcatggacaggaacacagatcattttgaagatttcagaattggtcaagaaaactaaagaaagactgtgaacatctatgcacgtgtacaagctgtcaataaacaagctgaagaatacaccaaaggcccagatgctacttctggcaaggcagtgataattcctctgtcttccan

SEQ ID NO: 600301 - DNA, 433 bp, Homo sapiens
  misc_feature (20)..(20): n is a, c, g, or t
  misc_feature (82)..(82): n is a, c, g, or t
  misc_feature (137)..(137): n is a, c, g, or t
  misc_feature (153)..(153): n is a, c, g, or t
  misc_feature (181)..(181): n is a, c, g, or t
acgagctgagatcacctgangtatttggaactctacgctgatgcctccgcttctatagcagtttatggggagccattgaagngcgtgtgtactgtattttttttccaggcaaaatggatgcaaactgtattttttanctaatatataacgtcnttttctccctgttgccgctaagtgatcnttcatatgtgtggttatactcataataatgggccttgtaagtcttttcaccttcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacagt

SEQ ID NO: 600302 - DNA, 526 bp, Homo sapiens
gggtatacctttttatgcccgctttcggaaaaggaggcccattgaaggcccccccacaaccccctccacccaggggcactcttcttgaaggttcacatctggtgaatggcctcccaaaacccccgaggcccccctggagagagatcacattcttgcaccctcgccccttgctcgtgtggaaagacccacgaatagtggccctaacgggtgttgtgccgctccccaagcacggccctcggggaagaagcctcttggggttctccccaggcctcgttcacttcgcctcgtttctcgtcacccacatccaaagaaaggctcccacagctgtaacacgcacagagtcccacatccacattcacccacgtcccttgaaaaggcttttatgtcttaaacccgtggcctctgccacaccgtgctccctgccacagcgttcccccctgaggttgtgtatccatattatctgtgttagccagtagtattttcagctactctctattgttattaaatgtagtactaaattctggga

SEQ ID NO: 600303 - DNA, 1380 bp, Homo sapiens
gcgagcggccgcccttttttttttttattggtcccaggatacttgtgcaggtttctttatattctatttcttattttttatttgagagaagagggattcctcaacctctattatggcccagaggcctgtgaagtgtgcaagggggtgccactcttgggcttccagtgcaaagcctcgtgcctctcgcggggtattaaccaccaatttcctcctgtgccttcaagccttcccgcgaagatagcgtgggaacataccggggtgccgcgcacaccacaacagcgagggaaatattttgtgaggatatatttcaagcataaagaagcgggggttataacagcgcggtgttacaccacagaagatgggctcctcgaactcctcgcggagaacccgcggagaacagcgagccaacactctgcggaatcctccccaaagagagtggcgtggacaattgtgcgcgggtgtgtgtgacacgcccacagtgtgaccacacaccgagccccttataatgtgtgcgtaaatcacctatacaaatgtgggcggtacacagtgtgcgtgaatcagacgggatagagaaacattagtccacatatctcccgcgaaaaaaagaagagcgcgtggtaataaaaaacaaaaaaacaaaaacaacacacaatcagcgtataacacaaagcgggacacccgaggaggacaccccgcgatagagcgaaaaaaaaatgttgtaccgccatacagacgaccaacagacacaaactatcgccgagagaacacagccccccaaaacacaaaacaagtcgatgtttaccatacaacaaaaagatgtgggccatcacgacaaaacaaagttaatatcattaaagacaagcctacagctattacgaaggcagagaaaaaagagatgcctgcacacaactagtcatatagacgcaccgcccccaccaacacaacgagagacgggggcagtcgacccaacatcatcacttaaccaccgccactccacaagcgcaccacgaaaacaacaaaggtggctgccacgtggcattccacacaccacaaacaaaaaacagccgtcgtctacatacaaagacaacaccaccaagagtatgcgctggtggagcacaacagcggcatgcaagcggagcgcaacacaaaacagaggggggacaacccgaggataatacaccccaacagtgaggtacaccaacgaggcaggcacaagtgccgaacaacacagatgcagaagcagcacagaccacccttcagcatgaggtggggcacaacaacacagagcccgagcattggagagcacaaattactctgcagcaggcagacaacaagcacgtccacaatacagatgcagaacacaccaccaccacatctagt

SEQ ID NO: 600304 - DNA, 140 bp, Homo sapiens
tctagaggacccctctctccacactggtatttcgtctgcagtctatgttgggttcatttttcttgcataatccaggaatcataaatcatgccaaagcctagtgtctttttctttttttttttcccccagggtggagagag

SEQ ID NO: 600305 - DNA, 249 bp, Homo sapiens
  misc_feature (7)..(7): n is a, c, g, or t
ggtcggnaccctggagtgctgaggggaattaggtctggaagtggagctagggaaggtggttaacaaagagggtggcaggccgggtgccgtggctcatgcctgcaatcccagcactttgggaggctgagacaggcgggtcacttgcggtcaggagttcgagaccaacctggccaacatggtgaaactgcatctctacgaaaaatacaaaaaccagcagggtgtggtggcagacgcctgtaatcccagcca

SEQ ID NO: 600306 - DNA, 370 bp, Homo sapiens
agtattggttggacgatgtcatttatagattcatcatttccatagcactatatgctaaaagtgaaaatcagcccaaaaaacttcgatgtggtattaatttggaagttacattcattgcactgtatattaaaaaaaaattttttttacgtgagtgtttggcgtgagccaccactcctggccaagcatccacttgttaacctcccacatatcagtgacaacatgtgatcatttgtcttcctgtccttcgcttatttcatttaacgtaataacctccacttccatccatgttgtggcacataacaagttttcattctttttatggccaggaccaaatattcattatgtacgtataccacatttcctatatcat

SEQ ID NO: 600307 - DNA, 220 bp, Homo sapiens
gctttttatcggagtctcctcccctggggaacctacgaaatcaaacactgagattggcactccacccttagggaataagtgaagtgtccaaagtgatggtgttgaatcccttacaggacattggtccacagcttctttttcagtcctgcaagcactggatctttcttttagaatacaaagagagggagagaaagaaagagaggtaattgagaagtagtaa

SEQ ID NO: 600308 - DNA, 186 bp, Homo sapiens
tgtaccatgagcctatgcacatggtgaaacttgtctctaccagaataaaaattagctgggcatgtggcacgtgcctgtggtcccagctacttgggaggctgaggtgggagcctgggaggtcaaggctgtagtgagccatgatcatgccactgcactccatcctgggtgacagcaagatcttgtctc

SEQ ID NO: 600309 - DNA, 106 bp, Homo sapiens
actgcaggacacctcaacgtgtgtgctgcatcaactgaattgcttgcttgatagcagtgaggagacctccctttacgtctagtcacagaaatcttgtgttggagag

SEQ ID NO: 600310 - DNA, 1101 bp, Homo sapiens
cgtcatgccattgagtcgagcgcgcgcgtgcagtaatccatagaccttctactgctctcctagtccgtggaatgcccatatggttcgcattagaccaacttactgccacaccagataacgttacacctcacatgagctgactcgagtctcgacgatgctgcaggcataggttccacatgccgatttgaactattctggcacgccatgcatccgtaggtactccagtcgagctaccatggctaggcatccgtttacataacggacgaggtcaacgatccctccgcttaccatcgaaatcaatctggccgagccaagtggctactggaacctacgagctacaccgactcacggtggcactaagtcttcaagctccatactagtactatcaccgccattgattcgctataacccaggctgacgcttgcgactccgttgaccgttagacaatgcgaggtagtacgtccgcgattgaaggcccccatttcgtattactaattacatcacaagacgtcttgcactcatgagctagtccccacattaaggcttaaccaacagatgcaattcccggacgtcttaaaccaaaccactttcaccggctacacgaccggggggtatactacggtcaatgctctgaacatctgtggagcaaaaccagagtttcatgcccagtcgtcctaagaattattcccctaaaaaatctttgaaagtagggcccgtatttaccctatagcgaccccttctaacccctctagaggcccaaaaaccaagaacatagacaacaagaacaagccaaacacaaagaccaacaagaacggcacgcagaaaaacggccagagaggcacaaagacaggcccccccacccacagaggaacacaagggacacacaaaaagagcaactctaaccagaagcacgcccacccacaaaaaacaccacgccgtcgaccacaagcccccatggacacagacaagacgacaaactacgagccgagagtacaatgacagaacccaccccactaaacaccccagaacaaaacacaagaggagcacagacaacacaagcaagctacgaaagaaaacacccaagctgaataacaacacgcg

SEQ ID NO: 600311 - DNA, 390 bp, Homo sapiens
ggggcaggtgcccccagagtacgtactctgccagcggtggtgagaggagcctggcgttcacgtgagtctacaacaccgctctggggctgctcgttgcacctgccactgactgaggtctgctgcccaggccggtcaacaatctgttgggtgatgcggtactctgtgatggtctaggctgtcccttgtgctcaaagatttgtcccaggacacttccccaccaaaactcctgatgatgaaggccagggcctcacggggcacctctcggttcaggaagaacttcaggccctcaaaaagcttcttgtgcttctcctgcgcctccagctccttcctgcggtcttcctcctgcgctgacatctccccatcggtgggaaactcatccacctcggcctc

SEQ ID NO: 600312 - DNA, 762 bp, Homo sapiens
gtgtctttgcagtttggtaattctgtggtctatttatacagatattaaaactgcaaagacagagtgtggaaaacaggtttgaaacccgtgcatagagccctctgtctttgcagttgtggtaattctgtggtctatttatacagatattaaaatcttgtttatagaaagaaaaaacaaaaatgagctctcgagtgcctcttatatcggcgaggggccgaagaacacgagtgtcttggatcagtgcggcctcatgtgggtcatgtaagctggttcccttcgtagcccaatccttgcttgcgaccacatcttgggtaccaatcctcgccgggacatcccgtaataagccgagtaccaattcaagttgacggactaacgccagggtaataccgtgctagtcatatagacttgcggccaacagtgtgcgacagcaagcgactgcgagtcattcgcgaacgtgggagaccaagagtcagcccgtcctgaggtacagccgcaagggcaaaccccaactgtcactactgtgtcccgcccttccttctgatggagcctccaatgccgaacaaggcccacacgtagttgtgtctggatacagtgacattctaccgcgaggagctgtgaacagttggccctggaagtgcaagatggcacgcccccgtcaacggcggcgagtggagacccaccaaatccctccaagacagagcaacaacgaagtacgcggccagcagctacctgaggctgaacgccgagcagggggaagtccac

SEQ ID NO: 600313 - DNA, 853 bp, Homo sapiens
  misc_feature (853)..(853): n is a, c, g, or t
tgtgatcggcacgagggtcgggagggaggaaggtggcaagatggtgttggaaatgcactatgtgtgtgtgtggacaacagtgagtatatgctggaatggagacttcttacccaccaggctgcagtgcccagcaggatgctgtcaacatagttatgtcattcaaagaccctgcagcaaccctgagaacaactgtgggccttatcacactggctaatgacttgtgaagtgctgaccacactcaccccagacactggcctgtatcctgtccaagctacatacttgtccaacccaatgtgcaagatcacctatctgcactgggcatccgctgtggcccatctggctctgaagcacctgacaaggcaatgaatcacaatgatgctgcatcatttgccttcagtggagcaagcccatgtggcaggcacacatgcagcaaggcatcttggttgcaccacttgtgctcaacaacgcctcgaagcaagtgcagcacacagtcaacctcgtatgcaccattcataccaattattattgggtgtgcacaccacggagtgttgacaaaaacaagcaaaatatgcctgtaccagccattttgctacaaagcacggtatcgacatgggccccaggaattgtcgaacgctggattactcaatcttgggtcgcaccagcttgcactttcccttgtggccccacgcttctgtggcgtttgttctgcctccgtcaagttcatggttcactccccgcactcttctgggactcgggtttgacaatcggttgggttgcccccttgcatttgcgggcacctcttgcggtcggccaatgttgtagcttttggacattttctgggccgttccacttn

SEQ ID NO: 600314 - DNA, 109 bp, Homo sapiens
tgaaagcgtgatgaacggtgaagatgcagaattaatgtctgtagagttggaagagaacttatagcgaataatcattgttaaaaaaaataaaacaaacaaagaaaaaaag

SEQ ID NO: 600315 - DNA, 117 bp, Homo sapiens
tccaagcagtcgcagttttcacatttggggaaatcgcagggtcagcacatcggagtgcatggataagcctcgccctgggaaaaccaccttccgactgcttggatttacaaggagggt

SEQ ID NO: 600316 - DNA, 336 bp, Homo sapiens
cctcatccgtagcatggggaggagagtgctccctgcagggctgttgggagaaggccatgagggctgttgggagaaggccacctctcaaatagtgacaggcgttggcattgctgtcctttgtcgtattatttttgagatattctttatatttcaaattagatcataatttttaaaaattaagtgcaggacaaaagaaacagaggggaacccacagatgaaaaggatcttaaaccagattgtagccaactacaaaagaaacctcagtcatcatcagtggccacacagcccctttgtgtacctattgattatacaactacataaatatgtcactaacaa

SEQ ID NO: 600317 - DNA, 503 bp, Homo sapiens
  misc_feature (357)..(357): n is a, c, g, or t
  misc_feature (368)..(368): n is a, c, g, or t
atcttggatcctctaaagcggccgcccttttttatttaatatttattttttttaagactagaaatggtccgctatatattcaacgtctcgacaggactgtagcattcgcccaattacattggctgagttgagggagagataagttagtaattctggtgacaaaactgtccagcaaacgcaaacgctatacacaatcttactctcttcgttcagctatgtacaaaccttaataaagatagtaaatgttagatctaaaactcttgcaactagcaatagtcgtctacctaaggacaggcttttgtttggtcggtgacagttgaacgtctccgttcagaacagatcccacgaacctttcancttcttccagngtcaccttgtcgtcgtacaccgcgaacctcccccggcgaggcttgtaggcgatgagcagcctgtcagatgacttatatggagacttatcaaatgatgacaggaatgcagattgtttggccttatccaacaaagcc

SEQ ID NO: 600318 - DNA, 284 bp, Homo sapiens
gaggatccaccaaccatagaaagtaaatactgtataaaaagctccagctgttagatacaaatgcaaaacgcttcctaaaaaacggcctgaaaaaaaactcacagacaatgccaaactttataggtctgtattttcctttatacaaaatgccctcaaattaaaaagtaattcccatatagcaataaagtccacatctctggattacctataaccggtattatggggtgtgtttatactgcctagaatgttaaccctcataaagccttaaaagtacatttgtgaaa

SEQ ID NO: 600319 - DNA, 386 bp, Homo sapiens
gttactcatatgcttgggttaacagactaccgtgcttatgagctctgaaagtcagtaagactgacttgctcaacatgtgtaatagctgacatcgtttaccagtcgttcagatatatgcacacttattgacaacgtgagacgatgactgatgctcagtgctctgacagagctagctatacgcagacctatagcaacgtctgagcagctgaaagctgtgatggatgattgatcatgatttatagagaagtgccgcgtggcatgacgataaggagtacctgattaccgtggctggtttactagatgctgtccgtctagctgccttatgattatgacactgcatagagtagcgtctcatcctaccatgatagtacgagcgaggcctgtgc

SEQ ID NO: 600320 - DNA, 379 bp, Homo sapiens
tactgacatagagagccacttagatagaggacagagcttgcatgaaagaggatgactagaaggctgccttgtccatcccttgcgtctgtgccaagccacactatttctcggcaatgtttcctgctttcaggtctatttccatgctcattcagcgtggaagcttgcataccttcacctcaaaaataaaaacacacttattaaagacctactgtgccccagacctactgtgagctgaatgatggcgttctaagcacgaacgagcaaccctctcttctctcggtcgctcaccgtctaggggctgcaacacatgagacaggctccagtttaaaacagaattaaatgcacgctaggtcagagatgccaagacatctgggggcac

SEQ ID NO: 600321 - DNA, 383 bp, Homo sapiens
caccaccttcgtactgcatgctagagtggagagcagcagcatgtgtctaggctctgataacgcggtgaggaggctatcccagcctggatctagcaaatcacatgagaacagaatcccgttgcccacagcctgcaataacatggttgctgatggggacagcagtgtagaagctccaggagaatggagggaagcctgggatgttacattcttgaggccttcacaggtacatgtcatcgtagcccggcggggtggatgatggtctgggttaggtccgggtgggctggtcccaatgggtccaaaggggtcaaagcgagctcctgggggcacagcgcctggaggaagtcggttcgggaggcctgaggaagggtcaataagtgcagatc

SEQ ID NO: 600322 - DNA, 835 bp, Homo sapiens
cctccttttataagcatttcacggcgaccgacccctcttgtcgacttctttgtgctctcccccccccccccctccccgctcttggtaagatggttccaccaaagttacgccgcctttcgcttgaaacaattgactctccggtgttcctcatgatccaagtctgactaagtccctttctttaaaaacagtcttcaattcccccgatgtatccttcccgcaaaatcttttgtggacagcccgtctgtccacgttataaactatggaatataggcccgccacgcacttgttttaatggaaatcgatcccattacactcctaaacacagttttttctttaccaccacaccattagttgaccaccaaatttgtcctcgcgttcaactactggataaaagaaacaaattagcttgacacctccttagcgcagtaaaatcttgaaaacagtgctcccgcgttttaggcccacacaatatttctgcaaccaacccctccttcaccctcactctatgtgttcctccacttctcactctttctagaacactttatgaactattgcacgatcagcatcaactcatccccccttctttttttctggcgtaactcccccacagttgtctgtagtacctcccgcgttcatatctgtggcccgccccccccagggtcacattactcttctgcctggctccccacagaacacattttccaaaaacatttgaaaacagtaaaacttttctacactcaatttaaatattgctagtttcctgttcaggtctgcccgacaagactgtgatagtattcatgggccattaacccaattttggcctgtcaacaaaaca

SEQ ID NO: 600323 - DNA, 212 bp, Homo sapiens
gtgatagaggaccccgtctcaggaactagtagctacacaagaacgattatacaatagtttaataactaataatatctacttttgcctctttttttttattatactttaagttttagggtacatgtgctctcatggttcaattcgcacctatgagtgagaacattgactcagcaatcccattacggggtatatacccaaaggcggtcccggtt

SEQ ID NO: 600324 - DNA, 292 bp, Homo sapiens
gtggcacacgcctgtggtcccagctactctggaggcagaggcaggagaatcacttgaacctgggaggcggaggttgcagttagccaagattatgccactgcactccagcctgggtgacagagtgagactccatctcaaaaaaataaaaaaattagccaggtgtggtgatgtgcacctgtcccagctacaggaagctgaggcaggaggatcacttgagtcttggagaagagctgcgttaggaacgatttcaccatggtactttagcctggtgacaacaagatctgtctaaaaa

SEQ ID NO: 600325 - DNA, 1674 bp, Homo sapiens
  misc_feature (1655)..(1655): n is a, c, g, or t
gtgggtgttatatattgatatgtgtttgtgtaagtggctaggatagtgtaatgtcagtatggtgggtaggtgagataagtggtctatgtagtgttgtctgatctacgtatgtgatatgtgtggtgtgagtgtgtaggtgtgtgtggttgatgggacgagtggtatgggtgtttgtgtgtggatgagtatagattgtttgtgcgttgttgtgtcgttcttatttagtcgggtttgtctagtaggagtgttcaaggtacgtcgttgaaagagtctttatacggggggtgttgattatagggcctggtgtagtcgtcgtgttacatgtgttgtaattggtgtatgtctgggatgggtgtgtctgatggctggttgggaatggctttttcgtgcgagaaggttatgtgggggatgtggcagttgcggtacggctggaagttggtctggtagtgtagtatgagtgggtgtccgtgtctaggtgcatggggtaatgatgagtgtggtttgagttgttgctgctgagtggggtggatgtgggggacgtagagggagtcgggggtagtatgggtcagagggaggtggtgtgagttgtcgggtcggagaggctcctcgcggtgtggtgtggcgctggtcgccaaggtgaggaggtccgcggtgcggcgtagtgcggtgtgcgaggcgggtgagtctctctggttcgcgttggttgagacgcgcctgcccgaagggcggctggggtgtgtgtgtgtggccgacgcttgtgggacgccgaggggggaggctgtggccgcttggtgttctggtggtgttcgggttgtcgcctgggggttgcggagggtgcgaggtgccttgttgtggggtggttggcgtgagggtgtgcgttggggttcgtagggtgtgcgccgcgagtggggtcgccgtgggtgtgggtaaggtcgtctggctgggggcgcgcgtgcgtggcgcctgtggtcaggtgggagtgggggcgtagtcaggtacggtcaggggaagggagtgtggtgtttgcgcagggtctgcgtgggctgttcatcttgcgtcacgggttgcctggcagttacggtggagtgtaggcttttgcgggggtttgtggagcagtcgcttattggttgtgtgggttggggcgcgagagtcgcaggggccaggtattagtgcgcagcagcctgagggctgggatcagtggtctcattgtgtggcgctggccgtggttcatgcgcgtcggtgcgatagcaatgcgctgattcatgtctgtgctccgtgttcacccggtggcgcaggggagttgccagcagagtccaggtacatgttccagtgtggcctgcagtggtcagctgccgcagcgcggggcccgtttgcacgctagttgttgcatgtttcaggtttctttaaaagatgcttggtaagagagctcgctgagcgaacgacagcagcatgccttaattgggaagagctagctctgatgacgaaggcgcaccagtgccgctcgtgccctctagccttcttgggactgaccaggagctgtctcatgtgtctgtagagagatgggaaccatactccttgcaggcagtggcttccgcgtgccccgagtgctggtgcaggttccacagtcacgcagatcaggaagggtgttgcagcantatgattcacctgcaactt

SEQ ID NO: 600326 - DNA, 174 bp, Homo sapiens
tcgatggcatgcaacgccacttatgcagtgaaccactatcacgaaaaaaactcgtacctcgctatactaagtctccctacaaatctccttgattataacattcacagccacagaactaatcatatttgatatcttcttcgaaaccacacttatccccaccttggccttatcgag

SEQ ID NO: 600327 - DNA, 1323 bp, Homo sapiens
ggatagacccagtggctaatgacaatagctacgatgaactgaaaagagatgcaaagttatgttcatcacttacctgtctcagggagttgctatagcacctcatcaatgtgcctttggtacttcaggtgctacaacaaacagcatatagtcaaaagcagcttcgttggccgtgcacgcatgacaccgattactgagcctagctccagacccatggtcatcttcataacgctctttatctattcctcaaacaatgaagcatgccaggtaaagagaatatccaggtggcctggcttcatacagtactttctggacaggacgaaaacaaactgtgagacgagtatcagaacatacatgtgcttcgctacctaggcattactagctgagtcctcgattaacagcatgtacagctcatcgttagcacacatgggaccacgtcactactggcagactaccaattttattgatggacaaaagtacgctaaacggaaagaaactactctacagacaaaaaggaaccaatgccgaggaaacgccatgagaatcagtggtgaagaggagcactacgcccaaatgtcacctctacaatgcaacgaagactagtcgaggatactaagtcgcgcacccgaattcacatcggcacggatggcataaggggaacctatggagatcgcgcattggttggttctccgttttgcctcagcgtacccactttatacacggaatagttgatcaacaacaccttggggtcataggcccgcacacggtgcaccaccgtcaatttgcacgattacgtcacgtctggcaacaagagttcgctctacaattgcacttccctggcaagccccacatcaatcgagacgaaatggcagccgcagcaccaagacacgacaaaaacgacattacatggcaaagtgtataccggatagtgtaacatccaccccaaatgagaaaagacacttgggatcatgagaaaacgaatacaaaagatagcacagacttcacactctcggagttgtgagcgcaaaagcataggctatctggacatgcatagaaccacagacatcatcaacatttgaatgttaaaccccagataacatcattatatcagcagatcagaaaaacggcatgacacgttcagtccatacgacacatatcaaagaggcatcgtatgatacacacaacagtacacatttcccacgatgcacttcaaaagttatacgcacacatgggctggtgggagagaacatgcctgggagaagactcattacaaaagacacatgccccccacggcactgtaggcttccacataccacatacaatagg

SEQ ID NO: 600328 - DNA, 238 bp, Homo sapiens
actcgatgccactcataaacatgtactcttattcagggccaggtttatgagtggcctaagtgaaagcaaacaaacccatgtacacctgaggaaggtcgatgctgccaccttacagataataataacttatgcatacacgggtaactgggcaaggactgccagcacggtagaacagctttatgcacacagctggcttcctaccaggtagaacgacgtggtgtacaaccgtgtcgacgac

SEQ ID NO: 600329 - DNA, 139 bp, Homo sapiens
  misc_feature (42)..(42): n is a, c, g, or t
  misc_feature (63)..(63): n is a, c, g, or t
ctagctagttagtactgtagactgtccatgtatcggatttcnacaaagaaagaacttcttttnaagaaagaaaagaggaggaccctcatacaactctgcataaaacaccaacaactgggaatcactatccgagcaatca

SEQ ID NO: 600330 - DNA, 143 bp, Homo sapiens
  misc_feature (40)..(40): n is a, c, g, or t
  misc_feature (45)..(45): n is a, c, g, or t
  misc_feature (112)..(112): n is a, c, g, or t
  misc_feature (116)..(116): n is a, c, g, or t
gtccggcgtgtcaaaactaacgtacctgtcaagctctttncccgntccacagatgtcaccaccagctcagccaagatcaagttaaagagcagtgagctgcaggccatcaagncggngctgacacagatcaagtccaatatcga

SEQ ID NO: 600331 - DNA, 157 bp, Homo sapiens
ccgaaatcctagttacgcactaaagaatatgcttgtaactttttcataaattttaaacagttaatttcatgctattgttgtttagtatccactatacttagaatttctctcgtccatccttgcatgttaactgtctcactattttctggcgcttcac

SEQ ID NO: 600332 - DNA, 130 bp, Homo sapiens
gcagcagcgcagtgcacagcggcttctgaaggcggcgtcgacggggagctgcgcgtggctcccggtttcctggttacgtgcgcgccggcagagccaaaacctgcagccgaaactcccgcttctccgtaag

SEQ ID NO: 600333 - DNA, 266 bp, Homo sapiens
  misc_feature (2)..(2): n is a, c, g, or t
cnctgctttagcttggaataaagactttaggagaaaatggtggcttcatcttaccccgcttccgggtgccagttcaaaatacatatattgtgcacttgtgggggccccagatttttttctttgaagcagtttgcccccattcccgactctctcagaaaatatcgaagaacaggtggctccccccctcttgtttcttctcctccccccccccccccaaattcttttttctatttataaagacaatataaaatagttatcttccccct

SEQ ID NO: 600334 - DNA, 129 bp, Homo sapiens
atcacagccgggcagacagtgagaccgcctttgtgttcaaaaaggtagtatcaaatattaactctggcttaatttcatttactcctaattgataaaatcattgttatagtgtggttgcttgttccgctg

SEQ ID NO: 600335 - DNA, 596 bp, Homo sapiens
  misc_feature (161)..(161): n is a, c, g, or t
  misc_feature (190)..(190): n is a, c, g, or t
  misc_feature (225)..(225): n is a, c, g, or t
tataaacatatccctctttttaatctccccccccccggggagttcagagggtgaaaggggggtttccctttttttgttttttgccagggggggatttttttttacccaagggccctgggggcccttgggcccctttgttagttcctttttggggcaggggnaccaatgggggggggaagggggttatttnttttctttttttcctgccccccggggtccaaaaangggaaatttcccaacccccccaaaaaccccttttgggggtttttttttttgggtttctccccccaacaccccccaaggggggggtttggggtgggttttccctttaaaaacaagtttttcccaggggcccttttttccctggggggtttccccccaatacccttttgggccaaggggaagcccccccgctcctttaagggtttttggggttaccccccccggggggggccctttttccccttttttttttgggggtttcccccctttgggggttcccccccccccccggggggttttttggggggaggggggggcccccctctttttctccccccccggaataaagccccgccctcccccctgttgggaga

SEQ ID NO: 600336 - DNA, 272 bp, Homo sapiens
ggagtgaaaccctatctcaaaaaaaaaaaaggcaaaaaaagggattgatgggtttttagagagggagtttgtctgataaactgaggatgctgcttgggaattaacatgacttaatttttaccaggggcattggttatcaggaagttatggcccgttttatatcagccccaaaacataaaaatttattgtttcacccattttttggggctgagggctggccaccatgaccagggagcccatgaaaagatagtgacaccaggggccctagtttc

SEQ ID NO: 600337 - DNA, 321 bp, Homo sapiens
  misc_feature (21)..(21): n is a, c, g, or t
  misc_feature (26)..(26): n is a, c, g, or t
  misc_feature (46)..(46): n is a, c, g, or t
  misc_feature (137)..(137): n is a, c, g, or t
  misc_feature (320)..(320): n is a, c, g, or t
cggggctatcttccactcagnggctngccattcattttaatgatgncctttgatgaacagaagttcttagttttaggccaagtatggtggctcatgcctgtaatcccagcgctttggaaggccaaggcaggaggatngcttgagtccaggagtttgagaccagcctgggcaacagagtgagaccctgtttctgcaaaaataaaatatttagctaggtatggaggcatgcacctgtgtggtcccagctactcaggaggctaaggcaggggcattacttgagcctcggaggtcgaagctgcagtgaaccatgattgcccggnc

SEQ ID NO: 600338 - DNA, 478 bp, Homo sapiens
  misc_feature (94)..(94): n is a, c, g, or t
  misc_feature (170)..(170): n is a, c, g, or t
gacacactcaatactgtgcttctgatcactgaaactagatcaagtcatagctcacagctgatacacaatccttatatacaggtagttaatgtgnaataggcaagctactgtagtcctattatttcgatataatgagatacctgctatacataataggtaccgtatgttancatgctactatggtgtggagtaattccattaccatatttatatttattggtcacacagcatacatttatgctcccagatacctggatctgacaaatggttactttaatgtcttttaaagaagatgactaaatttagaagaatggtttatccctagtatctcatttcaattacgatacaatttgcagagaaacattactgttacctaacatcaataatctccagttctaagacgatgcttctgtcaattccaaagtaataaggttctaatgaaaattgctcctagtttaagtataaagaatacaaaatg

SEQ ID NO: 600339 - DNA, 301 bp, Homo sapiens
ttaaaatagcgaggggttaatagagctgtagccgcctgtttatgccagagcacagtaacaccagatccgagctgcgtctgtgacctacaccacagctcgtggcaagcgtgggatccttaacccactgagcaaggccagggatctaacctacaacctcacagttcctagtcagattcattaaccactgagccactacgggaactcccaatcatcatgttagatgtgagatgggagtgaaggtaactacaacagacatatgagactgtgctgaagagaatgtatttaattttccgggtaccga

SEQ ID NO: 600340 - DNA, 1024 bp, Homo sapiens
ggtaccggaagaggctggcaatcgccgatcgcctgtgatgcctacctgtgctgagtgtaagttctgcctgcgagagccaggcaccttccttaccaccatcctagtacgatcccatggtcgagcgcgaccgcgtctgatacatagtggcttcgcaaacagttcatttgacacgaaatggcgagtaagcgccgaaacgccgacgtccaagtatccctcactacatgttggcgtaggcggatgtctggtgaacagatctactggggacttgctattgaatgtcattctcgttgtgtgaccctgaggtgaatgctcgcgacttcacagaatgtgggcatctccctctgccacaggagaaggacgagtgacgaagcatcccttgtcgcattggctgtgcagtcttccctcaagtctgtttcaaagttagctggttgcacagtccctgggggactgtgaccatggctacacagtctgttggttccctgttgagctcttgctcacaggaacattgagcagtgacattgctagccctacttgcccacccctcacctgcatgcaggataccctgacactgcgatgttcgtgcaggacaattgcaccgctttagagcttccaggagggccaagcattatggcaggtacttgtgagcagccaggtcaggctggcatggtagcataggaattgggtggtcttgaggtcctaggctatctccaggttagacttggaggtgtagccctgaacctgttgtgacacaccggggtgggtcatacggaacggtacgtaactgggttgtccacagggaatgttttccaagtactttggacgtgccgtccacgttccagagatggagagggttgagagtcacaattttcacgcagcaatcccagggcttccgcagtttcccacgtatggtttgcactgacacacagatacttagcccgtgcccttaatcggtacacaggcgtcacacccaaatagggcgagaaccacaggagaccatccacgtaacatataaaaaagctctagg

SEQ ID NO: 600341 - DNA, 918 bp, Homo sapiens
ggtcacttcagacccccactagttgacagagcaggagaatttcagactccagtagacttgaaatgtgcctctgggtcaatagaagcagagctagcgaggtaaagggattgaaagagtttttgctgggggtgtgagtcaaacttttaattccctgtctgtgtgcagaggggattcagactatcagagtttgtctggcagtggctctgggtccagccccttacttgaagatctgggagagcatgaagactgggctttttttgcctatgtctcttgggaactgcagctgcagtcccgacgaagtgctagattattatcgtgatcattccaagagcagatgttgaaacggtagcacccgagtaacactgcaatgccccatgtgaaagggctgacgatgacgaaccctgtgacaataagattcagacctagccgattgtggggggtcgtgccttagaagattttggggccacgggatttgggagtggggtcatagaaggtagtcgagtgctcgtccagtacccaagggtcccggtggaatatctgctttggctttttcaccccaggaaaacacggggggggccaccggcgcgtgttcgacgaacacgatggggcactgaggctgaacggctctgtgccaggggaccaggggacgtagaataaataccggagccgcgcggggacgtgtccccacccggaaatttggggtctggtacagacacgggttacccgtgtgcccgggagtgttcgaacccggggcagatgccggcaaatgcactcaaaggggggataaggactgaccaagtcgggcacagtgaatttgaccaggtcgaaaggtgaaaccaagtgaaggtagttgtgcacacacgcgcgacagaggagctagacgagtaaggcaccatacaccaattaggagactacaaa

SEQ ID NO: 600342 - DNA, 457 bp, Homo sapiens
tagaaaaatctttcccccagtctatcgggtaatgcaagctaaattctgatagatctatcttagtatgtcattgtcttagcctatcagaagtcctcagaaagtggagggtacaacttcaacaaggacaggtcagttagcgttgtataagaaccagcatgttggtgccgggcatggtggatcacgcttctaatcctagcacttcggtgaggccgaagagggaggatcacgaggtcaggatttggagaccactctgagccaacatggtgagaccctgtctctactaaagaatacaaacattacctgggtgtggtggcgcagggctgtaaacctcagctggctgaggcaggagaattgctggaagctgggaggcggagggtcgcagtaagccacaggacatctcaaaaagaaaaaaatggacagcgaggcaattggtggacgacaaaggggagccccgggg

SEQ ID NO: 600343 - DNA, 1103 bp, Homo sapiens
aaggagcccacggatcgagccaaaggcccgcgcgccgttgcatcccgcgtccagcacctacgtcccgactgccgatcgccgccggcacccatgcccaagagaaaggctgaacggggatgctaaggcggagataaagcaaaggtgaagggacgaaccacagagaagatccagtgaggatgtctgcatagacctgctcctccaaagccagagcccaagccttaaaataggccccgtgcaaaagaagggcagagaaggtacccaaagggcaaatcgggaaaagcgtgatgctggcgaaggaggggaataacccgtgcagaagaatggagatgccatgaacagaccaggcacatgaaagctgaaggtcctggagatgccaagtgaaggtgtgtgcattgttgataactgtgtacttctggtgactgtacagtattgacaatacatattttggtatcgaagttttataaacaatgcagaatttgggtattactttagtaagatttgtgtgtatttaaaagctatgttggttcagcgacacagaaacacttcagtggagggtaatgggggcacaggggcaatagtgctcccatactagaagggtcctcccaaagcgggcatcgacggggacaaaacaccacattgcccttgcaacactgggcaaagtactccgctctggcgcatcaccaggagaggaaggggcactcccggaacatggcacaccacagtggaaccacctgggacacaagaagcactcgggcgacaagagacagaacacagagagacaagatgtccctctggaacaccgataccagggctttacaagggacaacacatacaacgcccatttaaggcgcaaaacatcggagagaaacctggggccgcaaagaccatgggtgtaacccgacgaggttacaggcagaacacgggaactttcgcccaggcaccgccacacgaaatcgtggcccggggccaacacacacgcggccgccacgagccagacaagcgagcgacggccgaaaacagtggcacagaacacacaccccgccgccgacacaggacacgcaggccaaaagagcgcaccacagcttcagtgacacacgcccaga

SEQ ID NO: 600344 - DNA, 906 bp, Homo sapiens
  misc_feature (81)..(81): n is a, c, g, or t
  misc_feature (155)..(155): n is a, c, g, or t
  misc_feature (186)..(186): n is a, c, g, or t
  misc_feature (199)..(199): n is a, c, g, or t
  misc_feature (214)..(214): n is a, c, g, or t
  misc_feature (217)..(217): n is a, c, g, or t
  misc_feature (253)..(253): n is a, c, g, or t
  misc_feature (256)..(256): n is a, c, g, or t
  misc_feature (258)..(258): n is a, c, g, or t
  misc_feature (271)..(271): n is a, c, g, or t
  misc_feature (279)..(279): n is a, c, g, or t
  misc_feature (301)..(301): n is a, c, g, or t
  misc_feature (305)..(305): n is a, c, g, or t
  misc_feature (315)..(315): n is a, c, g, or t
  misc_feature (320)..(320): n is a, c, g, or t
  misc_feature (327)..(327): n is a, c, g, or t
  misc_feature (336)..(337): n is a, c, g, or t
  misc_feature (349)..(349): n is a, c, g, or t
  misc_feature (357)..(357): n is a, c, g, or t
  misc_feature (364)..(364): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (383)..(383): n is a, c, g, or t
  misc_feature (409)..(409): n is a, c, g, or t
  misc_feature (512)..(512): n is a, c, g, or t
  misc_feature (521)..(521): n is a, c, g, or t
  misc_feature (571)..(571): n is a, c, g, or t
  misc_feature (655)..(655): n is a, c, g, or t
  misc_feature (740)..(740): n is a, c, g, or t
  misc_feature (760)..(760): n is a, c, g, or t
  misc_feature (811)..(811): n is a, c, g, or t
  misc_feature (820)..(820): n is a, c, g, or t
  misc_feature (829)..(829): n is a, c, g, or t
  misc_feature (833)..(833): n is a, c, g, or t
  misc_feature (835)..(835): n is a, c, g, or t
  misc_feature (846)..(846): n is a, c, g, or t
  misc_feature (879)..(879): n is a, c, g, or t
ccatatctggacccaaaagggacttccctgctcggctggctctcggtttctctgctttcctccggagaaataacagcgtcntccgcgccgcgcatggagcctcccggccgccgcgagtgtccctttccttcctggcgctttcctgggttgcttcnggcggccatggtgttgctgctgtactccttntccgatgcctgtnaggagccaccaacanttnaagctatggagctcattggtaaaccaaaaccctaanatnanattggtgaacgantagattanaagtgtaaaaaaggatacttcnatanacctcctctngccanccatacnatttgtgannggaatcaaacanggctaccngtctcanatgacgcctaatnanananaaacaagtccataaatacgggatccnttaaatggccaaacaatccctgcaaatgggacttacgagtttggttatcaaatgcactttatttgtaatgagggttattacttaattggtgaagaaattctanattgtgaanttaaaggatcagtagcaatttggagcggtaagcccccaatatgtgaaaangttttgtgtacaccacctccaaaaataaaaaatggaaaacacacctttagtgaagtagaagtatttgagtatcttgatgcagtnacttatagttgtgatcctgcacctggaccagatccattttcacttattggagagagcacgatttattgtggtgacaattcagtgnggagtcgtgctgctccagantgtaaagtggtcaaatgtcgatttccagtagtcgaaaatggaaacagatantaggaattngaaaaaaantttncnacaaagcacanttatgtttgaatgcgataagggttttactcganggagcgacacaattgtctgtgacagta

SEQ ID NO: 600345 - DNA, 329 bp, Homo sapiens
tatgtatgtgcgcatgtgtagagtgagtaagtcatgcctatgtctactctgctagggcttctcgtttccacagtgtgtgtttgaaccatgatggctgtaataggtgtgcaatggtatgctgttaacatggctgttaaggatcattttggatgctcaaatgcaagttttaaggcaactttgtgtgaagtaaaagtttttacttcagttaagtaaagacaggaaaaggctgaacctttagaaagccagaagaaaggataacagcattaaaatgccagaagatggaaaagaagtggggccgagtatggtggttcatgcttgtaatcccagca

SEQ ID NO: 600346 - DNA, 958 bp, Homo sapiens
ggtttcggagttgtttttctttgatacgggagttcctccttgctctcgcccctactctttctggtgttagatcgagctaccctctaaaagcagtttagagtggtaaaaaaaaaaaaaaaaacacaccaaaggctcggagccacaaaggggatgaaatttcttcgggaaattcctccgggttctcccgttaactggatcgtctggctccctaagaagtccttcgtgaaagctttttaatccctcaagaaggagaaatatcagtcaccggcggaaaatctggctgattcacaggacgctggggcatgggaatggggagactggactggcctaatgaaatctgcgctaaaccttaaagagcaagctgggtcactcggggatcaatacattaagcatgggacctgggagcgaaaccagttgccaaatggcaaggggacctgggggtgccaagggtctcataccttcgggggtacactgcagcacccgagaaagatttttacagctctgccaaggaaagggtgaaggcagaaaaatgggagatgtgagtatgtaaggtaaataaggcggggatgtagtcctactacactcagaatgtggatggctacacaaagaaccttcagattgaaacagcacctttggaacgttacgggtaccttgcacacattatctgggacttcaccagggacatttcttcccgtgcaatgccgaagaaaataacctagtggaccataatgcgaccccttgctggctttctggccagctggacacaatgttctccgggtccccatttcttaacggggcgctaaacggtgttcaagtgaacagtttggctgagtagttgggatcttccatgcaaactttttgtacatggagtgaaacctgggcgtgccttatcaaaatcactggggtacaaacaaaagtgtggggtccccaatccgggaaacaagggattacttaacaa

SEQ ID NO: 600347 - DNA, 494 bp, Homo sapiens
  misc_feature (358)..(359): n is a, c, g, or t
gcctggttgctcccatgactccatgcttggttggcccttattttatttgtgcccaaaagattgaggattagactgggcgagttcttacctgtcctaggggagccgccaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggnncttgacattatactcatttagtgagagtagatgcaaaaaagtggaggggcaggagaacttctccagacacctcagataaagtccggagcccaaggctttatcttaaccatgtatggtaccccattcattcatcaa

SEQ ID NO: 600348 - DNA, 90 bp, Homo sapiens
gagggtctggggagtcgatggagggagccaggcagggagggcgaggtggtaccggattgccagcccggtgcgccaaaaaaaaggcggggg

SEQ ID NO: 600349 - DNA, 458 bp, Homo sapiens
ttccccaccctatcctggagcttgtcaaggccaccagagacctgctccctgtgccgtctcagactggactctggggtctccggtgcctcctctgattctgcacctcggtgcagcctctggcctggctgcgctctgaggagctccctgtggccaccgagcccttggaacgtggccagttccattctcaaactgctgtgagtgcaaagctcatgctggattttgaagatttgattgctggccaggcatggtggctcactcctgtgatcccagcactgggaggccaaggcaagaggatcgcttgaggccgggtggttgaggctgccgtgagctgtaatggtgccactgccctccagcatggatgacagagaccccacctctaaaaacaattaattaattaaaattaaatcagtaaaaaatttttttaattaaaattttaaaaaatagattattaaaacaaa

SEQ ID NO: 600350 - DNA, 316 bp, Homo sapiens
atgatagcacaactagggtcagttttgcaggtggtaagccatttaccaagatagttgtaggtaaagaagggcagatttattagagaaatgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcctacaataattgttcattattgttctcaacttggggctctccccaacctggggacccttcctta

SEQ ID NO: 600351 - DNA, 641 bp, Homo sapiens
gccaagggtccaacgaggaggcatgcgaggggtctgagggagcaaggtaccaggtgagggccggagctcaagaggaagcctcagagaggaccacggaaccgggacacaccatcaagccactccgtgtgaggggcacgcccagtggagcataccagcccgccgggaggtccttggcacccaaaaaaatcaaaccctacccccagggaagaaaagcagcaaagcgagaatccgccaaggtctcaacaagcgtagtggaaccacccaatacatgccacggtgtggcagcgcaaccgtgcaaggggtccataagacaggacagcgaggagaacccgcttggcaaacactggcagcaagcccagacagctcaaggtgcacaggagagtgaggggacaagggactgaagtatctgtcccggcgacactgagaaggggcacaccaggcacaagaaggccgcagcgatactcaaggcgcgccaggggggggcaagggccacaggccagaagggggcagcacacacggggaaagagcccagacagccgtcacgacaaacacaggccggccagcaagcaggacaaggcgcagcagggcacacacggaagcggaagacgaacaacaaactggaggccgacgagacagccgaa

SEQ ID NO: 600352 - DNA, 98 bp, Homo sapiens
gccaggtgattggtgaaaacactaaacaaccctgagcccagggccaacccctacggaacaccactactttacccagacgccacaggtcatcatctgga

SEQ ID NO: 600353 - DNA, 706 bp, Homo sapiens
catggaatgaatgtgtgaccagaaagtggcttgacaccaaggtgctactgtccccttgtaattggcttctaacaggattcaaccagaaataattgataatgtgaattttgttaatgttcacttgtaggaaaatagaacatgtatcacccttgttaggtagacatgaacttttcctgcacaaagccttgcttttagagaatgcccaataaggcaagaaaaagcatagtaacttgtgctttgagagctcaatattgtatcttatcagtacagaagaaatatttctggtgtaacttgatcttctgtctagtacttgtcttataggtaaccaacactgaaaacttggtagtgatgactaccaaagaaatacatagtaaaacaaccttttatttccaaatggttaaagagccagccattgatgctgctacatgagttccatgctcaagagccatcgtaagagatctaaggggtctctctagcgttcccgctgatccccgtccgtctcaccctcgtctgctcacatcagggttcccttcttccttcttcaatttctttgattaaaacatacacacagctgttagcataaagtcgtggggggcattcttctgggaatgctcagcagttctgattaactggcaagcccaggttgctctcatgaggcactgaaaaaatcctgtgtcttgatagcatgggtgctgtgtgtgtgctg

SEQ ID NO: 600354 - DNA, 1726 bp, Homo sapiens
tcggcgctgcgcgacatcatgagggaaatcgtgcacttgcagtgcctgggcagtgcggcaagcaaatcggcgccaagttttgggaggtgatcagctgatgatgcactggcatctgaccccactgtggcacctaccactgtgggacagctgaccgtgcagcatggaactgcatcaactgtgtactactaatgatggccacctgtactggcgaagtactgtgcccctgcgccgttgctctgttggatcttggagtccctggaacccactgtgacctcctgtgctgcatctgtgggccctttcgtggcatgactcttcacgtgcctggagaactatctgttatacgtgtcagacgttggttgcttgggaaacaacttggtgccatagtggtgcatctaccaccacgacagtgctgcgtgcagcataggtagggacctctgtgatgcattggcactgctcggctgactgaacatgtgcaggcatgaagaaggcttgttgtacattggcccttgccgaggcatttcgcatgcgtgacaccccacaaacataccccaacatggagaggctatgggacagcagcgcgaccacattgtgggctaccctaggcgaggaacataggggcgatcaacccaccatcccccatcccaaatccaacagtcaaaaagaacaatcacagagcgaacatggacagataacacccacacgcaccaacggggacatacacattgacacacacccgccgtccaacggctgcacgagcgtgcgcaccaatactctaggcacccaccaccacaaggactggcttcacgtacgcaccaaagggatggagatggaggaacggcacccaattaaccacaaaaggggcacccaccacgccacgtacacgtacaacgagagtacacaatacacgcaaggacctatccaggcatcacggcacaaaccaacaacacaccagacaccacgcaagcaaccacccgtaaccacaagggcgcaagaaagtgaaagaaacagcacgagcaagagagaccgcccagtccaattaacaggcaacaaacagtactacgaggcatgagccacgagacaaacacaccccctaaacaacaaggccgtcgaacgccacacaacgcccaacacccaagacatgggacttgcaccccattaggaagccccacacagataggaatggacaccacgggataccacgcccagagaacgagctagggagcgtcaccaaccacacaacccatgggcacataagcgcaagccagaccaccacaaagcgccccagagagatcgcaacgagacctcggccacctacgcacacacaaacagccatggagcacgtgcgcaacacaacatgtacgacaccaggcacatcaacccagggagtcgtgcagacacaacaatcaaacgaacaccggaaccaggggcacgccaacgatgcaaccatccagggcgaaacaaccacgcaaccacacgggtaggtgcatgaaccagaggaccagaaacagacacacccccagagaagactgatatagatagcgaacaacatacaaccgaacatagagaaaccaactcgagagaacccaccagcacaaacgccagatacagataaggagtacaccaagcaatacataagagccacagcctaccacaagcaacgagcaaatagatcaatcacgacgacacgacgacgcaaaacaacacacacacgagcaaagaaactgac

SEQ ID NO: 600355 - DNA, 694 bp, Homo sapiens
  misc_feature (3)..(3): n is a, c, g, or t
  misc_feature (5)..(5): n is a, c, g, or t
  misc_feature (118)..(119): n is a, c, g, or t
  misc_feature (156)..(156): n is a, c, g, or t
  misc_feature (272)..(272): n is a, c, g, or t
tcncncggcggggcaggcggttttattacctttgggcggccccctttttaaaaaaaaaaaaaaaaccccctttttcaaaaaaaaaaaaaaaaaaagggggggcgccaacaaaaaaaannttttttctttaaaaaaaaaaaagagacggggaggggncccccccctctttttttttttttttttttaaaaggaggggggggggggggggttttttttttttttttttttagaaaaaaaaacacacctccccctcccccccgtggtttttttgnccccccccccaccccacttctctcttctcttttttttttttttttttataaaaagaaagggggcggcggggtttttttttttttttttaccacaaaaaagaaaaaggaaaaaaaaatttttttttcccacaaaaattgggggcgccaccccccccaacaaagtgttttttttaaaaaaaaaggcccctccccccccttttttttcactctttttccaaaaagagggccccccttaaaaaaaatttttgtgaaagaggagcttcccccccccggggggtttaattttttttttccccccttttttttaccggggggcccccccctcttttttgggggttttttgggaaaacccccccccgggaaaagccgggtaaaaagaaaaaaaagggaattaagggttcccccttccttgggccaaaggc

SEQ ID NO: 600356 - DNA, 701 bp, Homo sapiens
  misc_feature (12)..(12): n is a, c, g, or t
  misc_feature (14)..(14): n is a, c, g, or t
  misc_feature (16)..(16): n is a, c, g, or t
  misc_feature (18)..(19): n is a, c, g, or t
  misc_feature (22)..(23): n is a, c, g, or t
  misc_feature (32)..(32): n is a, c, g, or t
  misc_feature (53)..(53): n is a, c, g, or t
  misc_feature (55)..(55): n is a, c, g, or t
  misc_feature (64)..(64): n is a, c, g, or t
  misc_feature (66)..(66): n is a, c, g, or t
  misc_feature (72)..(72): n is a, c, g, or t
  misc_feature (74)..(75): n is a, c, g, or t
  misc_feature (93)..(93): n is a, c, g, or t
  misc_feature (99)..(99): n is a, c, g, or t
  misc_feature (101)..(101): n is a, c, g, or t
  misc_feature (113)..(113): n is a, c, g, or t
  misc_feature (129)..(129): n is a, c, g, or t
  misc_feature (133)..(133): n is a, c, g, or t
  misc_feature (139)..(139): n is a, c, g, or t
  misc_feature (143)..(144): n is a, c, g, or t
  misc_feature (152)..(152): n is a, c, g, or t
  misc_feature (155)..(156): n is a, c, g, or t
  misc_feature (159)..(159): n is a, c, g, or t
  misc_feature (162)..(162): n is a, c, g, or t
  misc_feature (172)..(172): n is a, c, g, or t
  misc_feature (179)..(179): n is a, c, g, or t
  misc_feature (181)..(181): n is a, c, g, or t
  misc_feature (183)..(183): n is a, c, g, or t
  misc_feature (187)..(187): n is a, c, g, or t
  misc_feature (190)..(190): n is a, c, g, or t
  misc_feature (193)..(193): n is a, c, g, or t
  misc_feature (198)..(198): n is a, c, g, or t
  misc_feature (201)..(202): n is a, c, g, or t
  misc_feature (204)..(204): n is a, c, g, or t
  misc_feature (207)..(207): n is a, c, g, or t
  misc_feature (210)..(210): n is a, c, g, or t
  misc_feature (213)..(214): n is a, c, g, or t
  misc_feature (218)..(218): n is a, c, g, or t
  misc_feature (220)..(220): n is a, c, g, or t
  misc_feature (225)..(225): n is a, c, g, or t
  misc_feature (228)..(228): n is a, c, g, or t
  misc_feature (231)..(231): n is a, c, g, or t
  misc_feature (236)..(237): n is a, c, g, or t
  misc_feature (244)..(245): n is a, c, g, or t
  misc_feature (257)..(257): n is a, c, g, or t
  misc_feature (259)..(259): n is a, c, g, or t
  misc_feature (261)..(261): n is a, c, g, or t
  misc_feature (264)..(265): n is a, c, g, or t
  misc_feature (276)..(276): n is a, c, g, or t
  misc_feature (280)..(280): n is a, c, g, or t
  misc_feature (282)..(282): n is a, c, g, or t
  misc_feature (285)..(285): n is a, c, g, or t
  misc_feature (294)..(294): n is a, c, g, or t
  misc_feature (299)..(300): n is a, c, g, or t
  misc_feature (304)..(304): n is a, c, g, or t
  misc_feature (310)..(310): n is a, c, g, or t
  misc_feature (324)..(324): n is a, c, g, or t
  misc_feature (327)..(327): n is a, c, g, or t
  misc_feature (333)..(333): n is a, c, g, or t
  misc_feature (335)..(335): n is a, c, g, or t
  misc_feature (340)..(340): n is a, c, g, or t
  misc_feature (345)..(345): n is a, c, g, or t
  misc_feature (351)..(351): n is a, c, g, or t
  misc_feature (363)..(363): n is a, c, g, or t
  misc_feature (368)..(368): n is a, c, g, or t
  misc_feature (381)..(381): n is a, c, g, or t
  misc_feature (418)..(418): n is a, c, g, or t
  misc_feature (431)..(431): n is a, c, g, or t
  misc_feature (458)..(458): n is a, c, g, or t
  misc_feature (622)..(622): n is a, c, g, or t
  misc_feature (678)..(678): n is a, c, g, or t
tataggttggantntnannttnngattatttnttttgttttagcaatttagananatttatttncntttttnanngattttttatttataaantttcgntnttaaattttttntgctcgtttttaaccngttnctgttnagcnntaagaganttnnatntgntttttttttntttttananantttnttnttnttttntannanttntantannaaananttttngtnttnttatnntttattnnagaagagaaaantntngtnnatcattttttntttnanatnttagttttntttanntttngatttngaaaggtatttttntcngagaananctttnttttngagatntttaggaagatnttttnttaacccttgatntttagagattgggggctggtgatgggggtttggcttnattgactggatantgttatctttcatgagatatattatangaagaagggcagatatatatatgaattaagttcagccaaaaggatcaaatgagaataaaacgatttaaatatatgtacacacgcatgcacacacacacttagtcttgtaatttcaggccagaaattctcaacactattttgcatctgttttctttttctaagtnatgataatatagatgttctggtctatcataaaagaatgtttatgtacatttcagtnattcggtatgtggctttgtaaat

SEQ ID NO: 600357 - DNA, 365 bp, Homo sapiens
cctggtttttggtttggtttggtttgttttgccaaccacaagccggtttttaacccaagtttggttgggtaaaggaaataaaggtgtttatttaaaagggggcccttcccccaaggccaagggtttttaaaatttattgggggaaagggccggggatttttttttttcccaaatggttaaaaaaaaaaccggtttatatgtttttctggggttaaaaccaaaggtttttttttttatggccttcccccggaaattttgggggtttccagggcagccggccaaattttggtccggtagtgggccggattcaaccacccccgaaaggttttttggccctttgtttaaaaaaaaaacccgtttgggga

SEQ ID NO: 600358 - DNA, 237 bp, Homo sapiens
aatccttgataaatcagactaggtcttgtggcaaaggcacccaaagctaatgaagaagagtaaatgatatttgactgtcacatatgaatataaggacgaaaaagaaaatacaccaatacacatatctacaaggaaaaaatcaaatgcatgggtatgtaagtaagatattttaagtatgctagtatccacaccaagaggctaggcattcacctgtatatctctaattgaaaaatacgc

SEQ ID NO: 600359 - DNA, 479 bp, Homo sapiens
atcttccttcagcgagatgcacatgagccagtggtttaatagaacatttagcaggtgaacacgcaccctaagcccagggttttatacccgcttcttaagatggccaattcttcttctcccccccacccaaagacatgtgagcaactgctaatgaaaagcagtaaacagccgcttaggctatagcagtatcaactccactctgaggtgacgattccaattacatacgagacttaagttctttcaattttttcctaacaaaagttcctgagtccagtatttacaatattacagcactagcagctcagtgtctacaactcatattaaactgcagtatcctcttcaccagtagggggagggactgcacttccatagagtaagcagataattggtagaacaatttcttccagttccttcttcttagctctgaagtcttacaatgtcagcatctaggtggcttaccggccatacaatctttacta

SEQ ID NO: 600360 - DNA, 524 bp, Homo sapiens
  misc_feature (135)..(135): n is a, c, g, or t
  misc_feature (377)..(377): n is a, c, g, or t
  misc_feature (474)..(474): n is a, c, g, or t
  misc_feature (483)..(483): n is a, c, g, or t
tgacaaggccttgctcagttgcccaggctggagtgcagtgctgcaatcatagctcactgcaacctcaaactcctgcgttcaatcaatcctcccacctcagcctcccgagtagctgggactacaggtgtgcactgnaatatctagttaatatttttacttttaatagagatggagtcttgctatgttgtccaggctggccttgaacttctggatccaagtaatcctctcacctcggcctctcaaagtgctgggattacaggcataagccaccacgcccagacttgatcatttctttaaaagttaaatatacatacctccatgacccagacatttccactcatgggctatttatctaacaagaaatggaaagcattatngttccacacaacttgtaacatggaatgtttcattagggagctttatttgttaatagcccaaatctggaaacaacccaaatgtctattcaacaggtgnaaggggttnaacaaatttatgggtctaggccataccctgggcatattctt

SEQ ID NO: 600361 - DNA, 145 bp, Homo sapiens
atcaatatgtctcatattcatgtaaatggaagggagggtaacatgtactgaaataatctgcatgctaggcattggcttagaatatccgtacctttcgtcacttagcatttgtggactaggaatatccagattcagagcatcatgt

SEQ ID NO: 600362 - DNA, 112 bp, Homo sapiens
agtttggagggaggggaatggaagggcatggaagttttttttaataatttaaaaaatatatatataattttgagaattgagcctttaataaactgacttttgtttttatgga

SEQ ID NO: 600363 - DNA, 595 bp, Homo sapiens
tcctttcctcctctctgcacaccagcactttgtacccgaaaaaaactcacgggggtgcactgcaaacaccgcccagctccagggcccgaaaaccctcgcaaccaggccccgggatgcctgaggtctcccaggtcatttacggtggaggaactcaggccgtgcctccctgtgcgcaggaggaggaggcgtcgcgggagctgcagttccccgatcctttcccaggaagccggccgggttggaaggggagagggccgtatatcggtggtgcgaattccaactcgacagcctcgtgggagcacgttgcttaattaagggtcaatttaaaacaactaagtggtgccggcagggacgccgccgcatgggtcaggaagaagcccgcgctattattcatccataagggagcatggcttatcctggggtgtcgggaaaatgtgggcgctgtgccagacaggcccccgcggaggttgccgctctgctctgaacctataagcttcccccagagcaagtggatttgccgcagcctattaaccgccaccttccccagggcccccctctgggggcggaaccacccttagatggcaggaattcggagaca

SEQ ID NO: 600364 - DNA, 165 bp, Homo sapiens
ccttcaagccaagggtagaagagaagctattgtgtctcttttagccttcccagaagaaatgagtcagactagttacttcatggccagccccaccaagaaactctcagaaacatttagcataaactagctactatctttttccgttctcacatttccattacttcc

SEQ ID NO: 600365 - DNA, 163 bp, Homo sapiens
tatcctttgaaccccttagtgggaagagctttacactttccacagaacagaaactacaataacctgtttatacaatatagtcacaaattacagtcctcgatttttatgcccatacacttaattttttgtctaaaacattttttctttgtagcagctaaggccc

SEQ ID NO: 600366 - DNA, 101 bp, Homo sapiens
accccgtattggagagaagtttgggatggagtgggcgagagattgagagagcgagcaggctccccaacccttgtgaagctcatttcatcatcggtgccatg

SEQ ID NO: 600367 - DNA, 1390 bp, Homo sapiens
  misc_feature (203)..(203): n is a, c, g, or t
  misc_feature (1390)..(1390): n is a, c, g, or t
gatcagtctggctcagcaagcaggaatatcgtgatacacatggtagcgagcggccctgcgagtgttataactgagtgccactctaccacgttgtggatacacacgcgaagatccattaggttgagcgcagagtgcgtggtgtatcaagccctcagagcgaagctcaatgaatcgcttgctggactctagtgctgttcctatcncatccatagtcctcgaatgtaccgggacttgcgcattggtggagacgtatgctcgccataggcgcgttgtcaacccgataacctaagttttaagtaggactttcgagcacaatctgactagagtccacaatcaagtgcagctcacatgatcgacatgatagcaagtccgtaggtagaaagggcgtgatcagtgttacgcctcgatggatgcgcctccgcggagcaacgagagataactctagcgatgggtgagctcgtcgtcagtggcacagaagatgcgatgtcgaacgagaaccccctgggaatctacctctgggctgcaagggaactaacaagggttgggcagcgtgcggagggaaagcgataaggcacgaatacaggccaagcggaacgcatcctccggcgagtaggcctcacaatgcataacgacgcaagcagaaaaacaacaggtgctcgcacgttgcgcttcgatgcaaagcgacataggcataaccgggcccacattcctgccacatgaataggacggacacaacgcttaactgccatggaaaaagccctgggacgcatgagataggaacaagcctccgctggcgcagccaatggtgcgacggtttgtacacgaatcacagagtgcccaaatgtggctgtgaccgccaatgtcccgattgacccacctaaagtgcagtggatgccgcgacctattcgattgtgcgattcacaccgtgctgtatccattgtggccgttacgacttcaactcgtcgcgcgcacgcacagtgttgacaaccaccgtttgtgcaccctatggggatgttacgcccttgttgcaggcgttattgagcacatactcgtgagaaacacatggtattacacacatgtgctctgcggaggatgcgctcctggatatgttgatgcgaatccgcctttctgtttgaattctgagccaccactgcccatatcattcggatgccagcgctatcgaccatgcggagcacactctgtcgaacagacgccggttcagcgtcaatgccgctttaagacagttctggtaaccaaagtttttcgtatcgccccatagtggggggtacgccaattcggtgactagatcttcctgagcaaccacataatgtctgtttccaacacgcgaaacaagagttatgacggtaatgtttcgtgaatcccaccccgn

SEQ ID NO: 600368 - DNA, 483 bp, Homo sapiens
  misc_feature (48)..(48): n is a, c, g, or t
  misc_feature (76)..(76): n is a, c, g, or t
  misc_feature (185)..(185): n is a, c, g, or t
  misc_feature (198)..(198): n is a, c, g, or t
  misc_feature (297)..(297): n is a, c, g, or t
tcttcaagcccgggggtgcccttatgagggtctcccccatcttccgcnttcttccccaacgccaggaagtcatccngatgcacttcacggcggttccaagtaagttcactgggatagatgacggagggagggaaatgagagcccaggcaggctgagaccccccaagccacaggcaaacgttcaantcccgcgtggaanccatcaaccccaggggcccttcaacggtgcgtcccgtctgccccatccccctgctccccactgaaggggctctctcggttcaccagccctcacactagncagggcccatctgagatagttttgactccgggggacagcagaaggtgagtgggtcacatagtgtcccgccaaattcacgtccatccggaaccttagaatatgacctggtttggaaatagggttggctgggtgtggtggctcacacttgtaaccccagcactttgggaggccagggtgggcagattg

SEQ ID NO: 600369 - DNA, 139 bp, Homo sapiens
cggctggctgtatacactcgccatacttcagagaagtcagtggagaaatgaagaaaaaggtggtgaaatcactataccatcggttactgtttcgttgacaaaatatataatggtttactgtgtcattgtccatgcctac

SEQ ID NO: 600370 - DNA, 307 bp, Homo sapiens
tgccagataaactggctgttgtggaccaattactagccctctttctctgtataaatcgtccacaacatccagtgtactgagcgattacaaagtcaggataatcttgtaacacatggtgcgttagcattaacataactacagaaggagaattggcttataaacctgaagacaggctcagcacggtggctcacacctgtaatcccagcactttgggagtgcaaggcaaacctgaactatagaagcatccttgagttgccaacgttcacagtgatgaactttcaaaaatagcgaaactggctgcagagca

SEQ ID NO: 600371 - DNA, 932 bp, Homo sapiens
ctggggctgtggcgttccgagcgccggttgtccctcgtattctctgacaggtttccttcatctggttttcctcttccgcgtgttcttcgggctcctagcgcttcctggttcccctgactcctctctggccacaccctgggctcctaccctggtggggctgtccgcaccctcttgggtcccggggcgaaatacctctgcccggtcgtgtatcatgcctcccaggggtcaactcctggccctttggccacgggcgtgtatttcgtcgtgttgccaacccccggcccgtgttaaggaccacaccgtttcctcttcgcccaagaggcgaacttaacattacctggtgcaagattttgtgcggcgcatcacacgcggcggccttgtgccatgattggcccgcctcggaccaagtctttggcctcccccgagggcctcagcgtccgtctctcccgggcgtcaccacccaccgtactctcccggtcgtgcccgctggggcacctcacccctatcgcgcgggctgtttttgttcgctcggctctcaaatccatgacgccggtccagcgggccccccactccccgctcctcccgcgcgccccttcgccgtctcgccccctggagtgcagctagccccctccgcgcccccctcacagggcggcagtgtctctccccgcagcggcaccgagcccgggcggttggccaccccccagcagttccaagcccggcgggtgccggcggttggcgctccccccacaggggggggagaacagaaggccttctccctttcctggggaggtgtggctccgcggtggcccccacccccgtggagtgacgcaattttttggtctgttctatagcgattttctggggcgcaccacccccctcgcgggcggcttcatacagcgggcaccaaacgcccccggcccaacaatgacaaa

SEQ ID NO: 600372 - DNA, 112 bp, Homo sapiens
cggagtttgagagctcacaaaggaagggctatatgtaaattaaccgagaggtgcccaatgtttgaccaagggcaacttaacatggcctcttgcttggagggcccttacatat

SEQ ID NO: 600373 - DNA, 878 bp, Homo sapiens
cctaaacttgggaaaggccccatgggggaagagcccccagggcttttaagccactgatttttgcgttctcccagaaggagcgtgtggggtcaccagtttttcccctgtggggccccccccatccccacccagaacccactttgtggagaccttctcgccccccccccagaccccgctgtggaaaggggttgggggtggcccccctgcgttgcgcccggtggtcaccacgatgcgtgcgattttctggggagtgctaccctcccctgccagagagagttggcctcgtggaagactgtgcccgcgttataggcctttttttcacagagggatatctcctcaaaggttttaagagcgtttataccacttccgcgcgcttctactttgccagagctctggccccatacccgctgggttgggatgggaagagagatttgaggatattcttcttctatatcacagggcttgaccatatagactggggggtgtgtgtggataccctctccacgcatacccccactaatctctgaattgtgagaagaaagggagccacgccccggaaaactgtcttatgagggaatgctttaaaccccacccctccttcctcccccgctcacttgttatctgtataactgggaccacacagagaaatatatggggaataatgttgggaattttttaccaaccacggttataattgggaaagcactagaccacttatgctgtagaccactgaatataaaggaaccattgggaagtttttagactcgaagatttgattaaagtaccctttcaagtggggaccattgtgtgttgattgggctagggttttccccggtgttttaaaccaaaatgggattgataaaccccttttttaccca

SEQ ID NO: 600374 - DNA, 173 bp, Homo sapiens
gactcttctggggagctaggagtaatgggagacaaaggtgaaagaggtgaaaactcagtgtccgtcaggagtgtcggcagtactaaacgaggccgggctgaagtttactacatgtggtaccgtgggggacaagtttgcgatgacgacgtggcacaaattcttgatgccacttg

SEQ ID NO: 600375 - DNA, 1061 bp, Homo sapiens
ccgtgttgttgttgtgttttgttttctttgatatcacctagtgctcgacgtgacagacagaagatagaactgaatacgtaactgtcgtcatatgtagcgcgtgtttttgcatcccttttcgtcgcttctcgggcctgccccttgtcctggtggggcccggtgtccgggttccccagtcgtatggccggggttcacacttgagggccggcagtaagccccgggactttcggggactatccctggattacgaggtgaagccctgcaccaaggcgccccgttgtccagggacatgaaggttcagtccctggggattcttatgtgcgttgtccgcccccatttaagggatcagaggtctcttgagttctgtcctggggccttttttcaaaggatgagggttttgaagagttatccccggccagaagcacgaccccgttgccggcctagcagcacccaggttcaaggcatttgttgctatccggggacatacctatggccaccatccggtctgggtgttaaatgctcccaaagaggtggcccccccccatcccgtgggggcccatcaatcactggcgccagcatttcgcatctgtccccctgccccaggaggctatcttgggggaccacagatcggccagccccacacctgtgccctctggcaaaggtggaacaaggccccttgcggcttctgtgctgggtgacgcctcatccctgcaacccacggggcaactggcacttgttctgccgcaccccgtggcctaagaaagctgcttcactgatggctggtatcgatgactgctacacctcagcccggggctgcacctgccacacctgggcaaatttcgcccaggccaccctttgatgccacttttctaagacctacagctacctgagcccccgaaaccttctggaaaggagactgtattcacccagttctccctatcaggagttcactgaccccctcgtccagacccccccccgagtctccctgcaacggactccggctcccactgtggctaccaacatagggtttttataccagaaaaataaagtgaattaagccg

SEQ ID NO: 600376 - DNA, 87 bp, Homo sapiens
cccgaggacacggctgtgtattactgtgcaaggggtcgtaccataccgggcggtacaaacaactggttcgacccctggggccaggga

SEQ ID NO: 600377 - DNA, 449 bp, Homo sapiens
cttaaatatgtaacactggtttgaccaaactctcagattcatggcacactatcatcattggtaggtgatggtttgctacggtttttaatagctggtaaagtgaacacccagttcattctcctcattatctcctggattcccgcctaccgccatcagtcagtatgccctacatttttcttgacgtgaagcacagcctggagaatattccctgaaacagctctttaaacgcaatccaaaaaaggcatcatgctgacttaaccatgttatgaggaaattctctgagagctggggctgggcaagagccaagagagctgctgacagcaaagtgagagaaggcaggcctcagaaaggagaagagaaagatgcctggcaagcgagaagcaactggaatgctctgtaactccacattctcctataatttctccaaatttctctcactaaaaaaaaaa

SEQ ID NO: 600378 - DNA, 284 bp, Homo sapiens
gtttcatgggccgttgtatacatactccgggaacctgccatgatcattattcctggttccacggtctgatgtcgcatacccaggtcacatggatcatctcatctccgcttccaatgtctgatgcctccttccaagatatcatagctccttccaacatctcatcactcgtcccaagatctcatcactcggttccagcatctcatgacccttccaatatctcatcactccttccaacatctcatcccccttccaacatctcatcgcgcctatgagatgtaggaaag

SEQ ID NO: 600379 - DNA, 1634 bp, Homo sapiens
  misc_feature (1399)..(1399): n is a, c, g, or t
ccccacatgtgatccccgccccaagagccatgcatgtctgtatggaggaggtgctagcccggatccaccgggctgctgcaccaccaccatgcatgccacaagatatgcaggcacacagcgaacatgacccaatagaccatagaacgtgagacacagcattgagtcacaccggcgtccatatccgcacaccgctcgggacagaggaatgtgcaaaagtctataacgattcagccaacggttccctagaatcacgtcacgccaccacatagaagacatcactattgatataacgtacaccgcccatccaagacctatagaccatcggaaaaaacctgagatccatttgataatgaacagaggaacataacatcaggacgagagaatccaaaatagattacaacatatcgaataacatacagagaatgggaatcatatgataggaaaagaatgatatacaggggaccacactgaggaataaataagaaatagtatgaataagggataaaataggaaaataaagaaacataaatacaacgtcatatcataaataatcaagaaaaaaaaacacaacaaaagaaaaacaaacaaaagaaagaaaaacagaaacaaacgaaaaaaaacaaaaaaaaggggaacccacaagaagaaaaaaacaaagacacaacagaaaaaaagatacccaccaagaagaagacaaacaacagacaaaagaaaacagaaacaacacaaacaaccgaacaaaggaaagcaaaaacaaaaacaacaaacaacaaacaaaccagacacaacaaacacaaacaaagacaacagaaaacacacacacgcaaaaaaaaagaacaaaaaaaacaaaacaaaaaaagacgaaaaacacacaaaaaaacaaaagagacaaaaacagtaaaaaactaaccaacacaaaattcacacgaagccaaactaacaaggcaaccacaactaaagaacacacacaacaacggaaacacgagaatagacaaaccaaaagaggagagaacgaaacacaagcaaggaaaacagcacaaaaacaacaagaacagcgagcggagagacagtagcacacagcaaagaagagacagcagaacacagcagagcagacacacaaccaagaccacactagactcacatcacacatcataaacacagacacggacgcggatacacaagcaaactgacgtacaatcaacaagaagaccagacaacagaacagcaacacagcacacagaaccgacacaaagagagaagaaaacacagacacagagcaacaagcaaagaagacgcgcgagataacacacgaaacaagagacgaaaaacaacacaagacaagaaagagaaacaagacacgacacagaagaacagcagacacgacaagcaaacaacgacnaccagagaaaagagagaggacagcagaaggagagagagagaagacagcagaaagaaggagagaagagaccagcgagaaagaagaagagcaggcagaaacgaaacagaaaggatagacaacagaagacgacacacaaacagagcagaaggagacagcacacgacgcagcacacagaacagaaaaagaataagaaagagagacgacagagagaaggcaaaacgaaacagcgacagaa

SEQ ID NO: 600380 - DNA, 305 bp, Homo sapiens
  misc_feature (114)..(114): n is a, c, g, or t
  misc_feature (124)..(124): n is a, c, g, or t
  misc_feature (133)..(133): n is a, c, g, or t
cttctgtggtgtaccgtcaattgacttaagttcattcagtacataacccagcaatagacactttggtcccacctaacagtctgtctctgcctgaggctccaagagacctgttanagtacagttngaggttgtnctcaatggctaaggacatcaacaaatatcctgaagttgaagagataattacaagggaacccccataggttaccagatgatttctctatagaaacatctctggcaagaagggagtagcaagatatattcaaagctcctaaaagggaaaaacttgcaacctaggatatgctacc

SEQ ID NO: 600381 - DNA, 116 bp, Homo sapiens
ccaggctcagtccccccaaagtacgctgggactacagtgcacgcatcaccacatctggctaattttttggtcgagactggacattcgctatgtggcccagactggcctcgaattcc

SEQ ID NO: 600382 - DNA, 682 bp, Homo sapiens
  misc_feature (2)..(2): n is a, c, g, or t
  misc_feature (319)..(319): n is a, c, g, or t
  misc_feature (321)..(321): n is a, c, g, or t
  misc_feature (353)..(353): n is a, c, g, or t
  misc_feature (408)..(408): n is a, c, g, or t
  misc_feature (438)..(438): n is a, c, g, or t
  misc_feature (448)..(448): n is a, c, g, or t
  misc_feature (454)..(454): n is a, c, g, or t
  misc_feature (456)..(457): n is a, c, g, or t
  misc_feature (469)..(469): n is a, c, g, or t
  misc_feature (510)..(510): n is a, c, g, or t
  misc_feature (539)..(539): n is a, c, g, or t
  misc_feature (565)..(565): n is a, c, g, or t
  misc_feature (620)..(620): n is a, c, g, or t
  misc_feature (669)..(669): n is a, c, g, or t
gngaaggcggggagacaataaagtgtaataaggcacacagtttacactcgtaattgcatcctaaactgttgaatagttgatatttacaaccccccaataacgtttttgcatcctgaattagtccttcacatcttgatatttggcataatgttcaaacacactttatacacactgaccgctccttaaaccactcacagatttaataaataccgaaaaaattaagagatttgaaggcttgatcttctatttacttcaagatgacagaagagtaggtttcttgtgatgaaatactacaagaatgaagaattaacaaactgtngngtaattcatcagaaaagcatattaactctgcngaagtaccactgaatgaaacaaaaatgaagcggggaagtagcaatcggattggcnggcgggcgtgctatgtcccatcactctcgnagtcttcgancaccangnntgcctccacgcnccccttgggctgaaaagggctggggcgggcgagcaggcggntcacgggcgacgatgcggactcaaaggangagaccaggtttccggcacagtggcntgagtgggttcaccagagattcctctgcagaatgtcctccattaagctgggcgtnatctccgctgtcagggtctatcactccatgttccctgtcagtcagggcntccattttcaatc

SEQ ID NO: 600383 - DNA, 890 bp, Homo sapiens
  misc_feature (2)..(2): n is a, c, g, or t
  misc_feature (73)..(73): n is a, c, g, or t
  misc_feature (114)..(114): n is a, c, g, or t
  misc_feature (346)..(346): n is a, c, g, or t
  misc_feature (419)..(419): n is a, c, g, or t
  misc_feature (442)..(442): n is a, c, g, or t
  misc_feature (454)..(454): n is a, c, g, or t
  misc_feature (498)..(498): n is a, c, g, or t
  misc_feature (507)..(507): n is a, c, g, or t
  misc_feature (509)..(509): n is a, c, g, or t
  misc_feature (627)..(627): n is a, c, g, or t
  misc_feature (722)..(722): n is a, c, g, or t
  misc_feature (761)..(761): n is a, c, g, or t
  misc_feature (777)..(777): n is a, c, g, or t
  misc_feature (784)..(784): n is a, c, g, or t
  misc_feature (811)..(811): n is a, c, g, or t
  misc_feature (828)..(828): n is a, c, g, or t
  misc_feature (875)..(875): n is a, c, g, or t
cnaccagttacttttcttgtttcttctccccaacagtgaatcatcaaggccatggtgcttaaacacaagtgtnttcctttcacgtcttactactctccaaatcggagtccatcncttcacttcagttattccacaaatttcatataaactagtccaagttattgtgctagggctaagattctcaaacctgaaatccgaagggggccatgcattggtatacccgccgcaatacagggactcggtccaaccacggcgggggtataggctttcacctggttaaccattttggccttggcgaggggggtttatccagtcgctgtactaaacccatggtggtggggtgatnttaatatccctgtgggggtcccaattaaaccagggccggtggcattctttagtggatattcccctggggcggnaagaatggctccccccgtggcgntggcggtggtcnctggtccagcgacaggttgggcgtttgttttctcctccctaccnccggttctntntttgggtgttttaataccaaactgtccccagaacaggagtatagcaaaaattgggaaaataacaataagaatattttcatttggagaaaccatgaaacaacacgatattttagctcgntgatcgtttcaccttctctggttaattctgttacttcacaagtgtagtttcctgtgtgtgagacagcatcactcttatccatcttcaaagaggcntctccttttagtaattgtgagacttcaatttttgcactnctaaagtcagtggggncagtggncttgtttagagctccatcaaaggtgtnaatatctcttcctttanatttccccttttacgtatacttcagtagtgttttgtgcctccatatnggtatcaaagcttgg

SEQ ID NO: 600384 - DNA, 371 bp, Homo sapiens
  misc_feature (1)..(1): n is a, c, g, or t
  misc_feature (279)..(279): n is a, c, g, or t
ncgatctatgtgtcctggatttggttctccactcccgcatatggtcttatatctcaccacgagagtatgttgcccaaatgtgccatcgaccacttctcttggtgtttaagccccacagtagaatacatatttggcgtgtagctcagtgaaagcaatccttaatctatgtccattctgtggtttaaaagcaggtattgtttataagattcacacaacagccaatcacttccacagtagtgaaagtgtggtccataaggttgtccagttccagaaacacanagcgaatgtccttcatccccatggtaaccatatgaatgcttatcacaccttggtagtctattcatgttcacacctacttcaaaataataaat

SEQ ID NO: 600385 - DNA, 142 bp, Homo sapiens
atctatctatgataagtaatgtaagggcctgtccatcagtactcctgtagagcgaacttcctctgaaatctcttggcagccttgggagagaagcactaaactacgtagacctcctctacactccaacggactagagattact

SEQ ID NO: 600386 - DNA, 630 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggcgtttctgtttttatcagtttaatctgcttgtcacagtcaagaatgtgagaaaagactggatgcggtgagccaagacctgtaatcccagacactttgggaggccaaggtgggcggatcacttgaggagttcgagaccagcccggccaacatggtgaaacctcatgtgaattgcttgggcctgggaggcggaggttggagtgggctgagatcatgccgctgcctccatcctgggtgacagagtgagtgggact

SEQ ID NO: 600387 - DNA, 2633 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600388 - DNA, 2430 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgctgcctggtgctcccaccttcttgaattggggttgccaacaaagccgcccccaccacaaa

SEQ ID NO: 600389 - DNA, 255 bp, Homo sapiens
ggaggtaccctagtgaacgaggtgcacctcggtcgaatcaggtcgtcagtgtccccggtggcgcagagaagggctgatgggaagacactttcgtccgtggtggaccaggccccgatactctgcggtgcggaaaaaatgtataatatggtctgacacaggtgcctcaccttctcctccctcaaaactcaagttcccctcatgggctatacttgcccgcctcgagtttttcctaagggcccgaggcgaacccctggt

SEQ ID NO: 600390 - DNA, 2701 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgtgtgggggtggcacaccagggggtggcacagggggcaaggctgacctggcgctctcctgccccgggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600391 - DNA, 2551 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgaggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600392 - DNA, 487 bp, Homo sapiens
  misc_feature (111)..(111): n is a, c, g, or t
  misc_feature (178)..(178): n is a, c, g, or t
  misc_feature (180)..(180): n is a, c, g, or t
ggaggaccctagccggaacccggtacctgccaggctacgtacgcccaggttatatatacgtacaagagaacactgcagatgcttgcagggtttatagtatgacctcatttnggttaaaaaaaaatctctatacaaatctctatttgtatgtagtggctcatgcacgtatgaacataananggtgttagaaaaactacagatgtatttaccttggataccatgagaaacaggaatgaaggcaagtaagacaataaccgtaagagttcagggccatcgtgtaattggaatgccaataccctgaatgtcattgacatttcaaccaaataggatctcagtccaacctactcagacgtgaaccttgacgcacgtaccagggaacgccacactgcttccacagtgcccatgtggagagtcgaaactgaactacatgcaatttcatataactcgacttcatagaaaagatttaatgcttcggaattacaacagc

SEQ ID NO: 600393 - DNA, 449 bp, Homo sapiens
  misc_feature (254)..(254): n is a, c, g, or t
  misc_feature (319)..(319): n is a, c, g, or t
agggtttgcacaggcccctaactgtctactactttgatataatctataaacatcctggtatgctgagctggtaaaatacattgtaaattacatattaaatattttatctgcttttacaagcgcaaggtgcaaaaatatatacaattgtcatcttgatgactgtgaggtgaattaaccgttggtgataacacctaagcttttgactctgttatagcgctcaccaccccttcccttgtcttaacgtggaagtgcgncttacgtgttcacagacttacctgactcgcttacttaccggctgctgtcaccttccccttccccnttttctgtttcttttttcctttctttttcttttttcttttctttttttttggcctctgtatgtcccagtgatccaaaagcagcgtttgcctttttattgttattaaacaagtttccttctgccaaaaaaa

SEQ ID NO: 600394 - DNA, 2644 bp, Homo sapiens
  misc_feature (2171)..(2171): n is a, c, g, or t
  misc_feature (2174)..(2177): n is a, c, g, or t
  misc_feature (2179)..(2179): n is a, c, g, or t
  misc_feature (2182)..(2182): n is a, c, g, or t
  misc_feature (2184)..(2184): n is a, c, g, or t
  misc_feature (2194)..(2194): n is a, c, g, or t
  misc_feature (2200)..(2200): n is a, c, g, or t
  misc_feature (2208)..(2208): n is a, c, g, or t
  misc_feature (2212)..(2212): n is a, c, g, or t
  misc_feature (2222)..(2222): n is a, c, g, or t
  misc_feature (2234)..(2234): n is a, c, g, or t
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccatatactaaanaannnntnaanantgacacacantaaaangatgaatnaaanaaaaaataanaacccaaaatangagaaatactggacgtcatcttccaccccacccagccgtgggtcttctcctcgggggcagacgggactgtccgcctcttcacctagctgttctgcctgcctggggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600395 - DNA, 339 bp, Homo sapiens
  misc_feature (111)..(111): n is a, c, g, or t
  misc_feature (178)..(178): n is a, c, g, or t
  misc_feature (180)..(180): n is a, c, g, or t
ggaggaccctagccggaacccggtacctgccaggctacgtacgcccaggttatatatacgtacaagagaacactgcagatgcttgcagggtttatagtatgacctcatttnggttaaaaaaaaatctctatacaaatctctatttgtatgtagtggctcatgcacgtatgaacataananggtgtattctcgtgtgaatcagggttctatgttgttaatgtggtgcgtaagtaagccccattgtgtagtgctaaatatttcgagggagtatagggctgtgactagtatgtagagtcctgtaagtagaagagtgatatttgatcaggagaacacggggac

SEQ ID NO: 600396 - DNA, 179 bp, Homo sapiens
  misc_feature (177)..(177): n is a, c, g, or t
gatcacatgatttttgttctcagttctattaatgttcttggattctgttcaatgttctgttcacattgcagaaaaagcatttgacaaaataatttcagtagctgctgaaaaagcatttgataaaattcagcatacctttatgatacaaaaaaccttcaataaactgggtatatatgnac

SEQ ID NO: 600397 - DNA, 2421 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagcagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccgcagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600398 - DNA, 1759 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600399 - DNA, 1696 bp, Homo sapiens
ctcctgcgcacgcggcccggtcgctgtcggaagcggctgtgcgggtggcggccggcgcgcggtggggcatggcgggttcgcggggtgcggggcgcacggcggcgccgagcgtgcggccggagaagcggcggtctgagcccgaactggagcctgagcccgagccggagccccccctcctctgcacctctcctctcagccacagcaccggcagcgattctggcgtctccgacagcgaggagagtgtgttctcaggcctggaagattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctcttcacctagctgttctgcctgcctggggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600400 - DNA, 926 bp, Homo sapiens
  misc_feature (22)..(22): n is a, c, g, or t
tgcaccctgcaggtgaggggtntaggtgacgggcagggcagtgcaccctgcaggtgagagcgggaacacctgcataacagcctttggccctaggtgacaacgtcatctgtgggagctacgatagcaagctggtgtggtttgacctggatctttccaccaagccatacaggatgctgaggtgaggaaagctgggggtggaggcggccagcagagcccctcccttcagcccgagcctgccttcaacctggttccctccccccagacaccacaagaaggctctgcgggctgtggccttccacccgcggtacccactctttgcgtcaggctcggacgacggcagtgtcatcgtctgccatggcatggtgtacaagtgagtgctgaccctgcctggccccctccccagggcagtggtgtctggccgtgccctgagccctcctcgtccccacagtgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctgtgcaaaaaaaaaaaaagcatagacaacagaaaaagactagaacaaactaacacagaactacgctcggaggggacattattagacgggcgcgggcgagcagaaagaaaggggtataataaagctacgggcacgtggtggcacagaagtggtgtcacaggccccaagttttttttggacccagggtagtaaactaccgcgggggcccccaaaaagaggagggggaaaaactccagcaagcacaggtacaccccgataagagaagcgg

SEQ ID NO: 600401 - DNA, 431 bp, Homo sapiens
  misc_feature (29)..(30): n is a, c, g, or t
aataaacctgtatccgagtacgaagtggnngaacagggttttacaggacaaaggaataaaaggcttgagtctccaaaaagaacttaaagttattcttggtagggtacagagtagaaagggttgttaagagggtagaaggaatcagaattgcctgtagccttcgcttctgttttggactaactgataaaagatagacttacttgcataggaatgtaaattagataagtgagataatttcagctcttttttaacttactagcattgcttttatgtgctaagtcatgctttgatttaaatattaagaaagtgtccttgcttaaatcaatacttgattggaatcgatacaaaaatctgtgataaggataaacccgggcggccagattatgatatcctaaggaaccattgataggtttcatggaggttatttaggt

SEQ ID NO: 600402 - DNA, 354 bp, Homo sapiens
gttgccttgttcacgggcctcatcctctccttacattttctgtcatgtctcccgggtccagatcagcatcctcatcctctccactggggacaggttcactcccgtgtttaaatttgtatcccaaaaagagatcgctttgatttactcgaagatttggcatcaccacttttaggcttctctttcttatcttttgacttctttctttccttgtccccttctttgtctttcctagaactcatttgtttctccttgttctccttgttctctttcttcttctgttttttttcattggacttttttccaagccatcatctttcacttctccctcttctgatggattatctgaattcctag

SEQ ID NO: 600403 - DNA, 543 bp, Homo sapiens
  misc_feature (85)..(86): n is a, c, g, or t
  misc_feature (365)..(365): n is a, c, g, or t
cttttccacagggacaagggacactaggaggaatgggtggaggacaggcacagcactgaggctccagctagatgtatgacagggnntgggggtgaaggggcagaggtgagaatagatagttgaggatttgtggggttctgggttatgtccagggtaagcgaacactttcagtaagctagtaggtgggtggacagaaaggcctccaagagctcatcttcaagagatctctgtgtctcagctgctcatccacctctgtagaacatccctgcagatcactcacccaacaaattccattgattcaaatcctaaggtatccaactctgggttgtggaggccacaaaaaatattttccccatcttcactgnggacagaaaagttcaagctttggattctaactgatctcattttaaataaacctcagctctctcgtctactagctgtaaggcctggacttcagtttccttagctgtacatgggatgctcacttccacaaatgttggaggtgaggtgagataatgctggtgaagcagcacacacggttcc

SEQ ID NO: 600404 - DNA, 344 bp, Homo sapiens
aggcggctcttacacacagggttctgtgcatagaggtacatggcaaagctagagaggaggcatgtagagagcctcgggccttatggggcttttaggagtgcctagttcagcccttttaaatgtgggattaccccctcagtccttgtgaggcagaagtcgtggctatgaatcttgcaggcaacatttgtatttttcatgcatttaatggtggggacaatggcagccaattgggtaaaacccacagaatgagtcttttggatgacaggtttacgcacttgcccccagatggatgttttgaattgggcacacgccgtagcataacatggaggctatacagcgccgtt

SEQ ID NO: 600405 - DNA, 724 bp, Homo sapiens
ggtgagcggtggaggttattccttccgcggagttaagggctccgtggatcaatctcaggtcttcagggtcttccactctggaactatataaacggttcatgaaaacatgtgctcgaagatatgactacaggatcacgtatattttacctccagaaggtcgcttataccgaatgttgaatatgccatggaagctattgtagatgcaggcatcctgttggggaattgagagcaaatgatggtgttatggttgcagaagagagacgcatgattgagaagcttcttgatgaagtcttttgtctgaaaaagaatttataaatcaatgaggagatggttgcatttgtgtgcaggcataacttctgatgctaatgttactgagtaatgaagctaagggtcgtgctcaaaggtattaatatagagtatcaggagccaataccttgtgagcagttggttacagcgctgtgtgagtatcaaagcaaggcttatacggcaatttggaggaaagcgtaccttttggtgttgcattgctgtgcatgggttgggataagcacatatggttttagatcataatcagagtgaccctaaggtggaaattaccgggggatggataggcacatgttttggtaactaatagtcgatgatgctgtgtacatgctgacaagaatatattaaggtaatcgtcgttgactgcaacttgcttggctatcaagtatcaatagaactggtt

SEQ ID NO: 600406 - DNA, 393 bp, Homo sapiens
  misc_feature (331)..(331): n is a, c, g, or t
  misc_feature (354)..(354): n is a, c, g, or t
  misc_feature (367)..(367): n is a, c, g, or t
gcctgtagtgccatctactcaggaggctggggtgggaggatcacttgagcctggggaggtggagattgcagtgaaccaagattgtgccactgcattccagcctgggtgacattaaaaaaaaaagagagatcatcagtgtaaaagatacacaattataaaatcaagtaagtaaaaactcttaatattacatttaattggggaatattcaggaatttaactctttattttttaaagtgccaaaagtttttaatttttcatttaagtctggacccatttttgttcttttatttgcttgtacttttgggtgtttggatcctaattaaatccattngattaaccctcaggtcccctaangggtttacctttnggttttccttcctccgggggtttttc

SEQ ID NO: 600407 - DNA, 151 bp, Homo sapiens
atcttgaattactaaccacgtgatccacatgcgttagcatccaaagtgctggattacagtagagcctctgcttctggcctttttaaaaatttaaaaaatttatatttaaagtagagcaagggtttgctgtgttgcacagtctgggcttcaa

SEQ ID NO: 600408 - DNA, 193 bp, Homo sapiens
attcggcttttggcaatcccgggcccttttttcccccccccccaatgtcagggttgaaaactgccccccagtggttggggatgggtttttggccccccgggatctaggtgctaatatatctcctccgaaaagatataatgtatgttttgttttattttcagaaaaagaaaatgaataaaaatgttgccctcca

SEQ ID NO: 600409 - DNA, 454 bp, Homo sapiens
  misc_feature (65)..(65): n is a, c, g, or t
  misc_feature (403)..(403): n is a, c, g, or t
  misc_feature (453)..(453): n is a, c, g, or t
ccatttagagccccaggtgtccagcgtccctctctgccaggaggagtgtgccgggcatagccagnagccaggctcaaccgtgtgcccaagcccgaggccgaggtctgactctactgccatgttacgtggcgtgagaatcacactgcagctgctttccatttttatatatataaatacatataaatatatactttttaaaaataatttataaatcttaccaaaacgttatgctgaatatactttccagtatgagtgcacgagtgtcctgagcaggcagaaccgcagtctagatgaatggcgactccatcagcagtccggcacctgttcctgagacaaggcctagccagtgcccagggcgaggggcctgtgatctgcctgtactagcagtttgtcactcttctgncttttctgtgtaatattaagaactgaatgtgaagttttatagctagcctnt

SEQ ID NO: 600410 - DNA, 126 bp, Homo sapiens
cgctacctacacgctcgtctcactcaattcaatgtcacacttctgcctctgcaaaattgctggaggcagaagtgtgacattgaattgagtgcgacgagcgtatggttggtattggagagtcgccaa

SEQ ID NO: 600411 - DNA, 179 bp, Homo sapiens
  misc_feature (1)..(1): n is a, c, g, or t
naaaatatagcggaccgtgtatttacatggaaacaatgtgaaatgagagaaatgcaacagctttcagtgtggacagaaatccttggtagcccttgccttgattttttgccattcagaaatgtgaccctggctccattttacttgttttgatgaaatttgaccaggctctgtgatgctca

SEQ ID NO: 600412 - DNA, 755 bp, Homo sapiens
aggcgagaacgaccccgcggaccgaccaaagcccgcgcgcctgatgcatcccgcgatcagcgacctacgtcccgctgccgtctgcggcgcaccatgcccaatgagaaatggctgaaggggatgctaagggagataaagcacaggtgaaggacgaaccacagagaagatccgcgaggttgtctgctaaacctgctccgtccaaagccagagcccaagcctaagaaaggccccgtgcgaagaagggagagaaggtacccaaagggcaaaaagggacaagctgatgctggctaaggaggggaataaccctgcagaacaatggagatgccagaagagaccaggctacagaaagctgaaggtgcgtggagatgccaagtgaagtgtgtgcatttttgataattgtgtacttctggtgactgtacaggtgttgaaatactaattgttctaatcaagattttataagaatgcacgaactgatgctgtgacgttcctatggttcccagtgtgtgagaaagctagtgattgataagcgacgacagaaccactctgcatgtgctggattaatggaggggacagggcgccttattgtccattcaatcacgcaatgtcctcccaacgcgcagtgattagatggtgggacgaaacacaccttttcccttgatgagtccttgaagagacttcctcgtggggctcccatggcaggagggatgccccggagttggaccacacatgggcccactgggcacaaacgccttggg

SEQ ID NO: 600413 - DNA, 320 bp, Homo sapiens
  misc_feature (16)..(16): n is a, c, g, or t
  misc_feature (194)..(194): n is a, c, g, or t
attgcgcgtaattttntgaacaccccgcccagccatctgttcccggccgaattcgccaagcgggcaaaaactctggcgacgaccgagggcatcgaggtcgaggtgctcgacgagaaggaactggccaaggccggctacgcggcatcatcggagtcggcaagggctcctcacgcccaccgcggctggtgcgcctnacctaccggggcgccaagggcaagaaggccaagaaggtggcgctcgtgggcaagggcatcaccttcgacaccggtggtatctcgatcaagcccgcgggcggcatggagaacatgacctccgatatg

SEQ ID NO: 600414 - DNA, 1065 bp, Homo sapiens
gttatgaaatggctgccaccttcggcgtgcccagtattgacctcgtttgtacacttccacttcaccgtctccccacatggtagtaccgcctttgcctccccatacatcgtataagaccattgatatgtcttaggggtcattaccccatatcccttatagctggccaaaagcatcagtgggctgtgagggtacacggtctggagtggaacagtacagcctccacgcctagccatgatatcactcgcggtgtcgttggttcgggaaaaacctctctgtgtgtttctcttgggggtctgacacgttttctcgatttacactaccaatgattttcttgacttacatcaatcaagggatgactaaccaagatcctagcattcgtatagctgccgccaagccagatccaaggaaagaacctcgcagacaaaataacaccgaaatcgtcaagggaggcagcacgcaggcacacggacgagtgtaggagatcatcacatggggaacatgactggtgatacgttcaccagaacgaacccctcgccgtgaatcagccatgcacagtttggggagtgacagatacaaccggcgaatatggaaaataccagcgtcgagaggcaaagccgagagtctcgtggtagcaaaaccacgtggaatcgtcgatgttgcccgtaacacgggcatggggagcggacacacgcgaacggacgggccaccacaaagctaggtcctggaatgacaatcaagaacccacgggggcggtagaagcattgcattttggaggagcgcactacactaaaggcccaattcaggacgcgatctcaaattgccggtcacagacctcgcaaaaccgaaagtgaacgaggtacttacagctatcagtagaaacaaagacactcagacaggcttccaaggtcactgtacccatagcggccaaggagtttttactggtgggtatgcaaagtaaatcataccatcagctttcatactagctcctacgaattctaattctaccagatacgcgtgcacattacctcctaaacagctatgctaacttgtgtagatcacacttca

SEQ ID NO: 600415 - DNA, 496 bp, Homo sapiens
ttctagtgcatatcagttggtcttatttgaaatactttctctaggcataaaggagtttaaggcagaaccatagacactctttactttgatgttctcagccaccttgtcttagatgtggaaaaagatagggaaatccgtggttgttttcggtattcaggattctgagattcttctactgggagagacgtcgtccatagggaataagagaaagaaatgcttgaggttgaccccttgagaagggatcaacctgacaggttccagtgctgagggtcataagtgggtggggagatgtgagacctgcaggtctggaattgcccacctttgtcctgtgccattggatcctgggtgggcaccacacagctgggccccctgcacctgtattggcttgtcatggcttacctttagaaatactttgggggagggcaaagagacaatgcaggtttctggtagaatgctgtggtagagtaaaaaaaaaaacacaaaaaagagaaaacaa

SEQ ID NO: 600416 - DNA, 305 bp, Homo sapiens
  misc_feature (191)..(191): n is a, c, g, or t
  misc_feature (211)..(211): n is a, c, g, or t
tcatacttgaagccaaggcgttgggaagctaaagtcccccgatcacaaggtcaagagattgagaccatcctggccaacgtggtgaaaccccgtctccactaaaaataaaaaaattagctgggcatggtggtgcgcgcctgtggtcccagctactcaggaggcctaggcagggggtctcttgaacctgggangccgacgttgcaatgagccnatatcgtgccactgctctccatccctgggtgacagagcgagactctgtctactaaaaactaactgggcctaataacaattcgcctactcttggt

SEQ ID NO: 600417 - DNA, 1065 bp, Homo sapiens
  misc_feature (243)..(243): n is a, c, g, or t
tcgacccatcgcgatccggaggagaagcaggagctgtcgggaagatcagaagcgcagtcatggatgagcatgcgcgagcttatctccaacaatgagcaactggccatgctgggccaggcgccctggggccccggagagcaagtgcagcctgcggagcctctgtacacgaggcttttccatcctggtgactcgtgctcctcgcgtggccaggccgaccacgcgccatacgttcctggtaccagncgagcagggccggctggacaaaactgagcaggtcacctcccagaaccgtgcagctggagaacctgcgcatgaagcttcccaagcctcccaagcctgtgagcaagatgcgcatggccgacccgctgctgatgcaggcgcgtgcccatgggagcccggccccaggggcccatgcagaatgccaccaagtatggcaacatgacagaggagcatgtgatgcacctgctccagaatgctgagcccctgaaggtgtacccgacactgacaggggagcttcccggagaactgagacacgttagaacgccatggagaccatagaccggaaggtcatagagagcaggatgcaccatcggctcctgaacgacaggagcaggcacaccttggagcaaaagcccactgaagcacaacgaaagagtccgtggactggaggacccgcaccgagctgagtgtgacacagccggacagggacccaagcccccacgtaagaggacgacaagcagacacaaagcacggcagaccacaaaggaagatgacaagaccaaaaagcccaaacacgcacacgacaaaccgacagagacacaacaaagcgcagcgcagagagggcgacgaaggacagaaaacgcaacaggacggagaagagagaagaacagaccagacgaggcaagaggcagacgagagacgaacacgcaagcagagagacacagacaccagcagaacgagcagacagacaccaacagacacaccgccgacagggagacgaggagaacaagagcagagcgaagaacaacaacagcatcagtacagcaagacagaccacacacaccc

SEQ ID NO: 600418 - DNA, 313 bp, Homo sapiens
  misc_feature (296)..(296): n is a, c, g, or t
tgtggcgagggggttgtgggtcgtgtgtctattgtgtgtccgctgcgctgcagcgtgtccttcccgtctccgagtgtatctgcggccgccactccacgcacttgccttccaggtaggctctcgcgtgctccgcctcaggggccgcctcccagttgcgctgggtgatctgagccgccgtgtccggggtggcccaggagcgcatatcctcgttcagggcgatgacctcattgccgtcgtaggcgaactggttatacccggggaggaggcgcccgtccggccccaggtcgcaggcaaanatcctctggagggtgtg

SEQ ID NO: 600419 - DNA, 404 bp, Homo sapiens
cagggtgtatgttctgatagtcaactgcgtcaccatggttccgaaaaccagggtctcgtatgtgacaacagaggatcctcaacggcgactggctgtcctcggtcatgctcaggtgagtgctggaggtgatatgaagcctgtatcatagtttaactcttctcattcatttctccattatacataatatcgaggcagctcacaaacgctttgaactcgatgagctggtccttgttgtcatccgagagcctgaacgtcctttcggcgagtatctccgtgtgggccccgcaggtccagggcgagactagctgaaacaggtgtgcaaactgccgggcgtctatgcggtactgctcagcaatagggccggctggggtcgtggcgtgaggccatgggcctgggctgcttcc

SEQ ID NO: 600420 - DNA, 375 bp, Homo sapiens
  misc_feature (166)..(166): n is a, c, g, or t
gcgatccgtataaaagtgaggtcagcatcggggactaggtgggcactcactggtactggcctttatgctttgcttgccttggtcgaggggtgcacatggcggcagcagtggcgcgctgctgtggtggtggcatgcgcgagaagggggggtccactgcgagtgttgngggaagccttggacgaggccttctttgaggctccccgccgcagagggctgttccctagcttcttgggtgtgttgaggatgctgaaggccatcgactggcgccggtcagcttgtttagtagaagctggagctgctttcttctgggcctcagtagtgctctgtttgcgcccttcatgtcggtctcggggagccatggggcgtgggaaacag

SEQ ID NO: 600421 - DNA, 207 bp, Homo sapiens
gaggagaccccgctcatggcggccgacaccagatggaggagatccacagttgcgggggtggtcagcttgagggagcggaaacagatgtcgcaaagtgacctcttgtcgatgcatgaggcttcatacgtattctcaaccagctggagcacagacagcgagtcgtgatatggctacaccaccgcgcctgacactttgtgcgagagcgcc

SEQ ID NO: 600422 - DNA, 302 bp, Homo sapiens
attcgcggccgcgtcgacagagattaagaggcatgcatcaaccttaagatttaaggttatttgggaggccaaggtgggcagatcagttgaggtcaagagttcgagaccagcgtggccaacatggtgaaaccttgtgtctactaaaaaaatacaaaaattagctgggtgtggtgttgcacacctgtagtcccagctactcagaaggctgaagcaggagaactgcttgaaccctgtaggccaaggttgcagtgagccaagattgtgccattgaactcctgggtgacagaggtagactctgtctc

SEQ ID NO: 600423 - DNA, 150 bp, Homo sapiens
gactttaggtgtaattctactccagagctcttggttatgtgcactctaggataatttgattatgaacaccatcatataggaatcttttcatacatagtctctgtatttatgcctgactgggacatgtcgtatactttcaagcaaggcaca

SEQ ID NO: 600424 - DNA, 680 bp, Homo sapiens
tcagcttgcccctcttgctcgacttgaaaatggaaaagatgctcgcaggctgctttctgctgatcctcggacatgatcgtcctcctccctgccgatgccaatgaacggtcacgtgggaggtccatctctaggggcagacagctgctcggacccaaccggaggacggcccttctggagcagttccgtgtgataacaatgcggcgcagagcgggttttcatcatagacagctctcgcagggtcaaggacccatgacgtatgcaaaggtcaaggagttcatcggggacatctatgcaattcttggacatttggtcctgactgtcacccgagtggggctgtccacgtatggagcaactggtcactgaatgagttcgtgcctcaagaccttcaagaggaagtccgacgtggagcgtgctgtcgcagaggatgcggcatctgtgcaaagggcagccatgactgagctggccatccagatatgcgcctgaacgatcgcattctccagaagcacaaggtcagtgccggacccatgacgaggagaatgtgccactggcctcataaatgcatcgtgcgctggcatgggagaccaccggggctccacgacacggggcttgcggcaaacagcagggcactgacacaacccagcgcgacagccgagcccgaaaaccatccccatcggacatcc

SEQ ID NO: 600425 - DNA, 714 bp, Homo sapiens
acttttaattcaacatgagtatcatatggtatctctctagatttcaaggaaacacactggatactgcctactgcccaaaacctcattcttcctcatttggcctaaaccatcatgtctcacacacttgtccaaatcatccaatcaatgtcaaccacatcatcacatccaactcttcatttgtccagccatttggtcaccatcacagcacaacattcattttccagcgttgatgcacatccacacatttcattctctcactttcatggcctttgtggtgggggcgctttctgctgagggcattctttaaatcaaccacatttcccaaacactgtgctggcgggcaacaatctttcccccccccacacagttttttcaacacgacacaccgcggcccccacaacccgttcttactcacactccacatctaccatctcgatccgcgttctccccgccaacaacaaacacgcgaacaagtacactcgcatccttcttgtgggcgggggagcctcccgtggtctcatacacaacacacacgatgcttttttttgaccagaaccagcaccacccaacccgtaccgtccgatctatttcttcatccagcagcatcacactcacctactttatactctcctcccacccacccaccacccccctcccctccccaacactacattatctatttccttcaacacacacaacacacctcccccacca

SEQ ID NO: 600426 - DNA, 136 bp, Homo sapiens
ggcacagtgtgcggcatgctacggtctttagctactccttttcctacaagcatctcaagcacgagcggctccgcaaataccactgaagaggacacactctgcacccccccaccccacgaccttgtgcccgagcccc

SEQ ID NO: 600427 - DNA, 703 bp, Homo sapiens
gttaaaaaaaaaaaaaaaaagtggcagatcctggctcctatacccaaaattattataacatttttccagctaataatcacctgatcctttaacttatatttctttaaaatagcaactaacaggctgggtgcgggggctcatgcctgtagtcccagcactttggggaaggccgaggtgggcggatcacaaggtcaggagtttgagaaccagcctggccagcatggtgaaaccccgtctctattaaaaatacagaaaaaattagccgggtgttgtggcgcgcgcctgtagttcccgtgcttactcagaaaggctgaggcgggaaaaatagctggggcctgggagaacagaggctgcagtgggccgggaaccgcaccattgcactccagccgtggaacagatcgagactccgtctcaaaaagatagcaaactaagataataagtgtatttcactgtaactttttacttactttagcaggtttttcacctttcacttccactttttccaatatccttgccactcctattccttaaattactgtggccaaacaccacaatgtttcccatccaaatgaggagtgggacctgtggtgataacaaaatggagaaaccgttggtgttgcggcctgcatttggccatgctcagtaaaaccctcccgatcatgctgtgacataaaaaaacaacacaaaatcaaaaaaccacttg

SEQ ID NO: 600428 - DNA, 463 bp, Homo sapiens
  misc_feature (178)..(178): n is a, c, g, or t
gggggtgatctaaggatcttagtcgcgtttttacattagtagggatcaaaataaaaaatagatctgtagaagtaaatgactgttcactagattgagcgtgttgattcaaagcaatagtacaaaatgaggtgcggtttgattcacatcaccagtcactggaaattatgtcacattagtntcataagtcatggtctttgatttttctaaacagagctattacaaattaatacaaacttgaaacataccctaatttaaactaataagcttggggcccggctttttaaattttaaggcatgtgtgtttctctaccataacaacatggtacaaatttacatttacaatcacatgcatgatctacagttaaaaaaaaaggttgggattacagggtttttaaatggtgaatcacaattcagcacctatcaggttataactaataaggcaacagcagtgttgtatactata

SEQ ID NO: 600429 - DNA, 962 bp, Homo sapiens
  misc_feature (959)..(959): n is a, c, g, or t
aagacaaaatgaggaagaagcaaaagcagaaacccctgataaactgatcagatctcatgagacttattcactgtcacgagaatagcacgggaaagactggcccccatgattcaattacctccccctgggtctgtcccacaacacgtggaattctgggagatacaattcaagttgagattgtggggggacacaaccaaaccatatcagcatcctttcaagaatatcagataatggagctgagtactcaggaacttgacctgtagtagaatactgctagttcccttacttttaattcacatcacctgaaaagtaaaaacaaacaggcttggccaaggtgcatgcttttcagtaacacgtgaacgtgcagtgaatacccaacatgtttgcccgtggtggttcctatctcttcaggcaaaccatggtcagtattctggtaaaggttcccccgtggcctaaatgattacttgtgctctggggcacccgcggatattctattaaggctattcacaaagccacaagcaataagaattgtcagcctagccaaagagtctgaagatctcgagtacagactagcgacagagtctaaagatacgtgtatcctctgacattttggacatgctaacactactgcttaagtgatgactcctccaagatttcaagtatttatacaaatatatggcaattccttatagctaatcggttctggctcttaaacctgggaaaaccctgaattgcgtgggtccaataaaagggttagttcttccatcacccgacacggtcatatcggggagacatagcgagtcaggacatcccaggggaccaccctcggccccacagggtagtataccacaagatacggatctaagcacttgaggcctagccacggtttcacagaggaccacactcttttatacacagttgtccgtctcataattttataatttccacttatttatggngaa

SEQ ID NO: 600430 - DNA, 123 bp, Homo sapiens
agaagctgatgctggtggtccctgctagtcagtgtggctctctcattggaaaaggtggatgcaagatcaaggaaatacgagagagtacattgtgctcagtgtccaggtggcagggtgatatgc

SEQ ID NO: 600431 - DNA, 103 bp, Homo sapiens
  misc_feature (5)..(5): n is a, c, g, or t
ccagntatatgagtgtacaacgctgcaatgtgatcccaaacatgtgcacaactggtgtgcacatggactacagatcgggtacagctattcaagaaccagaaca

SEQ ID NO: 600432 - DNA, 546 bp, Homo sapiens
  misc_feature (382)..(382): n is a, c, g, or t
tcctgctagaagctgttattgtgctgtgtaggaagaaagagagcacctaggagtaggccctggtccagctggagcgagaggcaaatcatctttaagttcctcttcttcaaaggctcagaaattaaattaagtatactttgtggtcacgaaggggaaagaacattgctttttaagagaccagaagtggtattcaccatggcttcttccctattattctctgtttaaatcatctgttctgtgtccaggaccagccactgttgcagcatgagttcccagcagcagaagcagccctgcatcccaccccctcagcttcagaagcagcaggtgaaacagccttgccagcctccacctcaggaaccatgcatccccaaaaccaaggagncctggcaccccaaggttgcctgagccctgtcatcccaaagtgcctgagccctgccagcccaaggttccagagccatgcaccccaaggtgtctaagccctgcccttcaatagtcactccaggaacatgccagccgaagaccaagcagaagtcatgtggtcacagc

SEQ ID NO: 600433 - DNA, 231 bp, Homo sapiens
aaatcgagctcggtcccagagttactccagcctgggcaataagagctagactccgtctcaaaaaaaaagttcgacacagaggtttctagactggccaggctggtcttgaactcctgacctaaggtgatgctcccaccttggcctcccaagagtgctgggattataggtatgagccactgtgtccggcccagctaagaattttctctttttgagacagtcaagctcttattg

SEQ ID NO: 600434 - DNA, 475 bp, Homo sapiens
ctcaggtccaagaggcaggcggacagagggctgagcactgttccgggagcacgaagagcgacacaggtgttcgtcccgcgccagctctactctcccagaaaaaggcagggacagtattctgggtctggagcacaggattgggggtagggagggggactgggtactcctggatcaggtgctggccagagcaggtcttttccgtctttaagacatgcccaggtgggttttagcggcaacttcctagcagcgacactccccctcacccatcctgccgcggcatcccaccttctcgccttcttccaccttggcttgagtgtgacaatgaactcccccaagaagaagggcacccaactgtgtggggcgccttctgtccttcgctatacccctcccccgagaaataaaagctcctgccacccaccccagaatagcagctggtgatgccctaaataacagctcccagcaggcactttcccca

SEQ ID NO: 600435 - DNA, 645 bp, Homo sapiens
aagcggatagggtagcaggcgctgcagaagctgagataggctgcacggtaggcctcttggacaaacacttagccaagttgtgactgcaaagggaaaagttcttgaaattaagtgttactccagtgaacacaaatgattagaaagccttattgctgataggaaaaaaactttgctctaggtagaagatcaagccagccaaaatactcccttaagcccaggcttaatacagagcaaggccccctgttcaactctgtgaatgctgagagaggtgaggaagcagcagaataaaagtttaaagctagcagagttcagctcatgaggtttaagggaagaagctgtctccataatataaaagtgcaaggtgaaacagcaagtgatgatgtagaatctgcagcaagttatccagaagtccagaagacatagctaagatgagtttatggaggcagctgtgctaaacaacagattttttcagtgtagacaaaacagtcttaaattggaagaagatgccatctaggactttcttggctagagaggagaagataatgcctggcttcaaagaacaggctgactcttgttagggggtgaacagctggtgactaattgaggcagtctcatttccattctgaaatcatggtcctcatccgt

SEQ ID NO: 600436 - DNA, 407 bp, Homo sapiens
cacatgctaaatgggaggactgcggacacataattcccgctacgtgttcttgtcgctgattggggaaatggtgtacttcaccccccttggtctcattagctcaggaaaaagttaaatttgatgcttctatatttgcctataggaagaggaacatttgtctcttctgcctacttgaggatcgacacaataatcactggaacattagatggatatagctatatgcctctaattatccaacttggaccttgcatgataggggtataatagttggaaattttgaaaaaggatgtagtcctgccatatgagggacagctgcatcagaccttctctctcttttttttttcttttttttttgagatggaatcttgctctgtcgcctaggctggagcgcagtgtcgcaatctcgg

SEQ ID NO: 600437 - DNA, 267 bp, Homo sapiens
caaataaaacacaaccagccgggccacggtggaatttgcctgataatcccagcaccttgggaggccgaggcaggtggatcacccgaggtcaggcgtatgagaccagcctgggagacagaggtagcagagagccatgatcatgctactgcactccagcctgggcaatagagcaaaacgctgtctcagaaaacaacaatgacaatgaaaacaattttcaaaacttagccgggcgtggtggcatgcacttgtaatcccagctactaggga

SEQ ID NO: 600438 - DNA, 1105 bp, Homo sapiens
  misc_feature (481)..(481): n is a, c, g, or t
  misc_feature (623)..(623): n is a, c, g, or t
ggtgatccgggctgggcgggaagtcgggtgtcccgaggctccggctcgcgttaccgggccgcggagaagcagccgagcggcatggagctgtgcgggttgtgtgggctgccccggtccgaccggtgctgactggcgcctgcctgttggtcgacacgtgcgtggcaggcgactgttggcgctgctgactcatcgtgtgcgtctggtggtgcaggtggcgggatggcggttcgggcccccgagcgatctcggccaaagcgcaggtggaccaggggcgtgctgtgcacaccctgcccagcattctatgcgtgagaagacttgataccgcgataccttagcgtgtctatctcggtcccctggtacgtatacttctatcagtcacggccgacaggatcgctcgagatttctcgacgggacaggtgtccgccgtcacatgaccatctcccttgtctgggcaagggtacatgccagtttatccgaagcnaaggtagatcaattgtggcttaataattatctttgaggtgtatacttacagaaggtagaggccaatacagtaggagatcgccgttgccgttggatacttttccccatgtggcgtaggaaaataactccaaggggatatacancgacagaaacttgttcgtatggtacctgcgagagtaccaacgccgtgtgcagtgttccacggacggtgttggaactggcgtttgttccctctcaagatctaaattaggtcttttcaggaaagttggaagggtccttatataacgttttaagctgtgggttgaaaaaagggaaacccaaggtgggcttggttccgttttaagggccgcagaacacgggaagatatttggggcgggatcggacaatataccggaaaggggcgtatttaaggaagcgtgaaccccttttttaggctgccagggtttaggttgtataaattcacaacggaaattttcctttaacttgtggagaacttttttccagccccaattccaacgtggaaaaatcgcagcccaatttaatttggaaatttcgttcccagaggggtttttggtctttcagcgaggagggcacaatttttcggagtttggattaaccattcccg

SEQ ID NO: 600439 - DNA, 140 bp, Homo sapiens
accatccgaaacatgagcatatagtcccagaggactcagttctcaggtccaccagggggtctcccacttcacagcgccttgtatttgcagccctttttgcctgtaaactcgctcaagcctcttatcctccttatccccgg

SEQ ID NO: 600440 - DNA, 943 bp, Homo sapiens
  misc_feature (511)..(511): n is a, c, g, or t
  misc_feature (876)..(876): n is a, c, g, or t
  misc_feature (931)..(931): n is a, c, g, or t
  misc_feature (940)..(940): n is a, c, g, or t
ccgtgacatcagcacttcccaggtcccactggtatcattctacacctccgagactccgtttctgtctgagcacggccacacaatcattcctgtcagggtcgttcacttgcttcttattagtactgcaaacagtttaattagttagtaagaaacttggcacagtctggaaatccacatggccacagcgagatcttcaccgatttgcccgttcttagcacacaaatcaatcttgggcattcacatggcgtacaaagcaggacttaggcacttccaggctttcccactgtgttggcatggccttgatgtatatggagcttctcctgagacatcctgctggcttgaggtcagcgcccagtttagcagctgccagagaacgaaagcacagcaaggccgcttcctgcggctaagatggacaggcgactgcttgcagggatccgggggtgcgatcgaccgaggcccctgtctccagcaaatgccttcagaccatccacctcggggttgcaatccagcnacagcatttcccgcctaaggcagatgacaagagtccttggaagtgcagagaggtgagacactcgccgcaccccgacaggtaagaatgcgcaggctggccctagcacgggagaatttaaagaccgctgggacttccggccgcccttgcagccgcgccccagctccggttacgcccgagcagcctaatcctcaacgacccgaccctgtccagccccgcacggccgcacgtacacaaacactggcacgtggagcccggcccgggggcagggggaggggcgggcgcgcgagccatccccgattggccagctgtggatgcgtcaggccctcccacctcggggcgcccgcggcggccccacggagcctcgnggcgtgcgcagggtaagtcagtgggcgtgagaggactggagtaggagcgggtggngtccgcggncgc

SEQ ID NO: 600441 - DNA, 376 bp, Homo sapiens
  misc_feature (45)..(45): n is a, c, g, or t
  misc_feature (275)..(275): n is a, c, g, or t
  misc_feature (373)..(373): n is a, c, g, or t
tgagacagagtctcactctgtcacccaggctggagtgcaatggtntgatcttggctcactgcaaccaccacctcccaggttcaagcgattctcctgcctcagcctcctgagtagctaggattacaggtgcacgccaccatgcccagctaatttttgtattttttagtagagacggggtttcaccatgttggccaggctggtctcaaactcctgacctcaggtgatccacctgcctcggcctcccaaaatgctgggattacaggcgtgacagctgncgtgccggcctgtaggggcacattcttgatgaggtaagttaaattacttttttcttgctcatatgtcttttacattacatactgatgtatggtagggnagc

SEQ ID NO: 600442 - DNA, 204 bp, Homo sapiens
ctcggtacccccacctcctgggttcaagtgattcgtctgcctcagcctttggagttcaagtgattctcctgcctcagcttcccaagtaccaagtagctgggactacaggagtgtacaaccatgcccggcaatttttgtgtttttagtagagatgtgggtttcaccatgttggtctcgaactcctgacctcaggtgatccacctg

SEQ ID NO: 600443 - DNA, 230 bp, Homo sapiens
  misc_feature (107)..(107): n is a, c, g, or t
ctgaggtgactctagacggatccctactttacgcaggcttatacccgcacttactgggaattcctcgtcatggggaataattgcatcccgatcccatcacgaatggngtacaacgggtaaccgcgcctgcgggtagggtaggcacacgctgagccagtcagtgtagcgcgcgtgcagccccgggacatctaagtggcatcacagaacctgttatttgctcaaatctcggg

SEQ ID NO: 600444 - DNA, 403 bp, Homo sapiens
  misc_feature (288)..(288): n is a, c, g, or t
  misc_feature (297)..(297): n is a, c, g, or t
  misc_feature (379)..(379): n is a, c, g, or t
  misc_feature (400)..(400): n is a, c, g, or t
gactggagaggtggtcatgggtgtttacagcgtatcttttacgggatacgtctttatcccagcagacagtctaatgcctaagcatcctatccattaccaggtgtccctctcataggaaactcatttacactggcagtacccctgtggttcttgtctgacctacatctagtctattcctgccaagatagccattctctaggagatccctgaccaggaaagaagttcaattcaagtgtgttggtcaggtgagacacagaggaagcaactcaacaaaacacatgaaatganacaacagangcagtttattacttacagatcctgcatgcctcacagggccagcgggaaggggaaagcctgtatttgcaggctatggcatttnccaagcaggtttcctgcaggngag

SEQ ID NO: 600445 - DNA, 177 bp, Homo sapiens
tgcaaagtggagtattcagtcacatcttcaagctccacttccaaatgtagttctccggctactgtaccacatcgcagctacctcctcaaagtcatctggtagtcgtgagcccctcaaagttatccaaaagagatagaatctactccggtgaagatcctgtgttacgtctaggtcggg

SEQ ID NO: 600446 - DNA, 626 bp, Homo sapiens
  misc_feature (195)..(195): n is a, c, g, or t
  misc_feature (626)..(626): n is a, c, g, or t
tcgcggcctgtccgtacgtgcgatacgtgctccggctctcgtggctagcctgacttagatgcatagggatcgatatgttagagacttactttgggaaggctcgaagtggtacggcatcaatattggggatagagaaacagtctatgggcaagttgacagttcgacagcacgggttggccttgtcggctgccgaancggagttgggccgccccaaaattatgcagcctggcaagtgataccagcggaacaaacaaacaggggaggggagaggcacacacacacgtggcacgggggaacccacaacaagtggacaagcaggggggtgacacacaccacataaaacaagggccccagcgagggagtagacccaacacaacacggccgggggggtaaataatcatcaaccgcagcgcacaacacatttttcttgcgggggggcggggcagagcagaacataaaagcagaggcggcagcacagaccaatcaactactcctcgggtgcggcgagtagaatacaaaacacaccagtctgagtttagacagtagcaaggacgcagcatatcttttatatcgccgaccaccgcaccgcacagtattatgttcgtcgcaccagcaagctgcatagn

SEQ ID NO: 600447 - DNA, 373 bp, Homo sapiens
cgggaattcttctcgggaggcagtgctaggtcctttccaccatggcacctaagaaagcaaggggagagccggggcagcaactccaacgtgtactccatgttcgaacagacccaaatccaggaatttaaggaggaccatcactatcatggaccagaacagggatggctacattgacaagaacgatctgagagacacctttgctgcccttggaaggtgaacgtgaaaaatgaagaaattgatgaattgatcagggaggctacgggtccaattaacttggctgtgtacctcacatgtttggggagaacttagggagcggacctgaggaaccattctcacgcattcaagtgttgacctgaaggcaagggtgctgagg

SEQ ID NO: 600448 - DNA, 226 bp, Homo sapiens
taaacgaaacaaaacagagtcttgctctgttgcccaggctggagtgcagtggcatggtcttggttcactacagcaaaacacacctggacccaagcttgcagtgagcaatcatgtctcaccgcaagctccacctcctgggttcacaccattatcctgcctcagcaatgaagaagaacagaaaggtagagatttctcttaaaggtgacttcagacttgagcccatagc

SEQ ID NO: 600449 - DNA, 198 bp, Homo sapiens
acacccattgaggggaagaacatgtccttggtgaatgctcttacagtcactcaggatgggaggaagatttatgtcaccgattctagcagcaaatggccaagacgagactacctgcttctggtgatggagggacagatgacgggcgctgctggagtatgatatgtgaccagggaagtaaagtttattggacagctgggg

SEQ ID NO: 600450 - DNA, 365 bp, Homo sapiens
  misc_feature (14)..(14): n is a, c, g, or t
  misc_feature (19)..(19): n is a, c, g, or t
  misc_feature (121)..(121): n is a, c, g, or t
  misc_feature (126)..(126): n is a, c, g, or t
  misc_feature (147)..(147): n is a, c, g, or t
  misc_feature (213)..(213): n is a, c, g, or t
  misc_feature (223)..(223): n is a, c, g, or t
  misc_feature (304)..(304): n is a, c, g, or t
ttttgatatcaggngagancatttcctaacccaatctatgaggctaatattatcctgatagattgggttaggaaatgttctctcctccgttttttttggaagagagagattggtgttaatncttgngggaacctttggtagaatttnccagtaagcctatctggtcttgggtctttgggaggattttaattcgattcaatctatgtatttgtnatagatcgtncggattgtccatccttgagtcagttgctagcttgtgtgtttcttggagtttttccgtttcgtccatgttatctcatctgtnggcataccgtcgttcacgggattttattgatgtgtgtgaggtctctgagaacgtccctgcc

SEQ ID NO: 600451 - DNA, 397 bp, Homo sapiens
cctctgtgtccacttcaggtaaggatctattcatgttccacacaaccaccaaaccagtcgtaagagggcacgacaaatgcctcttccaactgaggaggctaaaaatatttggtatgggccctcagatcctcaaaaggttctagagctgcgtctttgagagcatcttgactggctgcatcactgcttggtatggcaactgcttatcaacggaccaaaaggtgctacagaaggtagtgtatacggccaaacctctataccaggcggtgtcaggggaagcccctaaaaacttactcctgccacccaagtcatagactgttcagtctgctacctcacaggaagcggaaccaacaggacccaagccgagccaaaataatgctaaatagttagtcgtcgacgc

SEQ ID NO: 600452 - DNA, 112 bp, Homo sapiens
tatgactgccatgtggagcatctgtgaatacccagctgttccccccgtttttaagctccccctaggagacctcttgtaacagctactgccttatccacatgttgtatgacct

SEQ ID NO: 600453 - DNA, 100 bp, Homo sapiens
taccacggcacccctgctccacgctgtgtacgtgtcccgctccacacgcaccagcacacgcttgcggtagcccccagcagtaacacctggatacgccttg

SEQ ID NO: 600454 - DNA, 247 bp, Homo sapiens
ctccctatagggtgtcaccttggcatgcttactgtgtgcgtgacaggtgcacctccagcgaggctgcgtctgtgtacgcccggtgacagttgtggcacttgaagggtttatctttgttgtgctgccgcctgtgggactgagaaaattgggagaaaccaggatgaatgtgctgaactctgacctcctggctccttgaccttcacagagaaccctgagctaggtgccgggcctcctagttctctttcca

SEQ ID NO: 600455 - DNA, 255 bp, Homo sapiens
gcatagagagatatatacacagagaggacatacatatatatatatagagacacagagacagacatatagagatatatatatacacagcatagagatacagagagatagagagagatacacatacacacattcatcaacgagagagaagagaggaaagagagagagagcgagcacagacagagatagagcacacagagagatcgcgcagatctatacagagggatattcaccacattgtatatggaaagcgcatct

SEQ ID NO: 600456 - DNA, 337 bp, Homo sapiens
cccaaacccccctaaggtttaaggaaattaattttgaagctttttaaccattgccttttaacctgctgagatttaaaaaaactggtataaaaacctttttaaatttcggaattttttcgggaatggatcttcctggggccttaggggttttttatggttagcccccccatggttttggttaaaaccttttccaatttttatcccggcggtttttccctaaaaaaaaaaccagttttttccccttattaaatttttttcgaaaaaaggggttttttttcccttctggggcttaaaggaaggatgggtaaccaggaaaaaattaaacttttaggcccca

SEQ ID NO: 600457 - DNA, 100 bp, Homo sapiens
ggacatgtcatcagcagtgaaaaggttttgttccgtttcctggcttcagaacttgcacgtgctgcttattaagacaggtggggtggagtttggggagagg

SEQ ID NO: 600458 - DNA, 153 bp, Homo sapiens
gatctggctctgtgcagttaacttctcaccacacatgtgaggaacatggtgaaattgatggggctggagcctcatacatcatggcatctagatactcatcagttggatacttccccgaatgaagcaagcatatcatgcagatcttcctatgtc

SEQ ID NO: 600459 - DNA, 1474 bp, Homo sapiens
agacgggtcattgggtctaggagagccacgacttctatctagcgaccggcgttgcccgacgccgaggtagagacagagtcgtcggcccggtgactcatgtaccgccgacggctggaagctggctggactgctgctagctggtgtcatgtactacaggtgcttgctgctagacgcacgagtagactagtcaatatcagcacaaggacgacaccgtacagaatcccagcgaaaattgctaccaactggacgtttcgtagtacccatgcagtctcctgcaacctgagactctgacccgattcggactgcgttcttagcatcattcgtagacgctctctctgtccaacggactcattgccagttgccccctattgcttggactgtcacaccatgaggaactttctaataatgctctgacggtgagcatactcatgggcgtataccgaatttcatgtccagtgcttggtgtattcaaggtggtacacgtcaattgagacctagcagagaattggttctcgaatggaagtgggacctcgacgaatccatcataccaaaccaccgaaagttgaataactcgaatgtattccctcttgtcaaaccgtaattccatcaagcacaatcagtcatggcaagtccaaggtggatatcgagctagggacgcaggtggtggacccaatgataccacatcctcatagtttaaccttaaataaatattgatgagcctttgatgtatggaaagaatcctgttcaacttcaagaaaaacctttgagacgcgataaatctttgcccaataaatattggcaaaccagctaggacagggaggaccttgagcccgactcccgtacgaattagataccatacatcgtatagacaggtatacaacgttggaccaaaaacggtaccctggtggggtcccttggcatccaagttggcatacgttgcgtacaaagagtaaagaatctactaattaatctatcagaaagccccacccaatgatgtggtaccaagattcaagaaacaagtctacccaaagcttgtggaccaggattggaactagtcacggagacggacatttttgtgggatgagcaccaaccaagggggtttgtgtaaccacaggcaatgtccaaaggaaagccgtgggagacaaactgcggcggtggcaaagggggtatcagaatgtggcccacctatggttgaccgcaatggaacctgccccgggacaatacataggggggccacacacaggcgttcgaggagcaggaccaagcgtgggaccaacaaaccggcacccgagggacaccactgagtgcggtaaaaccagggacagatgcacacaaggaaagaccagaaccacgcaaaagaggaagtaaaaagaagaacccaggagaacaaatacaacacaagagagcaccaagtagacaccggaaaaaagggcacacaccagataagaagacagcgaaaagaaagcacacaaa

SEQ ID NO: 600460 - DNA, 419 bp, Homo sapiens
ccctaggattacctcacgtcgggcattagaaaccagcctgggcaacaaagtgagaccccatctctacaaaataatctggaaaatatcctgtggacacctcctagcttctttggcaagctgaggcaggacgatcacttgggcctatgaatttgagcctgcaatgagctatgatcccacccctacactccagcctggtaacagagcaagactccgtctcaaaaataataaataaacatacgtgtgcatgtgtctttacagtagaatgatttataatcctttgggtatatacccagtaatgggatggctgggtcaaatgttatttctagttctagatccttgaggaatcgccacactgtcttccacaatggttgaactaatttgcactcccaccaacagtgtaaaactattcctatttctct

SEQ ID NO: 600461 - DNA, 429 bp, Homo sapiens
  misc_feature (24)..(24): n is a, c, g, or t
  misc_feature (28)..(28): n is a, c, g, or t
  misc_feature (30)..(30): n is a, c, g, or t
  misc_feature (35)..(35): n is a, c, g, or t
  misc_feature (68)..(68): n is a, c, g, or t
  misc_feature (161)..(161): n is a, c, g, or t
  misc_feature (319)..(319): n is a, c, g, or t
  misc_feature (348)..(348): n is a, c, g, or t
gctactactactactactactagnttcncngccgntcgactgaggcagacagctggttggcggggccngaatgagagattagaaccctctcgcggtcatcccagtcgttatggcgacgggatgtgcgctggatcagtggctcttgtctgaaaggccatgcnagtgaccatcagctctgtcagcactgatgcacacacacacacacgcacacacgcacacacacacacacacacacacacacgcatacacacacacacacacacacacacacacacacacacacacacacacacactccgccctgtgttattttcctgcncgctccaactgacctgagatcattcttcnctcttagctaataactggcaggcactcgctctgatcgctaatcaatgctagaggggggctgtgtgcgtggactgtgtgtgc

SEQ ID NO: 600462 - DNA, 197 bp, Homo sapiens
ttgtgttcaacacggcactgtggagatcatctgccacacaggcaaccgcaccacccccagctactgtggccttcactggacacctgagctggctcatcttgggatgctggccaatgaaccattgtggctgctagaaccctgcagacacacctgtgttttgacggcgaatgctggctgatctggcctgcaatgttctg

SEQ ID NO: 600463 - DNA, 383 bp, Homo sapiens
  misc_feature (358)..(358): n is a, c, g, or t
tgatacagtctcactctgtcccccaggctggagtgcagaggtacagtattggctcactgcaacctctgtccccaggcttaagcaattctcatgcctcagcctcctgagtagctgggattacatgtgcaccaccacagccagctaattttttgtattttttgtattggggttttgtcatgttggccaggctggtctcaaactcctactctcaagcaatccacccacctcagcctcccaaattgctgggattataggcattagccactggcacccagccagactttatagaaaatcttggatattctggtcatgggaagttcccctaggcttggttatttttttttggtaccgctttgtnctattttcgggcctttccatttcca

SEQ ID NO: 600464 - DNA, 970 bp, Homo sapiens
  misc_feature (1)..(1): n is a, c, g, or t
  misc_feature (19)..(21): n is a, c, g, or t
  misc_feature (25)..(26): n is a, c, g, or t
  misc_feature (29)..(29): n is a, c, g, or t
  misc_feature (916)..(916): n is a, c, g, or t
  misc_feature (919)..(919): n is a, c, g, or t
  misc_feature (928)..(928): n is a, c, g, or t
  misc_feature (932)..(932): n is a, c, g, or t
naagcatagtctaggtacnnngctnntgntccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcgggctccaggcgaggcggtcgacgctcctgaaaacttgcgcgcgcgctcgcgccactgcgcccggagcgatgaagatggtcgcgccctggactcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaattgtgcttgcanggngcaccgcanctangtgttgctaagccttcacgtgggcggagctgagggcag

SEQ ID NO: 600465 - DNA, 801 bp, Homo sapiens
  misc_feature (1)..(1): n is a, c, g, or t
  misc_feature (19)..(21): n is a, c, g, or t
  misc_feature (25)..(26): n is a, c, g, or t
  misc_feature (29)..(29): n is a, c, g, or t
naagcatagtctaggtacnnngctnntgntccccgccgctgcagccgtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcgggctccaggcgaggcggtcgacgctcctgaaaacttgcgcgcgcgctcgcgccactgcgcccggagcgatgaagatggtcgcgccctggactcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttcattattgaatgtgctgtaaattaagtcgtttgcaattaaaacaaggtttgcccacatcaagacaaatacttagacgccaaaacttggggggatttttgtgtccggggtcgggaaacacagggtttcgtgaatgtggcctgtcgccatagcgtgtgtccctgtgccccggttttttgtgtc

SEQ ID NO: 600466 - DNA, 1131 bp, Homo sapiens
gagagattcattcgtactgctactcacaactgcacggacgatctgtgctagtgaggataccagagacttaaaacagatttgaaagcagcgatttagccagtacaagggcatagtcgattggaagaactgggataccagtgcgtgcgattgtatcagaggaacgcgacgtgcatatacattatctatatgaggtaaagaccgaagacgtgacgcgtaagtcaatgaacgccgtaagaacgtatgctaatatagcggtgatgagacccgagctgctgcctcatcctgaacaaactgcgaggtacgaggctatcgcacggtaggtactcgagggcagcgccgttgcaagaagacttccgtatggaatgctgggaacgtgatcaaaacgtgcatatagcgggagttagcaagaagtcttcaaagcatacgttcacccgcgccggttaaaataaccgaaggagtggaaacgatgtcgtccagacttgcttgcgcttgattgaatgacactgggaaactacgtgctctcagagcgcaaggcatgtcacgaattttcggcacagagacttcacaaggcgttgtaatctaggaatccatggaaaagcacagatgtaacatgcaaagatgcgtcggcaagaggcgtgtcccatgtcctaggagattacgccgacgatcgaaacgaccggtttggacgaaaaacggggcgcaccaatcgatcgccaatgaagcggtagtccagctcccgaaggccaaccattgggtttactctcttgggtacacatagggccgtgtgcatgggatctcggttcgctggatccccaatcgaattaagcacgaatcctccttattctaagcaccgaagcgaatagactcccaggggtttacacgccgttaccattgagaacgtgaatttcggaaggagacacatggcggggcccccatagacaagctgggcatcccatgacagcgcgagcacataagggatttcatcctcagatccgatgtcggtggctcagacagacatgacacacggcaccctacccccgtcgcaccctagcccaacgcactgagtagacccacactcctttccccaagaccggacctcatgacacgcatccaactgaacccatgcgcaac

SEQ ID NO: 600467 - DNA, 309 bp, Homo sapiens
tcagcagctcttcaacccgtttgtcctcctgcgcatcctcttgcttcgttgtgggccttgccgaggggcacacggactgtcgtgattgacagtcctctctcgaaaaacccttgcgacttccctgaccacgtcagtgtggtggccatgatgggtgatggcaccagtcagcagaggcagcacgccagctttcaccaggtcttgcagatactgtacatgttacaggcaagcgtgacgcacacagcggatcccagagcaggtcaggtcagcctcatcagcattctgggtcagcgtggccactaggagctgcaa

SEQ ID NO: 600468 - DNA, 891 bp, Homo sapiens
  misc_feature (837)..(837): n is a, c, g, or t
  misc_feature (840)..(840): n is a, c, g, or t
  misc_feature (849)..(849): n is a, c, g, or t
  misc_feature (853)..(853): n is a, c, g, or t
gtatctgaggagtgcagtgcccgctttgctgcactgggctgagctgtggcctgggatgcctgtgagctggctgtgatgtgatgcactgtgcatgcatgctgtgctgctggctggtgctccatgtgctgatggctggtcgacgctcctgaaaacttgcgcgcgcgctcgcgccactgcgcccggagcgatgaagatggtcgcgccctggactcggttctactccaacagctgctgcttgtgctgccatgtccgcaccggcaccatcctgctcggcgtctggtatctgatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaattgtgcttgcanggngcaccgcanctangtgttgctaagccttcacgtgggcggagctgagggcag

SEQ ID NO: 600469 - DNA, 521 bp, Homo sapiens
aactcttactatctttacctactttagtgttttctttgtaacatgaaattgttgtgcgtcatagtgcatgaaactttgcctgtctccactttattttattccatggctttaagaataaaagtgcgaacgggtatgagagcaggagcactagcctttgttttcttaattacttcgaagaggcaataagattgtggtcagctattagcgcaaaagtgaattctaaacagtaaaatcagatctagctttttctttgtgttataaaagctgaatatgtaaaagaagcataattattatttaaggtggcacagatcagattctgccccaagaaataaaatttcaaggttccaggcaccgatttctgcaccggagtacacgtaagattttatctgctctgcttttgacaagtagttgttttgattttgaaggattatgttaatactaatctattcaccaggtaattgacatatgctatcctaattatctggtgaatagattagtattaacataatccttcaaaaaaa

SEQ ID NO: 600470 - DNA, 551 bp, Homo sapiens
aactcttactatctttacctactttagtgttttctttgtaacatgaaattgttgtgcgtcatagtgcatgaaactttgcctgtctccactttattttattccatggctttaagaataaaagtgcgaacgggtatgagagcaggagcactagcctttgttttcttaattacttcgaagaggcaataagattgtggtcagctattagcgcaaaagtgaattctaaacagtaaaatcagatctagctttttctttgtgttataaaagctgaatatgtaaaagaagcataattattatttaaggtggcacagatcagattctgccccaagaaataaaatttcaaggttccaggcaccgatttctgcaccggagtacacgtaagattttatctgctctgcttttgacaagtagttgttttgattttgaaggattatgttaatactaatctattcaccaggtaattgacatatgctatcctaattatcttcctgtttggctttttagtacctctgtttcaggatttctcaaactgtcattatatgctttattaagga

SEQ ID NO: 600471 - DNA, 298 bp, Homo sapiens
gtacccccaccggcagatatgtactaccgcggtttcttcttcgtcctctgtcctctgcccagagtgaggccatcaccatgtgagaagacatcttggggtgatttgctgccaccagcgtcccctctctcagggggccagaactcgccagccccagctttcagaggagaaagcggtcctctgaaatggattcctcccaaccccgcatttaaagggactcaaggcgcctgccacttcctcagcgaagaagtctgtgctcctccccgttcttgccagtggcgatcatcccttcacaatccca

SEQ ID NO: 600472 - DNA, 730 bp, Homo sapiens
caagtacctgatgggggacctgctgcgggaaggctcttacggcaaggtgacaaggatgtgctgtactcggagacgctgttcatgagggccgtcatgatcctcaagaagaacaagttgctgaagagatccccagacggggaggccaaggtgaatagaggatcattcagacgtacgtgagcgagtgttacgggtacatgtgatgtcatccaagctggtggatgttgttatacatacgaagagtaagcagataaatgtatatgtgtgatggatgtactgctgtgtgtggcatgcatgaataatgctgggactagcgtgccggagaagcgttctcccagttgttgccaggcccacgtggagttactttctgtcagctgattgataggcctggagtacctgcatagccaggcattgtgcacaaggacatcaagccggggaacctgctgctcaccaccggtggcaccctcaaaatctccgacctgggcgtggccgaggcactgcacccgttcgcggcggacgacacctgccggaccagccaggctccccggctttccagccgcccgagattgccaacggcctggacaccttctccggcttcaaggtggacatctggttggctgggtcaccctctacaacatcaccacgggtctgtaccccttcgaaggggacaacatctacaagttgtttgagaacatcgggaaggggagctacgccatccgggcgactgtggccc

SEQ ID NO: 600473 - DNA, 401 bp, Homo sapiens
  misc_feature (354)..(354): n is a, c, g, or t
caccatggcacctgctggacgcccgatgctacatgaaggggacagtgcagctcctgcatagtggagagtgtgacataggatatggcagcatgtatattactctggggaacataggctatattgaggctgatctctgtgactaccaggcactgattgaacacccatacgcagtacgtcaactacacatggtattcttgatagcacgacctgtgacgcagacttatacgctatttgccagagacgacaatatggctagcaagtgtgaagatgtacaatgcgtgtgactgtgacctcgacgagtaagtggctgtcattgtgatagctcatgagcatgtttgatctgctgacattaangttcaccaccagtagcagaagctagattgacagacttgtcgacacct

SEQ ID NO: 600474 - DNA, 695 bp, Homo sapiens
  misc_feature (296)..(296): n is a, c, g, or t
taacatatggaccgtgcagaaatctggtaagacttaaattcccgtgtgaggaataactctagttctctcctatgagcatttcctgaaagcccctctgatttggcattcttactggagctgccagaccagaaatctcaccaagcaccaaagtaacaccaaattaagttattattcccctgttaggaatggaaataaacttgtgaagtctgtttattttgaagtacttggtgaaactaggcttgctaaattgagataactgcacggcccgtttgtgtttaactcccgttcactcacgncttatggtcacatttgaagacagaatattataagaggtctttatagggccacacgagaagaaactataccactggagattctaatttgaaggagcacacacgagacacttcttggagaaagcacgctcccgttggtttttcaactgtccaacttgaatgtgtaagtccccccccgagcactggacccgtcggtgcaacgagttcccaggaaaccattattgcctgatgaccaccttcccttttgtatacaacctctttggttcgtataggccatattcccactggctttttagtaatagaaatcccgtatataatgtatccaataccattgaggttctaacctagtgtgttaatttatctgaatttggatttttaaaaagtaataaaaagttaaatgta

SEQ ID NO: 600475 - DNA, 155 bp, Homo sapiens
atctgctgcctcgacctcccaaagtgttgggattacaggtatgagccatcgcgcccagcctataaaaactaatggaattcttgccaggattaaatgatgggcatatggcaattattctataaacattaaaatttgtaattatgaagaattattct

SEQ ID NO: 600476 - DNA, 451 bp, Homo sapiens
gagaacgtgggggtggccatcctggtaaggttctttgtgacttcccccgggccaagcagtacttcagccagttcaagcacatggaggatcccctggagatggagcggagcccccagttgcggaagcacgcctgccgagtcatgggggccctcaaccctgtcgtggagaacctgcatgaccccgacaaggtgtcctctgtgctcgcccttgtggggaaagccccctttttttagcttctactccctgttagagagagacctagctgagcggctggcaggaagcgggacaggtttaggagtcccttagggaataaaccagccccgtttttatcagcccggccagcatgcgggtttccccatccccatttagagtatcccgcccccatttcccatatatccagatatattttatatccgagctatatataaatatatatatacatatatatata

SEQ ID NO: 600477 - DNA, 168 bp, Homo sapiens
gtgtcccatcatcttccttttctcctctctcacacaggggtccatctagcagccatactcgcgtgtccccgttgcctgcgcgtggcgtggcttatgtccagacgtacaggtacctcagtgcaccagttcgctgcactggtccattcatctctctcgtaccagcttcct

SEQ ID NO: 600478 - DNA, 204 bp, Homo sapiens
ccacttgtgctggattctggtggacgcggagccagctcgcctcacattccacaggtccatggactcacttttgtaagaaactcgtatcaacactgaccactcaaaaaaaaatgtgggttttttttttttttttttttttttttttttttttttgtttttattattaaattaaaaataaaagcaaaaaaataaatcaaaaaaaca

SEQ ID NO: 600479 - DNA, 370 bp, Homo sapiens
tatcccgggtctgcgacaaaggatgcccttcataaggaacaagcgatctctctaaaaccaatcctagagtatggcttcagattctgctcccatttctcaatgattatgagttttgtgccacatcttctccccctttatccctacaatatttgcatttcatgtttttattctcttactgcctgagcaatttgaaactctcatatttaggcaattcccagatctcgttcttaaagcattgtgattccctttcagcttttcagaggcacgtgtgctggggaaggcactgagtcctccctgtcaatccaatttgtgataaggatttccccaggtgcacccattccatagtccctgtgttgctctgagcctggtt

SEQ ID NO: 600480 - DNA, 1269 bp, Homo sapiens
tttgagatcagcctgaccaacatggatgaaagcctatctctactaaaaatatagaattagccaggcatggtagcgcacgcctgtaatcccatcttcttgggaggctgaggcaggagaatcgctagaaactgggaggtggaggattacagtagccgagatcgcgccactgcattccagcctgggcaacaacaagcgaaactctgtctcaaaaaagaaaaaaaagaaataaaaagcacgtgaccttatgaggctctcgctgtattgttattttaaaggactcataacagcagtttgcatcttaacacattcatgcaagggcccctcatgctgggcataattattcaaacacagcaacacttggtgtgtaattctccatgtggatttgcacagccccagcctacaccaagcgaccatagtgaggtacaaacccacatgacatcatatacatggtcctcggcatacgaaccaggaataaaagaaaaggatcaggctactcacatagatgaaccatgggtaaggctcaacaccaggacgcaccggaacggaaggcacgctcacacaaacaagcctggacacaccccaaaaccccacgccaacgccccctggcaactgcacccaaaccgcagcgccggctaaccatcacccaaacagccacctacgcgcgacaccaaaaaccaaatcggaaccccactacgaatggaacatcccggaccaggccaagttcactaacctgggccagaaaaactaaacgagcaccccatctcagggggaacccaggaacgtcaacacagcaacccccctaaaaacacacaacgatcaccgtaaaacggaggaagggataatgcccatccctggggcacggggcgcccgcgcagcacctgcaccccccaacacacgaccgtgcctacaggaagcacctaaagaaccaacacgccacctccaacgggcccttataaaccctgtacacatgggacaaaaaccagtggacgcctaacacacacgagcctggcaattacacaaccacgctggcccggccgccacaacacacaagcacagccccacacaacaccctgccccgcgccgctcccacaatagcccacaaaccacgccaagacggcaaccccctggtcagaccactaaccgccgcccactgaaactaacgcttaacaaaaataaaaactcaagacgggacccacgagacgcagcaccacgcgggggcgacaaacaagccaccacaggcgcccacggatccacaccccacgcatggac

SEQ ID NO: 600481 - DNA, 525 bp, Homo sapiens
aagaacaaacgagagagggtcatatatcctcataatttggtcttttaagtctccgaagtttagtcgacggtgtgaaagtaagtttgggataagtccataagtgtataagaagatcgaatagagacgcatactggcttacacaaggacagactgtgagagagatataagaacttataactagagtgggccacactaagaatggacggtggcatcattggcttggaatgaaataaatgagatctaacatagaagatacacatctcaagctggcatatagtaccggcttctggtctgagtatactccagctcctgagacatgttaccggcactataacctgatggcgtgccaatagatatcacagtgaagtggatggtctgcctggtacatctcaacatactggaaccactaaaggtatgtaacaagatctgcacttgagatacttcagatcaaatgcaccatctcttaccttaagatgtcctgaaattataactggaccctagagtatcacatatcttacataacca

SEQ ID NO: 600482 - DNA, 809 bp, Homo sapiens
ggcgccggcttgctgaccactgcagagccccgccatggaagacacgccgttggtgatatcgaagcagaagacggaggtggtgtgcggggtccccaaccaggtggtgtgtacggccttcagcagtcacatcctggtggtggtgacccagtttgggaagatgggtcaccctggatctccctggagcccagacaggcgtggcgcatgtgacgtcgagacaagcactggtgcgtcgagccgacaagaatgtccttctggggcaggatgagcctctcatccatggtcttgtgctaagagaacctggtagcgtttgtgtctcaagaagctggaaacagagacagtcctccgtcggccgtggaccgtgaaggacaaaagcatggaggggctgaaggcgctgagggaggtgatccgggatgtgccaggtgctggtgaccgtggaagagcagggcggcgccgcagcgtagcgtcagcgagagacacgtgaacaccgcagacacccactcagaggactcaagtctcacctccctccccggatggagggaggaacttatggcactagcccttggagccaggaaaaaagactcgtgtctcaggcagactctgactctggttactaagatcatctgtgcatgacggggacggtggaacaggtcccggaggagtcgtgaatggttctgtatcaggacctgaatcgatgcttgtggttgagaattggaggaatgagtcaggaggcgtagggtcatggccgcccgcggtgtgcaggatcaattgtaggaggaagatacttgaggattgaaagggaatgtgttatc

SEQ ID NO: 600483 - DNA, 113 bp, Homo sapiens
tgctattttgcgacattgaatagagtgagggtcctgtgcattggacagctgcagcctgggacgacaaactgcacccccggatcctgggtagaaatcacatcagtgggtgcagt

SEQ ID NO: 600484 - DNA, 92 bp, Homo sapiens
gtggtggattctctgacggacggatgatgggcacaccccagatccccgtgaggcattgttaaatgctttcagatctttcataaatgccaatc

SEQ ID NO: 600485 - DNA, 1076 bp, Homo sapiens
gacaacaaaaggccgcgggcggcgggcagtggtgtgccattcttcctcgcggtgcttctcctgaggctgaggcgcccggtctcacggaccggcggggcatccaggatgaaggtgtgaacagcttgctacggcgcagagggaattgtagataggagaaacagaatagactgatgaccaaggagaatgtgtcacggcgatgcagcgatgatccagtccgggagaatggacgacgatagggagaattccacaaggttggcgtggatgccaaggatattcttgagagactgcctgtggatgtagacatgctgtatgactgatgaggaatggagttggaacttatctactagtaataatgctaagtgaattacttgccgcggttctgatagacttattcataatcattaaccctcaagaacatactcacaatagatattaatgggggtatattgcgttgtgtataacatgttttcatcaaatcaatcaagttgggaagttgattaaagttgatgcatggcaaatgtgttggatatggtgggggaaaggtacaacagtacctattaatgtggggtggggaaatacgaaagatctgacattctgggaaaggggtgactcagttatgaagaagggcaccagcttgggtcagaatcttggaaatgggaggctttttttggaagtcttttctgctaagagaacatctcagaactgctgtggctcgccctcgcgcgaaagggcataacttctggagggccaggaaccacaatgggaccgtggccagctttccacacaggcaagcttcttcaatgcctcggggcagtcgattcttgttggccaaacccttgagggaacactggcgacatatatttctaacctgaagagaagccaaactggccccggtcttccgttgaaggaataaacgttcatgctctcttttagtacatactgggtaaaccttggagggacattccttttgggggccaagagctcccgctacccgtccaggttcactgtacccgctgagttctgtccaacggaggtcacattccatttacaattaaaggagcaattttagcctaact

SEQ ID NO: 600486 - DNA, 295 bp, Homo sapiens
gaaaagtgtatctgtgtattatctccatcgcttagcctatcctaggatctcatagagttgcaaccctccataggcatagccttttcagattggcttctctcacctactcatatgcagatgagtacccccatgtcttttcatggcttgctagctcatttcttcttagtgctgtggaataatattccattgtctggatgcaccacagctatatatccattcacctgctgaaggacaccttcgctgcctccaagttccagctgttatgaataatcgtgaataaagtcgctatgaacac

SEQ ID NO: 600487 - DNA, 330 bp, Homo sapiens
gaacgcttaccaggaatagctatactctggatcactcgctctaccaggaaactgatatgaccaggaatccgcactaacctagcaaacacatatccacaggcggaactcgtctgccgagggagaacagcgtattactcggcaaacagctccaactctgcctgagctgtgccgctcccgggcatgacacggtgctgaggacttgaggaagtgggacgagcacctttctattgtcttcacttggatcaaaagcaaaacagtctctaccgaccccgacacgcactatcaagatagttaaggaccctacggcgttgtgcagggcgatcctactag

SEQ ID NO: 600488 - DNA, 1098 bp, Homo sapiens
cctttcttcagtccccatgtgctgatccttcccggcaactttttctgagaaaaatgcccaaattcaaggcggccctgtggggtggggggtcatggaaaaacatgcgcccctgtgacgatcagatcctggcttgggaatgcgtgtgctgtgtgcgtgggtgtcctgggagaatgctggctggtggtcgcggtgacatggagaatgctggaggaagagtattgtgggtgcccctgggttgatgcctgactggattaatgcatgcaatgcacggggcagcaacatggatgtgaactctgatggcctgatgcatggtgacttggggacaatgccctgcggctgcctgctgggaacggcaccactgctggctaggggtcccaaggacatgccgtccagtgatgcgatccaggcactgaccgcaggcactgaggaggttgtgcccaacgccttggaacgaaacgtgcttgacacgaatggacaagccaagcggcgccatacaattgcacgagggtgcgttgtgtggaccccatgagggcactgaacgcctgtggcccaatacgaccagtggtccaattgaaacacacaagacacgccctcacttggccaagaggcggcaacaccactgtgcgttgcccaacttcgctccactgcgcacgaaccagctggcagctttggccgaaaacggcaggaccgatggaagggatctggcagaacactggttccagtgggtcacggcaggcgcgtggtacgggggcctaatccccgtatattcggcccacacagacctggggcaccccgcctgggcggaaccgtacgaaggttaggtcaaagtctggtgtgtcccgagcgataggggaatagttcaattacataaaaagagataacgccgtggacatagatggggcaccaatgagtatgtgcacccgaaaagtgatgcagtatattaaaaggaaagtcgcagttaggcattggaacgtatcgtgcgaagaaagcttggtaggagtgaagagagtcggatgaataagggatataagaagaaagagccgtgtgagaggggccttgggtaactatgcgaggtatttggcgagttgtgttagagaa

SEQ ID NO: 600489 - DNA, 447 bp, Homo sapiens
tcccccccatcactagcaatctaggtcctactaaatactaatctcagggtggatgatcttctagatacgtattattaaatgaaggagttttacgtaataatgaaattgatttgtcgtctgtttggccgtaaactggtgtgtctttaaatagttcttacggtgatatcttactatttttaagctggccggggtttcagatatggggatttcagcccctggttaatcagtcttgtcccctacaagtccctgatgcagtatgtttatttgtgatgtttaaagaacatttcttggctgggcgctgcggcttgcgcctgtaatctcagcacttggggaggctgaggtgggtggatcacctgaggttgggagttcgagaccagcctgacaaagcatagtgaaaccccgtctctactaaaaatacaaaaattagctgggcgtggtgttgggcga

SEQ ID NO: 600490 - DNA, 283 bp, Homo sapiens
ttcgattggcgggcaacaatgttgggtatttctgcaagaacgaccgtgctcgttatctttatccgttcgtgttcatgagagtaaggtctctgcacatcgttcaccaggctggactgcagtggtacaactcacagctcactgcaggctcaaactccagggttcaagcgatcctcccacatacgactccagagtagcgtaggacttcaggcatgcaccaccatgcctgggtaacttgcgtattttcggtagagatagggttgcagtaagtaggccgccaatcgaa

SEQ ID NO: 600491 - DNA, 270 bp, Homo sapiens
aaacaaagatcatggagtggtcactgacttaacagagtgggagaagcagggacccaaacgcctaagagaaatacttccatagaaatgtgtatgcatatttacaataatatagctactaatttgttaacactgaacctagaattgtgttctaaattagttgaaagaatgaagagataataactgggtagaattacataagagtctaatattctctcttaataggaagtccatagaaaatgtttgaaattgatgtattaagaaatactagtg

SEQ ID NO: 600492 - DNA, 176 bp, Homo sapiens
tgcctcaagctgactctagagtatcccctcataggttcgcaggtggaacattttttttgcccttcaaatcttcatatctgcctccttaatcatttaaattttatttctatattccatgtcttgacagaaggctcctctgtactacatttctagtctaaaatatctctatttttcta

SEQ ID NO: 600493 - DNA, 110 bp, Homo sapiens
tagctgttcttgagtgatcccggtcgtcagtatcaccattaacctggtattatccagcagaagacaaaaagacaaacataaatgtctagaaataaaactggtacaacccc

SEQ ID NO: 600494 - DNA, 461 bp, Homo sapiens
acagcccctgttgggaggggccatgatgggacaacccacatttatgacatgtccccggttatgagccggaagggcccggctccttaactgcaaggtgtggaaatggcgctggggccttaaaaattggagctggatcctatggccctgacccaaaagtattaggagcatgtgcgggaacagcaggctcaagtaaaaaaggaggacttcagttacatggtgggtgagcccgctgcccaacaaaagcaaaaaaaacggaaagctcagccccaggacaaccgtgggggcagcaaaaaatataaggagttcaagttttaggtcccctccccctagccctttttttggccctaagtttggaaggctggggtttacacaaaaaccccctctcccgcagtttccaaggacttgtcatttcatgtttttattttaaacctgttttgtaaaaaaaactgtttccccaggga

SEQ ID NO: 600495 - DNA, 316 bp, Homo sapiens
gggggggggggggggtcggggggggggttttttttacccccctttttttttttccccccgggtttgtgtgggggcccccccccccttttttttcccccccttaaaaacccgggggccgttcccccccccggtttttttcttgggggggggggggggttccttttttccccggggaaccgtttttccccttgggccttttccaaaagtttttttggttcccctttaaggggggcccccccggggggcggttgggtttttccggggggccccccgggggggggtttttttttttttttaggcccccctgggtgggcca

SEQ ID NO: 600496 - DNA, 219 bp, Homo sapiens
gccactcgcagaagtcatatgttgaagccctaacctccaatgggatggaatagaaagcagggcctttgagaggtaatcaagtcatcagtttagagccaccatgatggaacgtagctctctcccctctcactcttctcacacacaaagaggaggtcatgtgagcacataacaagatggtggcactataaggcaagactagaggtctcagaataaatttca

SEQ ID NO: 600497 - DNA, 108 bp, Homo sapiens
atgagcggtccagtagtagtagtagtagtagtatgtatatgtatgtaaaataaaaactttttttcccacgctgcctcccagggtgactcctctagcagtcgaccgtgc

SEQ ID NO: 600498 - DNA, 249 bp, Homo sapiens
  misc_feature (38)..(38): n is a, c, g, or t
tacgacgacagggatctggagagtatgttacagaagantctggccgagaggctggctgagctgctcttgatgacttactgcgtcagaagtcagcgaccactgatcaggcatcagctcactgctcccagtcccacccatgcccctctgcagcatggagcccaggccaggctgaggacccagccatggttaaccatttccacctacctcatgcacagaggtttgtttataaataaaaaattaaatagacaa

SEQ ID NO: 600499 - DNA, 773 bp, Homo sapiens
  misc_feature (711)..(711): n is a, c, g, or t
ggccgtgatggtgtggggggggagcgaggaccctagctggttgcctgggtctggtcgtcgtggtgggcgtccggtttgggttctttgaatcctcatgcgcccatgcgcggtcgtccccggtcggggtttgcgactttgttgtcgcccatctattgtgttcttgtccctgccgcctccgttggtcgccttgtgtcgttccgttgttgctgtccactaccttccttgggccgactcttgtgtcgtgtacgattgtagacgctggttcgtctctcgtcctgtcagcttgtgagcgctagcgtccgtctgtccagcttgtagtgcttgtttacctcatcgctggcaggctgacaatattgtttttccgtgtgtgtgagagaggagtaggttctataatgtgtccctgcgcctcagagagtatacagacacaccagattattctacaccaatgggacacacgctctgtgcttcaccactcgagtgtcatactcccctgacgcgtattcgtgccgttgatagtacgccgtgcgagtaattcctggtcgctcacagccgtgcgcgtgtaacgctctgtttactctcgacgcgagcgggacccacgctagacttctgtaaatttgatggtcaagcttactagcccgctacgcttcatcggcaggacacagaaaccaatcacgaccgccctcacgaagtacacgctgagacgatggaaangcggcagccggcaagaaaaatacaataataaacaataacacctacacacaaaatcacacaaa

SEQ ID NO: 600500 - DNA, 445 bp, Homo sapiens
tgacccactatcgctagaaaccctccagagagaaagtaatgtaatttttatatgtagaactctaaatgctatggaaagcctatgaatgttagcaatatggggcgtttatgctaaaatacacgcaaacattagagacgagcctaactgcttttcttactttcctgaatatggtaggacctgatcgctgcaaaatgaacccgtgccttaacggaggcacctgttatcctactgaaacttcctacgtatgcacctgtgtgccaggatacagcggagaccagtgtgaacttggtaagatgagacttggctgaaaaggtgcagttctttcacagaagatatattgggggagaatttatgttgtcgaatcaatcagagatttcaaagaaacccatatgaagattaattatatgttaaatgaagttaaaatctgagggtttcttagcgatag

SEQ ID NO: 600501 - DNA, 396 bp, Homo sapiens
cacgaggagacgaagtcgaggcccagctcgtcgtagaggtagttgtggaagcgcgtaccgatgttgctgggccgggccgccagcgagatgcacaccgcggtgtccttgttcagcagcgggcgccgcgagtacagcgattccgtcatcagccgaccgccttgatcacttgctgcgccaacaggtggatttcgcgatactgcttgtgcgacaacgacaattggtccggtttcgggacgtcgaattcggtgacgatcatgttgcggtcgtcgcgctcccaggtggcgccgtaatgctcgaggatcttgcgcatcgggaagttgtcggacagcacccgcgcggcgaaccgctcgacgcccgagccccgggccgcgggtaccagcgcgtccatcagaaagg

SEQ ID NO: 600502 - DNA, 469 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctgtaagcactaggtccttctcccacccaggaatatggctgcaacccttctggtcatagcgtggtccttatctaaagagtgggggacacatgagggaactttgagtgaatca

SEQ ID NO: 600503 - DNA, 156 bp, Homo sapiens
ctcatagcacgatcccctccactttttgcattattaatgtaaatataatcttatctttgttattatattgtagcaaagtcaccccttttatcacagtattcacatcattttaagataatgcttacaaaattctattatgctaaaattttaatcctg

SEQ ID NO: 600504 - DNA, 516 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtaagcccctgactgcgacaagctaaaacccacttttatgggtgttcatgtagctctgtgactgtcagggagggca

SEQ ID NO: 600505 - DNA, 7963 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 600506 - DNA, 8036 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggagccatccgggaccacgaacagagagaaagcgcccatttaccagggcgacacacaagtacggaaactacatccagcaacgcagccatccccgctcgtagagcctcaacacagagggagggggacacacacgtgctcccacaagcaggcatcgctgcactttagcccaaacaccacgtcccagggcctggcagcgcaacgcgaatggttcttggtgaggccatgccccgagcacacccatgtgtggtagaatagcagtttgagagataggacgcctcaacaaaaaggcatccacaaacgtcgaactagattctctgtctatgcc

SEQ ID NO: 600507 - DNA, 7882 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctgtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 600508 - DNA, 208 bp, Homo sapiens
atatcactccccatccctgacaaaggcatcttcccagaatcaggcacatagcccacccaggaccggagaaacagagaacacccactaggacggaggccgctgatggtgcagaaactggtgctgacatgtcaagtgactcctttggtccaccctactttccaacaatcagccaaccacacttgaccacagagaacacgtcgaattcgag

SEQ ID NO: 600509 - DNA, 7504 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 600510 - DNA, 8036 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcaggtgagactttacttcccgtgtcagagtcggagctctctctgcccagccctaagtgctttctcacccctcccagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 600511 - DNA, 8083 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatggtgtgcttcttccctgggattcagattcttcccactcttgtgctgtgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcaggtgagactttacttcccgtgtcagagtcggagctctctctgcccagccctaagtgctttctcacccctcccagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 600512 - DNA, 133 bp, Homo sapiens
cacgcgttgtatggatacagaaccacgatgccaacatcggtgtgactacaggacacggggcattgtagcttgtaggagtaaaaatgaagcggaagccccaaagttcacattaactcaggcatatcattatatt

SEQ ID NO: 600513 - DNA, 8592 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggtgccaccctctctgggaaggagtgttactaatagaaggctcttatccttggcccttaatttggaaagctaaggtctaagacagggtccattgggcttcccttagtcttaatggcagagccagagaccactgtgtggcgagttttccatagtctattgtctttaccactgtgggggtccggcctggtccctggcgactgttcagtgtactgcctctgacctccctgtggccagaggtacttcacacagagtctttctaaccagggccacttttcgatgtgaccaaaggtacatcacagggatctccagccagctctactgagtatgatgtgtgaggcatcagcacttaggtgtcaggagctgtcggtctgctgcagagggcgtggttgagggtcaggagccatcagtctgcggagagcatggttgagggcagctactcgcattacccaccagcggtggttcatgctgggcaatgcttgctgtgtaccaggaggtgggccgagcacttcgcattctgcctctgtccccacatcagcccagggacggggagcggttattgtctgtttttcagataaggaaactgaggtcagaggggctgcctttgtggtcataccacaaatgaatggaagggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 600514 - DNA, 8757 bp, Homo sapiens
ccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacatccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggtgccaccctctctgggaaggagtgttactaatagaaggctcttatccttggcccttaatttggaaagctaaggtctaagacagggtccattgggcttcccttagtcttaatggcagagccagagaccactgtgtggcgagttttccatagtctattgtctttaccactgtgggggtccggcctggtccctggcgactgttcagtgtactgcctctgacctccctgtggccagaggtacttcacacagagtctttctaaccagggccacttttcgatgtgaccaaaggtacatcacagggatctccagccagctctactgagtatgatgtgtgaggcatcagcacttaggtgtcaggagctgtcggtctgctgcagagggcgtggttgagggtcaggagccatcagtctgcggagagcatggttgagggcagctactcgcattacccaccagcggtggttcatgctgggcaatgcttgctgtgtaccaggaggtgggccgagcacttcgcattctgcctctgtccccacatcagcccagggacggggagcggttattgtctgtttttcagataaggaaactgaggtcagaggggctgcctttgtggtcataccacaaatgaatggaagggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcggagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctgaaggaggcagacactcccaagtgtgaagagaaggaaaggaggaagagggagttgcgcagctcggccacaggaaggtcttgccgaggggcatctgagcagaggctgggggacgcgccaagctgccgtgtggtggtgcacggcgttcaggcctgcaggatggagggagtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccgggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctaaaaaaaaaaa

SEQ ID NO: 600515 - DNA, 171 bp, Homo sapiens
tagacccttcgtcttcttctatgtcttccttttcttcagcctcatcatcgctctacttcttcatcacgtgccattctccacaataaagagtaatgggatatccaattaaactgagaatgtttcttcacaatctccttaattcttcgttcctcccgtaagacataaccgctg

SEQ ID NO: 600516 - DNA, 1239 bp, Homo sapiens
  misc_feature (423)..(423): n is a, c, g, or t
attaatccccggtcccaaccgcgtcgaatctagctctacgcatcattgcaggcacactcatcatagacgtctaagccgtcgtcgactgattttcttatcgctggagtacgggcctagagaataaaccatgtcgtagctttatagttccagtgtctaatcacaataataacataaactcgctcgtttgccacagcatagctggtcaatcaccaggtcattttaccttcgactgcaaaggctaacctgggatccaatcaatccgtgtctaaatgagcgtaatccttcatttcgaaacgatatgataactccgtccggagacaaaatggaaacgcaatgatagctcaatattagctatctcgaattctacattatcgttgcattccatctaatattagagtgcacttagatggggtctttataggncagaataatacactagggcacattagtctccctcatatattcacgtttcgtggaaggttcgccagagacagggcgtttagcccccaaagggagcgatcgcactctttcatggtaacaatctccgtggcccaatgtgctggtccatttgctttcgaaggaattgggaaccataggaaacatcgtaaggccccctctgcaagtcaatcgagaagtccaagttatttagcccgaaaagagtcagttcgtctgcgcggtctaacttgttacacagagccgtgttacagggcccaattttgcattccctatactaactttctgtcgtttccacaatcctgtagtaaattcccgaaatccaattagtacaagggacggaggactatctggcaccgccgctgtgggcaacttcttcacatgagagcccaaggagagaatcctcccaagggcaattaaaacagagccatggagacaccttccgttgtgaagtcccaattaaactctttcgcgttacaaaaaatttataagactccacaaagcccaactttaaggcgggcacacctggcacaacctttacaagggtacaggcccagggatattgacgagtaaaccggcgggataacataacaaaggccgcgtattacagacgcatattttatagagagcccaaattgttttcttgtttacacacgtgtgtagtagaacaactcgcttaaacacgtatgtcgacaagttaagtttttataattgccccatataaaaagcgttaagcattaaataccacagggcgaaagtttagtctccgtaaagcattaaagccgt

SEQ ID NO: 600517 - DNA, 306 bp, Homo sapiens
  misc_feature (85)..(85): n is a, c, g, or t
  misc_feature (147)..(147): n is a, c, g, or t
  misc_feature (164)..(164): n is a, c, g, or t
  misc_feature (179)..(179): n is a, c, g, or t
  misc_feature (183)..(183): n is a, c, g, or t
  misc_feature (306)..(306): n is a, c, g, or t
tttctgtgagctattagtgctgtactcttaaataaaaagagagttggttgggcgtggtggctcacgctggtaatcccagcatttntcgaggccaaggtgagcagatcacgaggtcaagagattgagaggatcctggccaacatggtnaaacctgtctctactanaaatacaaaaattanctgngcatggtggcatgtgctgtagtcccagctactccggagctgaggcaggaaaatcgcttgaacctgggaagtggaggttgcagtgatccaagatcacgccactgcactctacgcctggagacan

SEQ ID NO: 600518 - DNA, 824 bp, Homo sapiens
  misc_feature (99)..(99): n is a, c, g, or t
  misc_feature (112)..(112): n is a, c, g, or t
  misc_feature (172)..(172): n is a, c, g, or t
  misc_feature (177)..(177): n is a, c, g, or t
  misc_feature (213)..(213): n is a, c, g, or t
  misc_feature (224)..(224): n is a, c, g, or t
  misc_feature (283)..(284): n is a, c, g, or t
  misc_feature (369)..(369): n is a, c, g, or t
  misc_feature (392)..(392): n is a, c, g, or t
  misc_feature (401)..(401): n is a, c, g, or t
  misc_feature (422)..(422): n is a, c, g, or t
  misc_feature (427)..(427): n is a, c, g, or t
  misc_feature (442)..(443): n is a, c, g, or t
  misc_feature (452)..(452): n is a, c, g, or t
  misc_feature (465)..(465): n is a, c, g, or t
  misc_feature (476)..(476): n is a, c, g, or t
  misc_feature (480)..(480): n is a, c, g, or t
  misc_feature (483)..(483): n is a, c, g, or t
  misc_feature (491)..(491): n is a, c, g, or t
  misc_feature (507)..(507): n is a, c, g, or t
  misc_feature (542)..(542): n is a, c, g, or t
  misc_feature (547)..(547): n is a, c, g, or t
  misc_feature (551)..(551): n is a, c, g, or t
  misc_feature (554)..(555): n is a, c, g, or t
  misc_feature (566)..(566): n is a, c, g, or t
  misc_feature (584)..(584): n is a, c, g, or t
  misc_feature (596)..(596): n is a, c, g, or t
  misc_feature (602)..(602): n is a, c, g, or t
  misc_feature (604)..(605): n is a, c, g, or t
  misc_feature (609)..(609): n is a, c, g, or t
  misc_feature (615)..(617): n is a, c, g, or t
gagggaaacctggggcgtctcgcgcaaacgtccataactgaaagtagctaaggcaccccagccggaggaagtgagctctcctggggcgtggttgtcgtnatccttgcatctntaacttagggtcaaggcttgggtcttgccccgaagacccttgggacgacccggccccagngcagntatgaacctggagcgagtgtccaatgaggagaaatngaacctgtgcnggaagtactacctggggggggttgcttcctgccttttctctggttggtcaacatcttcnngttcttccgagaggccttccttgtcccagctacacagaacagagccaaatcaaaggctatgtcgggcgctcaagtgtgggcttcntcttctggggatagtgctcaccntcctgatancatcttccagatctacggccncgtgnggtgcctgtgggganntacctctcnttcaccatacccntgggcaccccntganaanttctgcanatactggggcctgttnattctcccaggacaggctccttaaagcagaggagnctgtnctgngannccctttctcanactcctaagaatggttcnatggtccacgtnctctgntnnaatnccccannnaagggaccctgaacttacaaaaaacaccaccacacagagaaaaaaacggggcggccgcaggcgcacggaaagtttaaaacctgcgtgggagggacccacagaggcagcgaacgggccagggaccagagaccggcaagaaggggggtccaccaaaaacggggacgggcttgacacacagccggagaggcaaaaggcgactaaccgggg

SEQ ID NO: 600519 - DNA, 189 bp, Homo sapiens
tctggcgcgggaccctgatgacggatgtgcgcggtggcctggggcgggaccccgcaggacctgctcggcttcctgctctcgccggaatgtttcctgctgtagagtggctgcatcttgcctgtgcccggtggcccttggtgcggcgtggcgcagggcgcggcgtggggcgcgcgtgggcgcgtgcggcag

SEQ ID NO: 600520 - DNA, 191 bp, Homo sapiens
atgtttcagaaggagaattacagtatgtgtagtttcttacagctttatcaaagggcgtcacggggcattatcttaattagcagtctcaaatagaaagtcaaaaagtgggagtctaaacttagggcactctgcaatgaacccatcgcacacacctctgcataggaacccacgctctgcaagtgaacccacgg

SEQ ID NO: 600521 - DNA, 221 bp, Homo sapiens
  misc_feature (66)..(66): n is a, c, g, or t
  misc_feature (68)..(69): n is a, c, g, or t
ggaagaaccatttccttttctggggagtcttgcggtttttattaaggctgtcatgtaaaagcccangnngatgaaaggattgttcttgttgacaacaaatgtaagtgtgcccggattacttccaggatcatccgttctttcgagatcctaatgaggacattgtggagagagacatccgaattattgttcctctgaacaacagggaggatatctcttgatcc

SEQ ID NO: 600522 - DNA, 276 bp, Homo sapiens
aggggggttttttttttttcccccggggggtttaggggtctgggggcaaaagggtcccccccccccggtttccaaaggccagggccaagtgggagttttttccccggccccaaggcccacaaaagggttttacccccttaaaaaaaaggcctttcaaaaatgggtttgttggggggggagtttttttaagggggaaattggaaattccccccaaaaagttttttttgcggggtccccaaaaaaaaaaacccaaaaaagaggggtttggggggccca

SEQ ID NO: 600523 - DNA, 786 bp, Homo sapiens
  misc_feature (134)..(134): n is a, c, g, or t
  misc_feature (139)..(139): n is a, c, g, or t
  misc_feature (175)..(175): n is a, c, g, or t
  misc_feature (186)..(186): n is a, c, g, or t
  misc_feature (245)..(246): n is a, c, g, or t
  misc_feature (331)..(331): n is a, c, g, or t
  misc_feature (354)..(354): n is a, c, g, or t
  misc_feature (363)..(363): n is a, c, g, or t
  misc_feature (384)..(384): n is a, c, g, or t
  misc_feature (389)..(389): n is a, c, g, or t
  misc_feature (404)..(405): n is a, c, g, or t
  misc_feature (414)..(414): n is a, c, g, or t
  misc_feature (427)..(427): n is a, c, g, or t
  misc_feature (438)..(438): n is a, c, g, or t
  misc_feature (442)..(442): n is a, c, g, or t
  misc_feature (445)..(445): n is a, c, g, or t
  misc_feature (453)..(453): n is a, c, g, or t
  misc_feature (469)..(469): n is a, c, g, or t
  misc_feature (504)..(504): n is a, c, g, or t
  misc_feature (509)..(509): n is a, c, g, or t
  misc_feature (513)..(513): n is a, c, g, or t
  misc_feature (516)..(517): n is a, c, g, or t
  misc_feature (528)..(528): n is a, c, g, or t
  misc_feature (546)..(546): n is a, c, g, or t
  misc_feature (558)..(558): n is a, c, g, or t
  misc_feature (564)..(564): n is a, c, g, or t
  misc_feature (566)..(567): n is a, c, g, or t
  misc_feature (571)..(571): n is a, c, g, or t
  misc_feature (577)..(579): n is a, c, g, or t
gagggaaacctggggcgtctcgcgcaaacgtccataactgaaagtagctaaggcaccccagccggaggaagtgagctctccgggtcaaggcttgggtcttgccccgaagacccttgggacgacccggccccagngcagntatgaacctggagcgagtgtccaatgaggagaaatngaacctgtgcnggaagtactacctggggggggttgcttcctgccttttctctggttggtcaacatcttcnngttcttccgagaggccttccttgtcccagctacacagaacagagccaaatcaaaggctatgtcgggcgctcaagtgtgggcttcntcttctggggatagtgctcaccntcctgatancatcttccagatctacggccncgtgnggtgcctgtgggganntacctctcnttcaccatacccntgggcaccccntganaanttctgcanatactggggcctgttnattctcccaggacaggctccttaaagcagaggagnctgtnctgngannccctttctcanactcctaagaatggttcnatggtccacgtnctctgntnnaatnccccannnaagggaccctgaacttacaaaaaacaccaccacacagagaaaaaaacggggcggccgcaggcgcacggaaagtttaaaacctgcgtgggagggacccacagaggcagcgaacgggccagggaccagagaccggcaagaaggggggtccaccaaaaacggggacgggcttgacacacagccggagaggcaaaaggcgactaaccgggg

SEQ ID NO: 600524 - DNA, 190 bp, Homo sapiens
cccaaccttttcctccgccccctaacagcccccctcctaatactaactacctgactcctaccccttacaattttggcaagccaacggcacttattcaggtgaaccactatacggagaaaacctttacctttttttctattttcctcaatttcttaattatagcattacaggccaggcttttcctttttgc

SEQ ID NO: 600525 - DNA, 229 bp, Homo sapiens
cccattaataaagatgccggctcattagtaaagataccggtcattagtaaatgatgccgggcattagtacagatgccggtcattagtaaagatgccgctcattagtaaagatgccgcgcattagtaaagcattgcgcctattagtaaagatgccggtcattagtaacagatgccggtcattagtaaagatgccgctcattagtaaagatgctggatcatagtaaagcat

SEQ ID NO: 600526 - DNA, 900 bp, Homo sapiens
ggcagaatggagagcaagatcatgtaggaaaggaagttaaggaactgaggcaccaggatgttacaaagataatctgacctggttatgagaatggtaatatgggtatagtggtatactgtcatggtttaataaatgcctcttatataatgttcttttctggttcttctaataattcagtgaagtaaatagaagaggtactaatcctatttggaagatgaagaaatggggcccagataaattatttggcctagtgagaactgaagttgaacttggctctttggacttctttgtgttctttcctttttaaataaaagagacggaattttgttacattgcccgggctgacttgaactccctgggctcacaccatcctcccacctctgctccctagtagctgagactacaggtgcacgccatcgagcctggtgatttctgtgtatagtatcgtgtatggtggtatatagatgtggcctctcttcaaggtatatgtactgtggtatatagatggtggtcatgtacagtgtgggtatatctccagtatgccaaaacattgtacttcttgtgataacatggagcatttgtgtaccagttaataaactggtagaacactagttggatgcttatcaagatcttcactcttgttcagacatctcagtttaacaccatagttgcagcgtgggggtcgtgcctgggtccggcttggggccagtggtgggtactgcgtccgggtgggcccctggcgctgggaaccggctctcagatcaaactggggggggggggccggtgcccacggggcggggggggacttgatccgggggggtagtcccccgggggggggtgaaaaaaagcgggcgccatggggggtcttctcgcctctctcgccgtcgtctctggccttga

SEQ ID NO: 600527 - DNA, 136 bp, Homo sapiens
gctggctccgtagacgctgaactatgtgggccaagcgggctgattttcccacctcagcctcctgagtagctgggaccacaggtatgcacaaccatgcctggctaattttttgattgtttttttgcagagaccaggt

SEQ ID NO: 600528 - DNA, 224 bp, Homo sapiens
gtcggacgggcgcttcctccgcgggtacacagtacggctacgacggcaaggattacatcgccctgaaagaggacctgcgctcttggaccgcggcggacatggcggctcagatcaccaagcgcaagtcggaggcggcccatgtgcgcggagcagcagagaggctaacttggacggcacgtgcgttggacgggcttcgcagatacctggagaacgggaaggagacg

SEQ ID NO: 600529 - DNA, 1040 bp, Homo sapiens
cattgctcgtagtcaaaaaccggaagtgtcggatgtcatgcactccgtgattgcaatatatctcaagaggtcgttcataggctatgtcatcgtcgtgagctcaaaaatataagttctgaggagtcacagctcttatacactcgagagtagtctcgcagcaccatacagtggtgccaagaggatccataggtgcaaatgaactctcgaggagagtacatcaggtcagctatacgtccaaacactggagcatggacctctgtttacacttatgcacgtctcgatctgggccaaatacataataagaagtcctatgggaaactcccagctagctattctctgataagaaaaccgtgtggatctaacacaaaagacgcacgcataggtaatggaccttcccatttaccgaatttcctcgacacgttggacagccccttacatacgtgagtcaattaacgtcactcaggtttaattttcattgccttgttctcattcgtgaagattagataggtattcttctacctaggaggcatccataaggcagaaccgatgatattaagtgaccactatcaaaggctcgttaaagcaagccgctcattcagatcgaagcccggatctgatagtttccatattcgggcttagattattcatccagacttccgacgctaagaagataggaggcagtcgttggccttagttaatagaacattgtgcatacgtatacaaaaaatccccatcgtcgagatatccaaagaacaaaggtagtatcggcactagcgatcacttatgagcctaggcgagactcttcatcggagctgaccggggacaccaggaacgcaacccttggccctctcggagagtaccctcgggatatgtcgaatcttatcttttcagaattcctatgaaaaagaagccatgggcgcagaaaaagaaaaaatagttggcgggccaaagacaatgtggcggcgaaaaagaagagagagagagcgggaaaacaagggtccgaaaattctagcagcgcatagcactaataacatatatgc

SEQ ID NO: 600530 - DNA, 1013 bp, Homo sapiens
gaagctaaggctgcgttggggtgaggccctcacttcatccggccgattagcaccgcgtcggtcagcgcctgccctacattcgcccggcatgtgctctgtctccgagctctgcctgcataactcgtccctcattctgcacgacgatgaggtgacatgtcacggagtataagatcaatgccctcataatacggagtcaggtgtacagctctttgacgccacttttgtggcctgcattgtttagcacagagggcgcgcgtgcccaagacgttaaaccattatgtggatgccttcatctgcagatgtacggggcgccgttaggacctgtttctaggaaagtttggttggctggactcaagccagcggagggtcctaggctctcctcgaataggtggttgttggaacccaggttgagagaacaaaaagaacgtgtgaaccccatggagacatttgagtgacatcccggaacggagtgtccgcgtttgaatgcccatgggcgcttgttgtgggacctgaacgggagttaagacccccgtcgttttgtactagaccattggtgtgcgacactcaagaaatacggcttgccacgttttgagccatagatacccatagagagaacaaccaacctagggtgatcattggggagcctggccaggcttgggggagcttggttgctccaagggggggcccccctgaattgtggggccaatgggacccttccccctgcaggaaaacctgcgaggggttcctcatttgttgacgcgaatgggagggctcgatgccaaccacccgaaaaggccagttagccctatagggggaaacagttggaggtcccaagctgccattgtctaggacagaattgcgcggcggcacaaggggacctgtggtgaacgctccaaggcctttttgtaagttccaacctttgggcacaacgttcgtacccaccttccaagcggtctattggggatagggccccttaaaaagccccggggaatatgtggaacccttgggggtcc

SEQ ID NO: 600531 - DNA, 383 bp, Homo sapiens
ctttccccttttaaatatttaattcttatgtgggcttatttccagaaaactttggtgataattcttgagaccaaaggtgggtaagtagccttattatgtaatgcttatatcccatagagtttttaatagaagagaaatccctttcctccgagggtccctattaacaatggacttccttaaatttagtttaatgattggaatgggggctgcctttgccccttgccttaagttatgatgagacgaattggtgttaaaaattatagccaaaagaaatgtaaacttgggtaaaatcccttccctctttggattggtttttttaagggttttattccttaaatgtaaaatggctccctaattttttgatgttaatccctttaattcca

SEQ ID NO: 600532 - DNA, 124 bp, Homo sapiens
gttgtacgctcgtacctctctgccgccagattcacaatgttctctcacgtccactcacactatctctgcctcctctcttttctttatcctgaagcctgatggcctgagaacttctcctgggggc

SEQ ID NO: 600533 - DNA, 587 bp, Homo sapiens
aggctgcaaaaagacatcagggggaggacatgctttgcctaaagttgtggttattgcatgctgcggtgatttacttcaggggacagactccgtagaatcctttgatcttgatatcccgaaaagcggttcctcgcctcacagataggaagcctctcctttggcgcttaagtgcttacatatttccagcaggctgcattcattgccagaatttgcactctctttattaacgcagacttcaggactctctgctttgcaggacttattcactacatcagccatattcgtatacttagactgccgcattggatatgtgcggtcatgcttgagttaccctacattggcgcgaaacctgtctcgggttactcagaggccctcagtctgagaccgacacacgtatgcgtgacattgctatcgaatttgagagagctgtggaggcccatatggtttatcaccgttggaacaccaaaaccaagaccgttctgagtgccagcttgctctacagtacttgcccacagcccagtggagtagatcgatgtcattgtactccacatactgtgctaagacctaatatgtcttattatcaacca

SEQ ID NO: 600534 - DNA, 359 bp, Homo sapiens
tgagcggactcttgagtatcccagtcatctcgtatacaccagggctacaacgatatgtagtatagtagtgtaatgatcactcctacattcagataatgttaaggctggaacatacttaggaagtcacttaagttttagttacttctagtagaacctaagaaatataagagcatacccacacagagaaaagaaatgatacaattacatggaaaattgcacacgtattatatacaactatatttataacacaaatggaaagtacatctttacaagcttccacagaacatttacaaaaatgacttggaatgcattcctctaatatctgcctacgaaatccctaagcattcttcattcccatc

SEQ ID NO: 600535 - DNA, 881 bp, Homo sapiens
ggtggtttttcgctcgtcgactgcgggtcttcctcggagcagacggaagcggcgcggaggtcgtagaagtggcctaaaacttcggcgttgggtgaaagaaaatggcccgaaccaatgtcagacgtgctctgctaatgtccaccggtgtggaaagcctcccgcaaacagctggccatggtaaagccgcctagtgaaaagcgctcccatctacgcaggcggtggtgaagaagccttctatcgtctacaggcccgggaccgtgagcgcttcgagaagattcgtcgtgatcagtaagtcgtaacgtagctgctctatccggaagctgcccttccatgcaggttggtgagggagatcgcgcagtgatttcaagaaccgagctgaggtttcagcagcgcagccatcggtgctgctgcagtgaggctagcgaagcgtacctggtgggtctgttcgaagataccaacctgtgtgccatccacgctaagagagtcaccatcatgcccaaatgacatccagttggctcgccggatacggggagagagagcttaagtgaaggcagtttttatggcgttttgtagtaaattctgtagaatacttgggtttaatttggtgacttgtttggtaagaaattgtgtataagtatgttgcattttgtacttaagtcattccatctttcactcaggatgaatgcgacaaagtgactgtgcacagacctcagtgatgtgagcactgtttgctcaggagtgacaagttggtaatatgcagaagggatgggtgatacttcttggcttctcatgatgcatgtttctgtatgtaaatgacttgttgggtagttattaaggtactagaagtggttaaatgtgtaaccgggtccgttgcaataaaa

SEQ ID NO: 600536 - DNA, 1330 bp, Homo sapiens
  misc_feature (824)..(824): n is a, c, g, or t
gggacacccgggaggtagaaccgggttctgctaggactgcgaatgcctaagatacaacatgccattatcgtctcattacgagaatttcaattgacttggtctctagttatctagggggtgatgcgtttttgatgtgcatctactaggagatgaaggaaagcagtgcatgaacttactgcacagataaggatgaccaatgagaacagatgtatgcacatcgtctctcaagcgagaaaagtgccatcttaaggtgactgaagtcaaagaagacgtggaagaattccttaccatacaattggaccccatgtgtgattggatcagggcgtgacccattgagtttataaagaatcggggtaacgacatagtgtactcaccttggagaagttcggaggagcaagaaagatattggatatggtgatcgaaatcaccctatatactaagggttgacgcgtatttctcgggggttcgattttcgtgggacacaaaagattaccactattacaaaaagaggtttcaataaagaacgaggattaaggccctttgttagacccccccgagctgacattaggttggccccacattaggaggaggttgaaaaatataaggcggcctggatataaacatcttgattaagctgttattacgtgaagcgttctccacactttttttcggaacttggctcggtctaccattagccaaggtggacaacacgcgcgagcaaatctggtggccaatataggtctgggccaaactgggaaaaaggttgggccgaagatccgaaaaggtttacccccacagacttcccggtgggggaataataggtncccttaggacttcatctcttttaagaatccttatatcccctggctaggacacttcacttttttagaatgagacaccttttctaacatatgccaataaaggtggggaagcctccacaccaaaaagggggagggctcaggaccagtggcaaggccccaatttgtgggacctgacacacagctcattagaccccggccacaatcacgattaacctgaatccattgggggaggaagcgacactttctaggaggacaaatggggccccaaggagcgttttcctttctctctcaaagaaggcgccttcgtagaattggcaaagtttacaactattcccacatttcctaaaaagccgtttggggccattaggaccgaggtggaaaatgggctccagtcgcccatatcaccaataccggcacatttggcaacggaaacaatgtgcccataccccgccttggaaattcccacagggggtcgaacgtataattctccacaagtggacactgggccg

SEQ ID NO: 600537 - DNA, 503 bp, Homo sapiens
  misc_feature (395)..(395): n is a, c, g, or t
tgcggtggctcatgcctgtaatcccagcactttggaaggccaaggcaggtggatcacctgaggtcaggagttcgagaccagcctgaccgacatggagaaaccctgtctctactaaaaatacaaaattagccgggcgtggtggcgcatgcctctaatcccagctacttgggaggctgaggcaggagaatcacttgaacccgggaggcggaggctgcagtgagccgagaccgtgccactgcactccagcttgggcgacagagcaagactctgtctcaaaaaaaaaaaattatgtaactaatattaaatttacgtaatatatacatatgaagaaatgcctgtttgcctgggggcgcataataaaatacatgtgtcacatcagtcatggtgtctgacanaaaccctcagccttctaagaaaaacagaatggcacaaaattcttaatacatagcatagaaaaatagtgttttatttcatagtggcaccaaatcaagggacaaccatag

SEQ ID NO: 600538 - DNA, 1001 bp, Homo sapiens
  misc_feature (458)..(458): n is a, c, g, or t
  misc_feature (775)..(775): n is a, c, g, or t
gctagagtgagagttagtcccatggtgcggagggtctaaggcccacacccggaaacctagcgaggtaaagttgcgtctctggtatgtcagagagtgacaaatttctccgcttcctcggctgtatggcgagcggtcctgtgtgagacgggtaatgcgcaccgatttataaaccgtgtgtgtaactggaccaagcaactactgctacggaagctcagtagttatctgtctgaaatctacatatattatcgacaatgatgcagcatggtctaagaaaatccgtggcgtgcctgaagaccctggcacataatggactcacctatgtactttaaagataccttgtcaaagcatcttcaagccatttgggcctcttgcatagaaaagcatggtgatggctgatagcccaagaatctcgggtcacgcaaaacatatgtgcacagattgcatgcggtcattggatngcatcagggcaacaggttgcgcatcgcgttgtacatcccgcatgttatctcattgagtggctacagataaagggcgtgtgtagcacatgcgtgtgacatgtgtgccgcgtagatatatatccccgcacgttatatatttgctacctaagtgcgtggcattcgtcttatagtggaaagttaccaaatgtgtggttcgcccataaatctattatgtaaacaattgtccaaatattacgtaaggagtttggggacacgtggcctcttttggaaacaccgtgagcaaattacgggcgccttgggttttatccaagtatagnaccagcggccgtagagacattgatcgtgctttgctttacgcgcctttctcatttgcgggcattcgcattctgttttcaaggttgacgtacaaacgaatagtctcccaaatccaaagcgaaagtttccccacggtgaatagcccaatgtcttgttaggccaacgttcggccatagcattctggaatccccaacgagaggaagcataaattattccctcccaagggga

SEQ ID NO: 600539 - DNA, 689 bp, Homo sapiens
  misc_feature (567)..(567): n is a, c, g, or t
gggagagtagtaattttagacatttaagtaactaaagatttatatagctttagtatgtaagctgttatatttaaaaatgcttgaaaaaataagagttgttctccagaaattattcattttcctatgattagcacagctgagaccttacaggtgcactgctattgagtattctcccaaccttttaaattttataggtctaattgttggtaaggtattgtggaaggagttctaagacttgctcctgctttaattgacgttgcaataataatcataataaaattgttggtcaaagagtagcacaggagtggttttggtagtgaagaaaataaaaagaaatctgaaggtagagatgaatggaatcagcaaaagtgaaattggttagattagtaagttgtttttctactgggacactcatggatgatactgacatatactccattctcccttgctatatctagattttttagtacctctaatactaagagattttaatttctttgctatacttctgtccttttcttctctattcatgctcaaaagaaagtaagtgctataactactcttttntggtggctttaaaaatgactcatgaacttaggtacttaagtatgacacttctgacactaataccatagcggagaactactgagtggtaccagtgcaatagagggctgcaaggggtcatcggg

SEQ ID NO: 600540 - DNA, 1750 bp, Homo sapiens
  misc_feature (179)..(179): n is a, c, g, or t
  misc_feature (369)..(369): n is a, c, g, or t
ttgatgtctttctttttctctctgctgtgcgtcgtgtctggcgactcgacttgcatgccggtgtgagtacgtgatgtcgttgtcccgcttcgtgcgtggagccacaccactctgtggtgttgtctaatctaataagatacggcgcgcgctatctcttctcccttcctttatgtttattntttcgcgccggggcggagtgatatatattattttcatacggcgctgtcattgcttgctcccttctagcgtctcttctttgtgggtcgcgctacacgtatgaacaccgcttggtgtggtccaccaaacaacacgcgtggtgttgatctcctcgcctgcttgattctttctcccgcgggggtttgttttgtntcactcctccccctgtgttttgcaccgtcctctctcgttctatcttgtgttgttggttatcctcctctccccccctctctttgcctctctcttatcatggggggcggtcgcttttatactgctccttccctttaatctggtgatctcctcctggcgccgtggtttcagcacacgtcgtgggtgtgttgttttcgtttgctctcgcctccgctcttttcgtttacacgtcgttctgtgttctattattagtatgtggggatccgttgtgttcgttcgttcctcacgcatctgccctgttcgatcatgatactgtacgcccccacgaatgttggtgggccggcctgtattgatttctttcccctctcgcggtggggtgcactacctatctcttctatcgttggggccggctgtgtaacactagacacctccctgctggtgttccctctctaaatgggggccgtctttattttattccgcgcgggaggatatatcgtcctcttgttgtattgtgcctcccccctcccacacggagatgttttttttttttttcccccccgcgcgctgttttttttttgtgtgcgcgccttttttgttcccccacgcgcactctccctgcggtggtccgccgcttcgtctctccccctcccccctattagtgagagggcgcgcactgtgtggcgcccccccctcacacagtgtgggttgttactaccccccctccgctgtgatatcatcccctctctgctgagagggagcgctccccctcgctcttttatagacacacacacgctcgctcgtttatatatgtgtgcgccttctctcgcgcgagagagatatatatatacacactcgcgcgggggtctcgcgccccatcgtctctcttgtatatagtataggagacacacacacctccgcgacacccatcacatatatgtattttacgacgcacctcgcgcgcgttgatatctacacacactcttttgttcgcgggtgtgtttattttttctccctcctctctcacacagcgcccccgagagtgtttttgcggagtgtctctcctctctcctcctcctcttttctctccggcgcgtgtttatctgcgcgcgccgcacacacatttttgtgtgcgcccaccccggtgttctccccggtgtttctctccccttatttgtgggcgtcacacacactttctctcccacacatatgtggttttttccccccccccaatattttctctccttttactccccacacacacaacacctttgtgtggtttaaaacccccccccccatatatgtcgctctttttaagagaaaggggtgtgtgtgcttttttttttgttttctctctcttttttgtgtgatggggggggtgtttata

SEQ ID NO: 600541 - DNA, 848 bp, Homo sapiens
agcgggtgttgtggactcgtggtgctggactgccgcatgttcacgcgcgagacgggaacgggcggaggggagcgggcggaggctggccctgcctctgcctggccggcgccgcagatcggcgcgggccgcgcccgccgaccgcctagctgcacctgagtcgcttgactagatggccgaagggagatcgtcggggcctgtcacctggagggagcctgccgcgctggccccgatggagggtggcgttagccataggttgaacaagtctctccctgctgctgacggggggtcgggggacggaacctgggaaaggagggtcgtggtctccttggacccccgcgcactcctcccacttactctacaccgtggatgcttggatgcggcccaagatttgtgtggccaaacactcaccgaggcatttgtggcgcttctccagtcgtcgtccatcagataccttcaggcattcccctagactgtcgcagggtcttgcgcatctatcgccataggtagcggagagctgtgaagatgacttgcgtggatgtttcaatgcttagcacctttaccagactaggagcagctcgaatgtccttcgtatttactttcatagagcaagaaaagtgctagggctcccacttattttctccctgatggtgtaccaggagttctgctccatatccaggcagaaatgctggcggtccacggtgtttggcgcatccatggatggcaactggtgatccttcccctaccccagaggatatcacgtacattttgtagatgctggactttgagggccatcgttgcaaggaaagccaacagattcatcctcaaggacaagtcatcgaggtttccca

SEQ ID NO: 600542 - DNA, 550 bp, Homo sapiens
gaaagaccctgtaaagaggttgaaaaaatgaattacagactgggagaaataatttgataccatatatctgacaaagaacttacatctagcatatgtaaaaaattctcaaaactcaatagtaataagataccaattagaaaataggcatatgtgacctctctgtattataacttaaacctcatgtgactacaattatttcaaatgaaataaacaaaacagtaatgcctgtttctggcatataaaataatcagagaacatagaattgtacgaagttaaattattgggccatttacttaatttaaatatttttaaatgcgtgtacccattttgcttgaagggtgtgtgcaaggatgcttggatttttttaacgataatatgggcacatgagcattaaatttattttttaaaagtttataggtaccccacacaaatttcttattgaatccctcaatcttaacacctggctaagatttcattttataattaatggaatggagggttattcttttaaaacacctgtggtaggcccaattttttttttactaaaaag

SEQ ID NO: 600543 - DNA, 126 bp, Homo sapiens
cgatattgaccagatgtaccaggttgagtttgacgatggattccagatagcaatgaagagagaggacatctacactttaaatgaagagttacccaagagagtgaaagctcgattaaccacagactt

SEQ ID NO: 600544 - DNA, 364 bp, Homo sapiens
ttatgtcattcgtctggagcctctgctacagaaggtggtagagaagggggccattgataaagataatgtgaaccaggcccgcctagagcaggtcattgccggggccaaccacagcggggccatccgaaggcagctgtggcttaccggggctggggaagggccagccccaaacctctttcagttgctggtgcagatccgtgaggaggaagccaaggaggaggaggaggaggctgtagtcactctttttcaataaggttagtatggtcacttctgagtgcctttataggaatctttattgtagacttatatcacacttactgttcttgcttcttattttttcttctaatgcgtttacttggttttt

SEQ ID NO: 600545 - DNA, 801 bp, Homo sapiens
ggacaaacctacagtgatgtgtgacggagtggtagtctcgtgtggaacagcggtctacctccactcactggaccagctggtgaatggagaatgtggctgagtatggtcatgttatccattgggtgtggaacgacgtgtgtgtccggcgacacatggtgcctcaatcatgcctgtaaaatggaccaataaaggtatggtcgtgagtggagaagggatgatctacgggagctatgtggatgcgtcgtggagtagattgtatcacacatgcgtgtgttaggatggcatggggactctatggtgattgaacagcaaatctgagagagcgataggaggggacgaggtcagagtggggaggaattgctagtctgggtcgtctattcttagtactattctgcgctaggagtaagatctatgctccagggagcttggaaccgaggaggtaggcgacggaggttagcagtgtcctgcaagggttaataccattggtagacctcgaacgcctgtggcccccatgaggtgccatgggttgctgtcccgatcgacaattctgtggcagatatcgggggaaagttgactggcttgaagtaattcgcagggagaggtgacgagacatacgaatgagcacaagataaatcgtgaggataaaagactgaatacgttctgccaggtgtctgacataattctgatagcatcaagaaagtgtgtccctgaaattttcattctatagcgtaactacaaaatggttatatcaagtgaagatttagagttaaagagaaggtggggagttggggctgcgggaaa

SEQ ID NO: 600546 - DNA, 486 bp, Homo sapiens
  misc_feature (308)..(308): n is a, c, g, or t
cctgtgttacctcatccatacccatagcttgtagctataagcaagtatgataaaatctccctaagctatagccaagaactgtcttccaggctcaacccattttagtaccatgcttgtctggcaggattaagtaagtgcaaaactgaactcagttttctttctaatgcaagcctgttctgcgacttcccatcatgggtgaatggtaccatgacgccacctagaccacccaccccagaacctccaacgttatcttacatagggtccctcattcctctggttcctttagcatcaatcatgtagtacagggnctgatgaggtctgtcttcttgaatagttctcgaatgctgctcttgcctctcaaattccactaccgtggtcttgaaggtcctcatcacttcttgctgtccgccctctacaatgaactaaggtttgttttccaaaacacaaataatcctatttctctcttgcgctcgtcacttaagagag

SEQ ID NO: 600547 - DNA, 123 bp, Homo sapiens
tctcacttagcaaagattatgaatttatggcaaaatgctgagtgaattaaacaagaaagtcagctgcagcataagcttcctaagccacttagtgcaggatgctaaggacagtctaacctgtta

SEQ ID NO: 600548 - DNA, 832 bp, Homo sapiens
  misc_feature (696)..(696): n is a, c, g, or t
ggtcgcggttcgggtctcctggtgtacggacaacgccaagtaggggatggcgtaccctccagtgcgcaaaaccttagtcagaactatgtggagtatgatccattgcgataatattgcacttggcatttttaccaagatggattatcagacaaggatgttgcatagaggttgtgttagggatatagtatagagaaaaacctggtaaaatctgggtagtcttccatgtaggagtggggaatacatgtctggaggacacaagacgaagcgatgtgacggactagcagtgcgtagaacaggagtgaccgagaaactatgtgacaaatcactgtcctcgagagcatatacagtcgccacattctcgaagcaactagaccaattgctgtgcattgactgttatgatcaacttattgaatctaggtgatgcgcactaatgttgcgatgactctgtaagaagtggtggcatacaaatcatatcccttcactgtcatattcgaagtggccgatatgttaatttgctcggatggaatatggtagctgagaccgagtgagaacggtcttgttcagaagtgccacaaatgtataagagacaattgcaattctacattaattgaagcgaagattgtaaaatcctatgtgcctaaatgtgttggcacttataacattgtactgtcgtttgggggtacacttaatgtatcnggaacatgaagacatagataaggcacatactagatgtacaagacgcaggtttcgcgcaagagaattgttattgcgtctaagtgatgggttcgagaacgacacgaagggataagggtggaagctaatgattctacta

SEQ ID NO: 600549 - DNA, 1214 bp, Homo sapiens
  misc_feature (355)..(355): n is a, c, g, or t
agtctgtgggaggaggctggcgtggaagtgtcgaggagctcaagactcgctggaccaagtccgccaccagattacctgcgtgcactctgcagccattaaacacatgcaattcagtagccggtggaaggacgaagatcgggccgagatgtggtccagttgactcccgtagagtctgggctctgtgtggtaggcccctctgtgagctgatgatcaagcgaatgtgtcccgcattacatagacgaggagctgtggtagctctagagtgatacccaatagattgctcatcgaattgagataccacatattagctaatatcaccagtaggagcataattgagctcgttattgcttggtcnagtgtagcgacttaagagagtaataaagaccactctatccatacgagactatctacgagatgagcaacaattgcacagtggaacgcagggccctgctctaggcacagtcctgtgatgcgagcgagtgcctgagagcttgtactcctccccttatgcgtgatagcttggcgcacatgtcggggtcggtattcattgagacatgtttatgggcatgatgcaattgacactgacttggcaaacatggacacacattgacagactgtgaggcacattggcagaaccttctcaatctatccactagtcatctcgctagctccaattactggcgtgatggttgcccccaaaggtctaccaaagcagacatcgagagattgcgctcggcaccaggcggcgatccgggagacacggaggactgggcgggatcagacagtgtactggagcagatgtcccttgggctccacatccggacaggggctcaatcactcagcgcctcccgaaaacatcgcacgggggaccagcacgaaccggcagactaaatcaacctggaatgacagttacgccgcagcgtatgacgacagagatggaggcggagaacctccgatacgcgagcacgtccccggaagctacgcagacataccccagggctggacaacaaggagaggggcacccgctggtcctctggcccagtgagacccttccagaatccgcgtataattagaggccgtgcgctacctttatactctacattagaaatactaaatacttcagcctcaccacattttatatgcaggcacttcggctgagcaaggctatctactatataaaaggtaatcagcagtatatccctctcatagacgtc

SEQ ID NO: 600550 - DNA, 234 bp, Homo sapiens
gcttggggtggtagcaccttggtctatgggtgctaccttagaaggatggatgatgggaagaatgtgaaagggaggtgagatgcgcagcactgggatgtgtggcttatctgtcttgaggatagatagaagaggagtcagatacagttgcagaacagagatgacgtctttacttgatgacttgaatgatgtgtctggatgcgaacatgttgacgcatagcgagagaattttagtgt

SEQ ID NO: 600551 - DNA, 240 bp, Homo sapiens
  misc_feature (130)..(131): n is a, c, g, or t
  misc_feature (143)..(143): n is a, c, g, or t
  misc_feature (157)..(157): n is a, c, g, or t
  misc_feature (226)..(226): n is a, c, g, or t
gggggggccccccccccttttttgtttttcaaaaaaaaaaaaataaaattttttttgtaaaaaaaaaaaaaaaaaaaaaaaaaaaaaaaaaaaaaaaataaaaaaaaaaaaaaaaaaaaaaaaaaaaaannaaaaaagagagnggtttttgatatangaatgctgttcttgtaaaaatcaatcttgacactttattttaaactttttattggtaatgtcagggagnagaggaccgacgac

SEQ ID NO: 600552 - DNA, 320 bp, Homo sapiens
tagtcgaactgctggacgcgtccggcatggagattcagcatgcggtgcagcgcttggccgtgccagaagctcaagctcgcggcgtgtcagtgcatgaaatcattcgcgcctatcaggccttgatcgatcgggccatcgatcgcctggtgaaggacggccgaaagaaagtgtttccgaagttcaccgtcacgaccttcccccaggcggtggccaagtgccagggcgagagcgagagccaatacctgctcggtggcgccgttgcagggttcatcgccgtggctcctgattggaacgccaaggtcggattgatccttggcttg

SEQ ID NO: 600553 - DNA, 209 bp, Homo sapiens
  misc_feature (99)..(100): n is a, c, g, or t
  misc_feature (112)..(112): n is a, c, g, or t
  misc_feature (126)..(126): n is a, c, g, or t
  misc_feature (195)..(195): n is a, c, g, or t
gtcgctggtccctctactcccgacacttttctttttcaaaaccgtcctaaactcatacccattttcagcatcaataaaaacacaaagatgaataaaaannaaaaaagagagnggtttttgatatangaatgctgttcttgtaaaaatcaatcttgacactttattttaaactttttattggtaatgtcagggagnagaggaccgacgac

SEQ ID NO: 600554 - DNA, 921 bp, Homo sapiens
gagcttgtctcttctgtcaaccccacacgccttctggcacaactgaagtgcggtaacctttatttcgccttcttctttctctttagtctcgtgacttattccacggcgtgtagtttctgctcgtagcatgcatcatcgataggagtgatggtttgcttacactcgagtatctaacatgacttgtcggtgcatgaacgatagaaactttctacaggccttggttgtgtgactatagcctttgctcagtatcttcagcagtgtccatttgaagatcatgtagaattagtgaatgaagtaactgagatttgcaataaatacatgtgttgctgatgagtcagctgaaaaatttgtgacaagatcgacttcatgaccctttatggcagacaaattatgcacaggttgcatacctcttcgtgaatcctatggtgagatggtctgactgtctgtggcaaaaccgatgaacctgagtagatagactgatatgcttgcttgcaatcacaaaagatgacaatccaaacctcccccgatggggtgagaccagaggttcgatgtgatgtgcactgcgttttcactgacaatgaaagagacactctattgaagaaagctaccttagtactgagaattcgccagaagacatccttgacttttatgccctcggaactccttttctttggctagacacggtatcaacgctgcgttgcacagaatgtcgccaagctgctgattaagcttgcctgctgtgccaaagctcgatgaacttcgggatgaacgggaaggcttgcgtctggccaaacagagactcaagtgtgccagttctccgaaactttcggagaacagagctttcaaagctttgggccatgtagctcgcttggggccagagatttcccaatgctgatttgcagaagttcccagttagggacc

SEQ ID NO: 600555 - DNA, 401 bp, Homo sapiens
  misc_feature (387)..(387): n is a, c, g, or t
taagagacagggtcttcttccatcgcccgggcaggagtgcagtggtgccatcatggcttgtggtagccttgagctcttgggctcaagcagtcctttcacctcagcctcccgagtagctgggactacagacgtgcaccaccatacctggttaactttttaatttaaatttttgtagagatggggtctcgttctgttgtccgggctggtctagaattcctgggcctcaagcaatcctcccgccttggcctctcaaagcagtagggaatacaagcatggggccaccgtgctggaatgggatttaggattcataggagggggcaaaaagatcatgagggaagtttgttttctctggattttgaagttggctgtaacatttgcagggttttntagtttaggagggg

SEQ ID NO: 600556 - DNA, 1151 bp, Homo sapiens
gcttggagggattacacatgagactaataacattgggagatcatggtgctctgtgacccggtacaatagtagccctgtgagtcctagcatcatgatcttatcgttaactagactataaggccccattactcctgaggtataaaacagagctctacttgttataaacccgtcaagagtctactccttcagggagaaatatatgcatcagtcctgtgtttagctatgcacctactcttagtaccagaaactgtgaagtatcgaatagcatactagtttacctacttctctctttaaacttggggcacacagtcccatggtccattctgccatttagtcaaaattgaactataattgcaagcacctgatagggtttggccacttagaaattctgcaaaataaggtcaacatctgtttctaaaatccttaagtttccactagttattgccaaactcatggactgatagcaatacaggcctttttaacacaggtgaattgtaacacttcagctattatggcttactctagagtaacacatgcagttttcagaattattgtccccacagtggagaacgtattaaaggactaatgcaagaaactcagataggacgcacacaacggttaaggttcacgagggtcccagacaaggacgacatttataagcactgggaccttggagtaacttcaaccttaccgtggattcactgcatggtacatgaagcagggtttaccgtaaataacacttttctaactctcactttgggacaacacacatttttggggccattacacgtaattctaccaggtttgtcctagaagtaccgattttggtgttgactcaaacagtgtgtgaaacagtcttactagtcaaccaaggcgcttagaccaattgcctttgctttggcaagaaaaagagggaatatgtattacccctgagctagaaccacgtgtttaggttgcgagctgcttggggcaccatgggcccgtctgtgcgtgtgatatgtcaccgcaagaaagaactattgcgggaccacagagctctaccgggtcataacgcgctaattggcagttgacatgacccgttataccgggggtgaaaacttaccggcacccagggggaatgaaatgttacgtacatagagagcaccgccggt

SEQ ID NO: 600557 - DNA, 309 bp, Homo sapiens
ggtttattccgatggccagtgcccccaggagaaggcaggaaccctggagcctgcaataagggaggaaagaggactggaaagtgtggggaatgggaagaagtagttttctttgggctaaagaatattttgggggaaaaataaagggggggcttgccgggacccaccattgggagggcccggaaaaaaaagagcttaaaatggggaaaaccagagttagaactgttggatacaggagaaaaaaccgcagctccccttccggcccccccccaggtttgatgtccttccaagaataaagtttttccctggtga

SEQ ID NO: 600558 - DNA, 367 bp, Homo sapiens
  misc_feature (10)..(10): n is a, c, g, or t
  misc_feature (41)..(41): n is a, c, g, or t
  misc_feature (273)..(273): n is a, c, g, or t
cgaatgtgcnaactccagcctgcgaaggctggaggcatganacttcaaccccatgaagagctgcctgggtggactgagccccagcaaagccataggggcagggctgcctcaagaccttggggcccagcccagctctagtgtgcccaagatgcaggacgcagagtcaaagatcattctccagctttaagacttaatgttggctgggcacggtaatcccagcagttcgagaggctgaggtgggtggatcgcttgagcccaggagttcaagaccancctgggcaacatggccaaatcccatctctacaaaaactcggggagctgaggtgagaggatcgcccgagcccaggaggttgaagctgcagtgagc

SEQ ID NO: 600559 - DNA, 820 bp, Homo sapiens
agcggcctccgttcgggggggggagattgaggacaatgctgtaatgcagggattaggagactctgttccttcatccgatacagcctggagaagatcgaccaggctcactaagaatcatggtgtctatcttatcatcctttgagagccgccttatgacgactgtgagagggtccatcatccctgtgcgacaagccaagcacggagaatctgcagcggctgcggcgcgcatgaaatgtatgaagcaaggacgctgtcctgcctggagcatgtcatcagcctactaccatgtgggccagtgacgactgagaagatcatcaccagagggccccacaggtaggctggaaggagtacctgggaagcatggccaagattcccgcaaggcagtggagtcattctccagggagcacacaggcccagatgagcccggaagctcaagtaaagtgaaactgctctttgagccgcgggaaggaggccctggagtccgaatttcgcaggctgatgacgcggcacagtaaggtcgtctcgccgtgctcatcttggcatctgatcagtggtgaacgactgatctggaaggcccagcgagggacgtgaaccctgggagcaccttgcccgaagagcgtgcaccagggatgtcaatttcgcaatcctccccgatggggtgggtggaataatgggcgcaaccacagatttccttgaacgtcctacctagcagattacggctcccagccactgttggagcgcgtcccattcacacggcgtggcgagagccttctccttacaggagcccggcgcataacacagagagggcctcacacacccg

SEQ ID NO: 600560 - DNA, 222 bp, Homo sapiens
gagaagacgacagaaaggggtagagatcttttcccatgtattctgctcaggtatttcccccaaataaatgagaaccatggagtagagaaaagagacctcaagaacagggcgactgagcacaagagggaaaaaaaaaaaacaacaccaaaaaggcgggcccttggcccccgggccgggggaaacttttcaaaaagggagggggggacccccaccaggggccca

SEQ ID NO: 600561 - DNA, 1376 bp, Homo sapiens
ttagtgtggcacagacgatcagcagcgcgtctatgtctctctgcgtgcgtcatggactagagcaactgctttaggtgatataatgtggggcatatgtgctgtgtcattggtaatagtgcgattgtgcatacaatgggccccttagggcccttctccgtgtacgtgcttccctacatccctctaatcttatctgtgcccctctacggtggctcctctatctttcgcgcatgttggaggaaatggtaaatgcctcataccgcagattatatgtgaacccttttggtaccctcaaggatctgttcttctatggacaacttgagtcgcgcgaacatctcatgtggtttgtgtcacggggaaaaaaggatcctaggataaaatgacggcggatcgtgcagttttccatgacgtcgccgtaatagcaatttaggggccccctagggggcgccatacgttctgtgagcccgtatggttgccctctccaatggctccctcatcctggtaggagctcttgtggcgtggaacacacaggtggtcaaatccggcccccgttgtcggtttaacgtgcgagtgtaatattggtaacactggtccaactcttgttgctgttcccggggaaggtgtgtacagatcaaggtacacaacggaattccaagcgaaacggctggacaaaggaagatgcttctttcctgctggatggacctggccggatcgtgtggtcctggacgtcagaaggtctgtaatgcgaggacacaaagtggccatgctcgtgtttccgagagatgcccccacccactgcaagccactgaccatcaggtgccaatagcttgggcaccaactctcagtgccagcagtgccggtgcgcattttcgcactgccaattactggaccccatggatcaagagacaagaaggacatcagttgctccagtcatcgtgattccccgtgccatcttgcacataggaacagcctgtcccccaccagcaagccatggctggctaggcggcgttaagccaagccacctgactgccaggaattggagcctcagttccctcctgtgtcaatgtagtctaactgcagcagctggactgagggcagagtctgtgggtgcagagaccctgcatgtaggtcacagagttcgaggcccaggccactctacctggggccatggtgggtaggcaagtagaatctggggcacacctcaagtgaccaaatgctattaatttccatccctttagcaggctgggccctaggcaggaagctggcttctgggagaggagtgagaacgtacagggcatgcctagcttgcgtgcattgaggaaggtggcattccgtgcttggcctccgtgagtaagcggtcgcaggtctgtgtcttctgc

SEQ ID NO: 600562 - DNA, 270 bp, Homo sapiens
catgagagtcacttgaaacagggaggcagaggctgcagtgagccaagatcgcaccactgcactccagcctgggtgtcagagtgagactctgctcgaattcaagcttctaacgatgtacggggacatggagtagagaaaagagacctcaagaacagggcgactgagcacaagagggaaaaaaaaaaaacaacaccaaaaaggcgggcccttggcccccgggccgggggaaacttttcaaaaagggagggggggacccccaccaggggccca

SEQ ID NO: 600563 - DNA, 938 bp, Homo sapiens
tcaagtagagtaagccagatactaaacgagaagaaacccgtaagccaagcaaggttgaatgctgggtggcgaggtgacgaagggtaacctctaatctgataagcccacagaagtgcgtagatgcctattgatacgatacgtgtccttgtcacaggaatggacacggtagtactgcgattctgacaatgaattccaggaagaggtccgattgttagcaacgatgtgacatgtaacattagtacggatagagtccaaggtgtgatgaatgatgaaagaaggatgagatggtttctcggaagctgtataacaaagatcgagtggtgtgggtgattgaatgataggcgggaggtgtacacacgtggtggttaaagattgctgcagaaagtgtctatgatagttatcgtatggatatgattgtgcctcgagaagcgagctgagccactggcgataataagtccgttcagctcaatgactgtagacgaaaacgtggccgacgtcaagtattaaccccggtgagcatagctggatcatacctcatttgggacagccaccagagggcaaagatgggcttggttgtgacttgaacgcagattggcctagagtcgttatgacattgtgactgaaacgtcgtggatgcgtaaagtcgatgtttgctcttaataaaggaagtagagccagtagagttggtacatgggccacattctaagccagaaattaagtatatcaaggcatatgtggaaagattctctaagaaacactctatagctgattgcttagctgtcaagacagaagaaagctggtagtaaggtcgcagaaaccaggaaaggtgggatcttcggacacagaacaaaagagaaaatttgagagttacggaatcatcttcagattgatttagaaaggtgaggacttcagaaattttaggcaaaaaataccgctaa

SEQ ID NO: 600564 - DNA, 324 bp, Homo sapiens
cacgagggcatgtgtgtgtgcgcatatgtgtgcgcctgcatggatgtgaggggtgtgtaacgtgaggctatatgagggggactgtgtacatgcacatgatcataggtatgtatgttggacagtgcactcgtgtgtgttcacagacaatgcaacatgccctctatggtgccccaggtcagtggtatccccagcttagtgaccagacttacttgcactgtaagttgtgaaatacaggcttggagtggcctgggaggaggtcctgccagcagctgccacgggaacagcctttgggctgttaaagtcacattaaagtctctttcagta

SEQ ID NO: 600565 - DNA, 107 bp, Homo sapiens
ataacgactgcggcgtcgctgcgcggcgcgagtggcatcggtaaacgcgacggtggcggacttaacgcttgcgcggggggccatcaccgtgacctgtggggccgtga

SEQ ID NO: 600566 - DNA, 169 bp, Homo sapiens
ccccatgttgtgtggttgatatcctagggtcgtgatgcatcatcattaaggctccgcccgtccaagctatccagatcggagtggagactgtgtgcctgagggagttcctgctcagttttggtctttttttgtgtgcattggtctcctcactttcactctcatgagatcc

SEQ ID NO: 600567 - DNA, 349 bp, Homo sapiens
ggggggtccccccccccccccaaaaaggtttttttggggaaaccccccccccccttggggggggtccccaggggttttttcccaaaaaaaaaccggggccccccccgggggggcccgggggggggtggggaccccccccttttccccccccccgaaaagggggttttttttttttttgggccccccccccccccccgggggtttggggggtttcacccccgggggttatttttccaaaagggtttaaaggggcggggggcccccccctttttagggggccccaaaccaagggccttttttttttggggcccccccccccaaaaaaaaaaaaggcggggtttttctttta

SEQ ID NO: 600568 - DNA, 458 bp, Homo sapiens
aaaacaaaaggtttttattcaaaaaaccccaagtttaaaaaaaaaaaaaaaatcttttttattccccgggccagtttttcactcaaaaaaaaccagcgggctccctgttgttaaaaacacacccccaaaggggatttggagggccccccatccaaaacgggttttaaaaattatcctatatacccaggcggcaatgcccctccccataacccaaagagccgggacccacctgggaaaggggggggggggccccacaaaacccagggagctgcaacactgccccccctgagtcccgtccccccaaaaacagagaaggggtggaagccctcccccaaaaggtccccacgtcagggggggaaagggggaaagaaaactggggccccccctttggaaacttggaatgggaggggacccacttaaataaattaaaaaatccctaccctggcccccccaggtta

SEQ ID NO: 600569 - DNA, 376 bp, Homo sapiens
gtgtaatagatgtcatgcaggcaatccaaacgggagatactactggggtggacagttcacctgcgacatggcaattcatggcacagatgatggtgtagcatggatgaattggatggagtcatgggactcaatgtagaagatgagtatgaagatcacggccttattgccacagctatagtccacaatacgtagattctggctcttgtgtatgtgacaacatttctgtacattatgctattggaattttatttcatacattatattcctgtaatactctcacagcagacgtgagtgtgactttctgaaataagcatatgatttacatttagcacatgaatgtctttagagtgttcattactattgctcaccaagaggc

SEQ ID NO: 600570 - DNA, 102 bp, Homo sapiens
atgcgctagatgcaaatttattagtgaacggtcatcatctggaacaatcactgtaagcttgggatttaaagcatgatagacttttccaatggcccccttata

SEQ ID NO: 600571 - DNA, 149 bp, Homo sapiens
cgcccttaatcagatcttcttttgataagtcagtcagtacttttcctaacgcctttcttctggtgtgagccaggtggcctactatttttcactgcgaagatctagtgacgtcttctttacttcttccatgggaacaaaaaattcaaatg

SEQ ID NO: 600572 - DNA, 115 bp, Homo sapiens
cccggggtgggctagtcccttgaggcccagagatctaggctgcagtgacgccatcattggcatcactgcactccaatctaggcaacagacgcacgaccctgtctcaaaaaaaaaa

SEQ ID NO: 600573 - DNA, 142 bp, Homo sapiens
ctcactcatttacaccaaccacccaactatctataaacctagccatggcatcccctatatagagcgggcgaagtgatatataggctttccgctctagagattaaaaatgccctagcccactttcttaccacagggcacacct

SEQ ID NO: 600574 - DNA, 207 bp, Homo sapiens
ttcgctcagtgctcagaagacttcctgggcttctcataggggtggtcaggctgttttccttccaggggctgttctggactggagcccgttctgtgctccagcctcaggtcctgttggctgcagaccctcaagggtatggggtgggagagtgcgagaaggtggggctgcagactctggaggaggttttggcacttgggatacctcttc

SEQ ID NO: 600575 - DNA, 282 bp, Homo sapiens
aatgagaaccgaatggaggagagcaaggccctgttccgcacaatcatcacctacccctggttccagcactcgtctgtgatcctcttcctcaacaagaaggaccttctggaagacaagatcctgcactcacacttggtcgactacttccccgagttcgatgggccacagagggacgcacaggccgcccgcgagttcatcctgaagatgtttgtggatctgaaccccgacagcgacaagatcatctactcgcacttcacctgcgccaccgacaccgagaacatc

SEQ ID NO: 600576 - DNA, 161 bp, Homo sapiens
ggtgggtcttggagaagggagagatggctcaagcttgtgagcctctccctggtcaggggtccaagggaaagctcaggttgttcgcttctgccagagaacgaagatcaaaataatacttggcagagacactggaagggaacatttgatgttagaacttgcag

SEQ ID NO: 600577 - DNA, 201 bp, Homo sapiens
tagcaaccatgttttagcaatcggtgttgggttaaatgaaccaaacgtctcatttggaaaaggtcttgtcccgatttttggtcataacatgggtgattataatgctatttggccatatcatccaacatagtttagtgccttacaaaatatgacggccaagtcaattattggtaaaccgatttacgtctccgagggtaaaac

SEQ ID NO: 600578 - DNA, 102 bp, Homo sapiens
tgttgtcaatccctagactgtaagctcttcaaggagcagaggcgcattttctccgtgtcatgtaatttttctaaggtgtttggcagcactctgtaccctgtg

SEQ ID NO: 600579 - DNA, 168 bp, Homo sapiens
cactgatgttcataggggttgtgtgggatcggaattgcctgtgtgcatgctcgtatactagtgatcattcacgatgactgcctgtacaggagtctcatgactgagaatgacactactgaccctgacttgggccttgctgctgctgcacccaacggtgaccggcgactt

SEQ ID NO: 600580 - DNA, 1431 bp, Homo sapiens
  misc_feature (666)..(667): n is a, c, g, or t
taatcttctgcgatcggagtgtgtcgtccatcagcgtgatcaacccgaaatataatgtgggggcgggggagaaagcttgatatactagccgggcttctttcttcatcttttggggggagaaaacaccatctgcttggaatgagaagaagtgtgtcacccaaaaaaaggggggggcgtcttctgtttagtgaaatattgttgggatgagacgttcggcttttttttaggacgaacaggaagcattttgggttttcaaacaccaacacccgtgagagtgccgcacaagatttttgtctacaaacaagcgcggggagattgtgtgccgacaaaagaggtttttcggcgcccctccttttggagcctttaattgtggccccaaccctccaccacagaagaaagggggggtggttctggaggggatcacaaaaggagtgtcaacactacttgcctcgtggtggtccacaacacaaacaaagggggcgcctacgaacgacactttcatactcgtgataaaacgactcttctggggcggagaaatttgcggtgtttggtgtgttctcctctgacaacagtgtggtccctgtgttgtagagggaaaaagatttttgtgcttggtagacaccgtggtgtagtaccctcctccctactatatattctacacaaatnnttttgaagaggagcccaccaacagtagaagtattgctactactagttgacacaacaacaccggttgtgctgttgacaacattagagcacagcgcctcgggtggccaccgagaaatctccctgtatacaccacgcgttttgtagatgtgtgcgcgttggttagagatgttcccccacacatttgtcgtgtatatggtggggagacaccacatagtatatggtagacacaacacattcttagtgagcgtgtgtctttggacccctctgagttttttgtggcgggagagcactgtgcgtgtgttggtgtgctcccctctggtgtgagaagagagcgtatataaagtgtgtatagaaattataccgcacaggtgtctcttttgagagacacgcgtgtgtgcgctccggcacacaccacattgtgcgccacagggcacagtggcgcacaggagaatatatatagcgcacacatctccacccgcgcgcacatgcctgctgtgtctggcgttctcacacacacatgctgtcgggcgacatctttatatatctttgaggtattcacactccacgcactgagtcgcaagaatgcggtgaaagaaaggtgagatcacaaagttggcaaaggttctgaaacctttgaacacatgggtggctatatgctaacttgccactgaacttcacctgagaggctgtcaattgctgccttgccccacccataggcccctgtccatacccatgtaaggtgttccaataaagaacatgaaccca

SEQ ID NO: 600581 - DNA, 964 bp, Homo sapiens
tttggtgatacaagtgcttgttgcgcctctatctcccgcatgtttgcagccggttgttctggtttcctgttggcgcgtcaaacctttggtgctccgcccatgattggtcttcgtgcaggccttgtttgttgtgaccacgatgtggtgctgtcatactaccggtgtttcccagccgtatgcctccgggccgcggtcgaggtgtcctgtggttgacgcccccccgggttttcatgttgtggctgcgcttttagccataccaatattgcgggtgggccccaaccccagaggcggtcctgcctgtgtgcccccgtgtaacaataccccccaagtggttggttctttatacaacggctccggagattaccaaaattctctctgttccagctacataactcttgcacacccccccaatttgtaaagtcacctgcgtcacccttcatgaaacgccccctcgtggtcatctttaaataaaaaagtatgtccccccgtcacacacaccgggtcttttcagggaaaaatcttctccctccttcttggcctccttccattaggatttcaattctttgcagcccccgcggcccatgaatttttgtttcaattgcacacacccctttaatccatcacgcatacacatacgagaagtcttcctttaaaaatagatccctcctaatttgttctcccataattatttttccttcttgcatccagaagaacagctgtactcatttcgaactcttgtttactgccataccccccctaattatgctgacagcgtgtaggccaccataacaatcatataacccgatcaagccttcttataaatgaaccaattcgtgtcggggtctctcctcaccaacccaccaaagttgcatttcacggcgaatacacggcccactgttggtgttcccccaaacaaaaaaaaggtttttccccccacaataacgaaaatcacggaacatataaa

SEQ ID NO: 600582 - DNA, 681 bp, Homo sapiens
  misc_feature (493)..(493): n is a, c, g, or t
  misc_feature (538)..(538): n is a, c, g, or t
  misc_feature (681)..(681): n is a, c, g, or t
tgggttgagcacaggtactttattgatggtacttgacaaggtgcggctccctaggcccctcccctcttcaaggggtctacttggcaacggtgaggaggggaaattcaggtggtgggtgggggacgtgagtgtggtggcagggactctccccagcagttgagggctcttcctcttcttctccctctttgtgtgcctctttgcgtgggcgcgtggtgtggtctccaggggtctctatactctccttttggaggccatgtgtgtggcgccatgtggaggtctcccacccacccgtgtgtgtggcgtggtagcccaaaattctcggtgtgtctcattcaccaggaaaatgtgaagctttgaacaaaagtgtggctcgttgtgaagggacaatgtcgccagccccacaggcgtctcaagagggtgtgagagagtgtggcgtgtgtctccgcgtgtgtgtgaacagtctctagagagggagacacccaccgtggtgtgncctcagtgtgtgtagcccccgaggagtagtcgcccttgtggaggngggcgccctctctcgagacgccctgtgttgtctcacaccacaccttctcgtgtgagagtgtctatcatatatatgtgggccagagggttcttctctaagacacgggcgagcgctccgagtgctccccaccccatgtgcaccan

SEQ ID NO: 600583 - DNA, 252 bp, Homo sapiens
attcgcggccgcgtcgacttgaaatacgactcacacaccccacaccagacactccacacaatccacataccacacactccacgcgcacaccacacactacacacaccacacacactccacacaccatagactccacacagtccacaactccacacacaccaatcacacactccacacacaccacacatcacacactccacacacaccggatactccacacacaccgtcgacgcggccgcgaatttagtagta

SEQ ID NO: 600584 - DNA, 153 bp, Homo sapiens
agtagtccggctagacgccgacaatgacatggcaacgattgagaactgaccaaggtctacaagtcccggaaggattggccgtatcctggccgttgaccgcctgtggctgggtgtgcgtcctggcgagatgcttcgaggctcctggagcgtcaa

SEQ ID NO: 600585 - DNA, 102 bp, Homo sapiens
cacccggtacggttatctggagcacaatttctttgcacggcagcagaatcagaagccagacttggccatattaacctcgaaactcggtttcccggccgccat

SEQ ID NO: 600586 - DNA, 201 bp, Homo sapiens
  misc_feature (24)..(24): n is a, c, g, or t
  misc_feature (44)..(44): n is a, c, g, or t
  misc_feature (69)..(69): n is a, c, g, or t
  misc_feature (77)..(77): n is a, c, g, or t
  misc_feature (90)..(90): n is a, c, g, or t
  misc_feature (92)..(92): n is a, c, g, or t
  misc_feature (109)..(109): n is a, c, g, or t
  misc_feature (114)..(114): n is a, c, g, or t
  misc_feature (126)..(126): n is a, c, g, or t
  misc_feature (134)..(134): n is a, c, g, or t
  misc_feature (137)..(137): n is a, c, g, or t
  misc_feature (144)..(145): n is a, c, g, or t
  misc_feature (160)..(160): n is a, c, g, or t
  misc_feature (181)..(181): n is a, c, g, or t
  misc_feature (187)..(187): n is a, c, g, or t
gctggagcgattcggtggcacgcngagccacggcgtgggagtanggggctgaaggcaggcagcagccgncagggcgncctctggtagccntncggtctccgggtacccngtttnttcctcgtaggntgtccggncgngtgtccnngcgagataggacatnccccgctatccggattccggngtccgnatcccgtcgatccc

SEQ ID NO: 600587 - DNA, 769 bp, Homo sapiens
agcggagcgcgagccccggagcccttgagcgcgaggcgcggagcccccggtagcccccaaaccgcatacacatccacgcgccccagaagccccggactgcgcgcccagccgggcccgcgcgatgccctcagaccggtcgctttcaagtcagcgagacgtgatgcttcagcgcgtacctgctgtaagggaggtactagtcagtatcctgcgtaccgagcaccccagcaaaatcccggtgatcatcgagcgctacaagggtgagaagcagctgcccgtcctggacaagaccacgtttttggtcccggaccatgtcaacatgagcgagttgtgtcaagatcatccggcgccgcctgcagctgaaccccacgcaggccttcttcctgctggtgaaccagcacagcatggtgagtgtgtccacgcccatcgcggacatctatcgagcaggatgaaagtactgatgactggcttcctctatatggtctacgcctccctaggtaaaccttcggcttctgagccagcagtcatgggggctcggcctgggagtcggggggccccggtcaggccctgcccagagatgctcctggttcctgaactgagctgcctctaccgtggtgggctgggcaggcatgttgcccccctaggtcagagggtccccaatccatctactctgcccatgggtggatcctgggccggtcgtgtccgggtttgtccctctgggtgctggctggtggggatggcggaggggtgggggagcagctcgccgaaccct

SEQ ID NO: 600588 - DNA, 724 bp, Homo sapiens
  misc_feature (539)..(539): n is a, c, g, or t
  misc_feature (637)..(637): n is a, c, g, or t
  misc_feature (686)..(686): n is a, c, g, or t
  misc_feature (708)..(708): n is a, c, g, or t
tgagacagtgtctccctctgtcgcccaggctggagtgcagtggcgccatcttggctcactgcaacctctgctttcccaactcggatgattctcttgcctcagccttccaagtacattatgctaacttttaaaacatagatattagctattccttaaagtataaaggaactttaactttaaaaccatagtgcaattttaatgataataacaatcatcctattttcttctaccatctattcatgcttctaaatctttgtgacctaatttttgagaatcagcatttgtcagaaaatccgtgtcctagactaaaagttatatttttaagtttatacataatattttccatagcttttctaatagcaagtataatggctatgtccctctgtgttttctaatattgtatattttcattgtacctcatttagaattaatagtggttaattactttattgatcttttcaataaacaagctttttcttttttctcatttgtttcttttttatatttaatttttcctttgttccattctactttttccngattttccaatgttataatttttcacatgatttcaagagcacatttcaaaacagaaatcacttaaggagtataaatttttcctacagaataatgaggnaaattttgaggtaaaacaattgatctatataatataatttaagtttggnggaaatcatcaagggttatcanaagaggattggggact

SEQ ID NO: 600589 - DNA, 108 bp, Homo sapiens
  misc_feature (102)..(102): n is a, c, g, or t
tggccggtccctgttgagcagtattgtgctattgcatactagtctttgccgctgcgacacacggtgggctagccctactagtctcaatctccaacacatatngcctag

SEQ ID NO: 600590 - DNA, 204 bp, Homo sapiens
aggagatcagaccatcctatcctggctaatacagtgaaaccctgtctttaaaaaattagccgggcgtggtggctggcgcctgtagtcccagctactcgggaggctgaggcaggagaatggcctgaacccaggaggcagagcttgcagtgagctgagatcgcgccactggactccagcctgggcgacagagcgagactctgtctc

SEQ ID NO: 600591 - DNA, 184 bp, Homo sapiens
  misc_feature (56)..(56): n is a, c, g, or t
  misc_feature (59)..(59): n is a, c, g, or t
  misc_feature (63)..(63): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (152)..(152): n is a, c, g, or t
  misc_feature (155)..(155): n is a, c, g, or t
  misc_feature (162)..(162): n is a, c, g, or t
  misc_feature (175)..(175): n is a, c, g, or t
aaaggaggctttttggaaaggggtcccccaggttttttggtgttcctgcttggggntcnctgntgctaactgactggcccccccccttggaagtttgtgattttgctttggcaaagtttcattgactagtanaacncnttttgttttagggnatntttcaanataaatgtaaacnttttgccca

SEQ ID NO: 600592 - DNA, 248 bp, Homo sapiens
agatcccggccgcctgggctccaggagccccggaaccaggataagttggatggctgccgcggcgaatcggagggcggggtggaccgagcccggtatttactatacgggtattgtggcccgggagaagccctccatgaggaaaggtgattgcctttatttgcaactctcgtttttttctagtttgctatctagtacaagttctagctgcaaatttttttatgatcctttgatggtgctttttcttgagc

SEQ ID NO: 600593 - DNA, 136 bp, Homo sapiens
ctgactagaggatcccgtggacatttccacgagtcaccactttatgaatcttgtatgccatatgcctggcatatggcatacagattcataaagtgggagaagagtagtaaaaggtcagtatgggtggagcagagtg

SEQ ID NO: 600594 - DNA, 108 bp, Homo sapiens
tatcgcatcactcagcactccacggaccctccctgaccctctgtgagcagacaccacaggtaagcaggggcaaaactgaccctcacgcattgtgcgctccaggaactg

SEQ ID NO: 600595 - DNA, 311 bp, Homo sapiens
caaactctattacttcatagaattccatcttccagaccggtcccacttaattgaatacttagaaaaaaatggccagtggccgattgaaaggtatattaaaattaagggcagttataatactagaagacaaatatcttcatggaaatctatttgtaagcttctgagattgctgctagaaagtctacagtctgtagaatataccaattcccctatatacaactgcaatgcagatcatatatgaaatactggcaaggctataccctaacacattaggcaattggtagtaggctgccaactgctaatcgctctca

SEQ ID NO: 600596 - DNA, 329 bp, Homo sapiens
ccagcttgaacgaacagtgagcatgtgctgaagatactaggggagaggatctggtgaaaaaaataccaaatttaaattatatgttttgtgttcgttccatttaaatggaacgaacaccggatgaactgaaggcctaaggcaaaaaagccgcggatgacgcggctttttgctgtcttgtgattagctttttctcagcgatggtataaataaatctgtccgtttgtgctgtcttttggtgttgtttcaacaggaatatttcgtgggttggagccacgcggtactaagctgttcgttccatttcgaaatggaacgaacatgagggtgttttc

SEQ ID NO: 600597 - DNA, 128 bp, Homo sapiens
tgtacttgaggatccctcggggccttacctgttcatcttctgggggcccgagcaagatgcagaagcccaggcagcctcgtgcgtgtgatccagcgagctgggctggtgttccccaacatggaagcata

SEQ ID NO: 600598 - DNA, 937 bp, Homo sapiens
ggagtatacaagggagagatgtctcgcgtccgtgggcttagctgtgctcgcgctcactctcgtctgtctactggactgaaatgctatccaaatgtactccatagattcaggtatacgtcacgtgattcatgaaagaatggaaggtcagaattatcgctgaaataagctatgtgtctgggtatcatccgtccgagattgaagttgaattactgaagaagtggaggacgagaactgtgaagaaagtggcaggcattgagatttgtcttgtcagccaagggcactggtctatgtggcatactatgctatgtgagctaaacattgaaatggcagtcaccaccgtgagatgagatgagtgcaatctatggcctgggcgtgctgagatcatggtggacgtggtgatgcgacgagcccacagagattagttaagttgggatcagatgactagtggtagcgcaagcaatcattgggacggtttagaaaggagttgccagcgaatggggatttgggagagaattgtctgaagacttcatgtcatgaatgtctattggaagtagtaagatattaccttagtaaaactgaggaaatttctaatgtgttaaaggatgctaagagggttaatatagataattctgtaatgatgagattctgagtcgtctagttatataatctactaacttatcgagtgctggtctacctctgtgagtactgtttcctgagacagagttgctccgcgcttgtaggttctaatcgaggaggtgggaccgttgcaaagcaggccgaggggaaaatgcccgaagttcaccatggaacgttgtatgggcacgagacggagctcctgtaatctatatgccatgtttcttcaggccaacacttgggatgacgatagatttcagcacacatgacgggtttgacatcacgtggtttaagagtgaggcga

SEQ ID NO: 600599 - DNA, 716 bp, Homo sapiens
  misc_feature (276)..(276): n is a, c, g, or t
  misc_feature (332)..(332): n is a, c, g, or t
  misc_feature (386)..(386): n is a, c, g, or t
  misc_feature (549)..(549): n is a, c, g, or t
tggctctaaagggggtaaagggggtgctatagggtaaatacgggccctatttacaaagattttaagggagaattaatttctaggacgatgggcttgaaactggtggtgtttggcctccacagatttcaagagctattgaccggtatgtatacccccgggtctgtgtagcgggtagaaatgtggtgtttggtgttataagactgtccgggagaattggctatctgtgttttataacgctctaatggtggggagacaggctcatgagatgtgcgccanaagacgtgttctgtggtgagatgtgtgatattttatctatatccacgacaaatggnggggcgtcttccacactcggggagatgtcacctacacctccgtatgtgggtgcnacacgtgctcaagggatgtcccgccagtgtccgccttgggtctctaagggattatcaatgcgggggagaatgtttatgtgtagagcgatgtttgagaaatattaatgtccgcggcgcgtaatgtcgcgcgtgtgtacctcgcgtaaaggtgttcacaggtaancactttgtggtgtgtgcgcgcacatttggtatcttgagagtggcgtaaagggagagggggatactgtgtgggacccttccgtttcttgtgtgttatgtgtgtaaaagggatgcgcggtaagggggacttgggagaaggggccagaatagagggacctcagcgactgc

SEQ ID NO: 600600 - DNA, 479 bp, Homo sapiens
  misc_feature (147)..(147): n is a, c, g, or t
  misc_feature (224)..(224): n is a, c, g, or t
  misc_feature (237)..(237): n is a, c, g, or t
  misc_feature (240)..(240): n is a, c, g, or t
  misc_feature (255)..(255): n is a, c, g, or t
  misc_feature (266)..(266): n is a, c, g, or t
  misc_feature (270)..(271): n is a, c, g, or t
  misc_feature (286)..(286): n is a, c, g, or t
  misc_feature (293)..(293): n is a, c, g, or t
  misc_feature (296)..(296): n is a, c, g, or t
  misc_feature (304)..(304): n is a, c, g, or t
gaatttaagggttttaaatatagcattcagatagtaattggtatgttttgccatctggtccactcaatgtatatttttatttgcaaaacaacccaaaacttactttacgttgcttgttcagtacctttgaattcccccagaagagtngttttcaaaacaaacattccagaatgaatgtcgctcttcaatggaacgtctttatgtgcttgaagtatttcttctcnggtgtaattctanatnacagagtcatttganctttctccccncccnntagtatctttacagnagcaggnaanagcagtanaggatgtataattttgggtaaagttaaattacaattaatttgaggttattcctaaacatacttatttggtgttttgaagaagatcactctctaagagatcgtagatagcctcggttattgttctggctgggctctttggtcacttttccacgcatgttaataaatgtcactgatt

SEQ ID NO: 600601 - DNA, 109 bp, Homo sapiens
gcggccgcctactactactgctcgaattcaagcttctaacgatgtacgggtacatgtaataaaggtgtttattgttttgttcccacatttatgttgcctgaacaaaaaa

SEQ ID NO: 600602 - DNA, 270 bp, Homo sapiens
gggagggcccgggccgcgtgctcatggcatttcagccatgcttcagcttttcccaaaacccgtttttaacacatcatcgaatgtgtgtcagttctccactttccttcacccacgaggggttatgaggatgcctttgatttctgtatacagatttgctagccagaagcattttttcttagaagggcataacttgaaaatgtgcacaggtgcctaaatccttatctcacaaactttatagcaaagaaagtgtagttttcacatctccatgtt

SEQ ID NO: 600603 - DNA, 1281 bp, Homo sapiens
agtgagctcctccgacagcgaggcccccgaggccaacccctgccgacggcagtgactgctgactgaggacgatgatgtgacctgggggtgtcatgtgcctgtcacatgctgtgtaacctgccacatgctgccatgctgacatgtgatggatgacgctgactcatgactcagtacaatgatgtagctgacaacatgtgtgccttgaagaagtgaatgactgccatgcttgctaaatgactgtctgtgtctctgataactgatgccctgaaatggcctccatgctgagccttgtgactcatgtgccatgctgttggtccccatcctgacagatggatgaagcatctgtgaaaatgctacatcttgacgtctggatgaagaccaagctgaaccagtgactatcaacaccttgatgaacgacaatgcaagctgtgtcctggtgctgcccactgggagtggtggcccctcttggagtgtgggactgtggaaccaaacaaatgatatgtggctgcctgatcatgcactcccgaaccatctctgcatctcccaaatggtgccctgatatcctgtgacctgtgagagaccaaatgccattgaatgacctgtgttgtgcccacatagtgctggctggggtcgagtagattccattcgcatcggctatcgctacattatcacatacccgtatccatacgcttcacgaagctacactgaaagtgagtggtacttggttcgagagggagaatgcacagtaccagaaagtgggtggcatagtgaaatgacccaaagagatgggaagagaacacgacccatacatacgctcctagaaaaacgcccatggccggaagggggtggccggagaaaaaacgcgagagagagggcccattgacaacatggggcccaatcacaggatgcaacaggggcgttccaatgagcaaggatttgagccaatggttgcaccaagggtcagtcaagcactcaatggggtattgtgggaacagccggagcatattccaagggtggaatgcaggggagaaggagccgtggtggcagtgtgtagaaactggaaaggtgactgtgcggtgaaaggtgggctgtacgagatgggcagtgggggattgtgtgacccatggtgtaagggtgatgtagtatgaaagtagtgtctatggtgaaatggttagttataaatgcaatatgatagtgtacgtagaccttttgacagtgagtaatggcaaagagagaagtagaaattgtgaaaggtgaatgtgattgtgagcgtattaaaaa

SEQ ID NO: 600604 - DNA, 603 bp, Homo sapiens
aagagaaccggaccagatgctggcagggaaactgtgttgctttgctgcaagatgtacagaaccaaagtgggcttgaaggaccgccagcagctctacaagctgatcattatccagctgctatatgacgggtacatcagcatcggcaatggcctcatgaatgaaatcaagcctcagtatgtgtgtgcaccctcggagcagctcctgcatctcatcaaactcggtagattgtgaacacaaatccatacgtcccatggcagggaatggaaaacgatgacaccagagtgcagtatgcaatcgggcgatcagatactgttgccccttgcacagggatcgacctggaattagatgcatatgttcagactatgtgcgcagaagcttctgagtacgaaacatgctatgtcacatgacatataggaccatgacgcgtaactacctatagtagagatggacagtcaatagctaccgggcctgctggtgcttcgataaaaaactcgacaccacaagatgtcgtgcaaaatggccatgccatgtcatgatgaatgagacccacaacaaatatggttccaacaacaaacaaaccctgatttgggtaaagggattcct

SEQ ID NO: 600605 - DNA, 261 bp, Homo sapiens
tagggaaaaggagtttttggttttagggttttttttttattttatggtaaggaaaaatagatatttagatataatttgttaaaaaaatgagtttttattaagaatgaaataaaaattatatttaacttctataatatatttattcaaataagttgaataatatgtttagaaaattaaagttttaaataatggtttatatatagataatgataaatttaatatatgaatttaatttaaaaaaaattttattttgaaataatt

SEQ ID NO: 600606 - DNA, 415 bp, Homo sapiens
  misc_feature (6)..(6): n is a, c, g, or t
  misc_feature (33)..(33): n is a, c, g, or t
  misc_feature (44)..(44): n is a, c, g, or t
  misc_feature (155)..(155): n is a, c, g, or t
  misc_feature (226)..(226): n is a, c, g, or t
ccttantatatatgaaatgaattattaaaattnaagtaaaaatncattttttacccccaattatttcaaattccagggtcctcccagtggctgccagccctatccccagaagcctcagggtgcaaggcaagaagtaatccgtgggacccaggcgnccgtgtctcgccctgtaatcccagcactttgggaggcagaggtctggtgaatcacttgaggtcaggggttnccagactagcctggccaacatgatgaaacctcgtctccactaaaaatacaaatattaattggatgtagtggtacatgcctgtaatcccagctactcgggaggctgaagcttgaacccggaggcagcggttgcagtgagctgagttcgtgatactgcacttccaccctgggtgagggagtgagacttcta

SEQ ID NO: 600607 - DNA, 176 bp, Homo sapiens
  misc_feature (8)..(8): n is a, c, g, or t
  misc_feature (53)..(53): n is a, c, g, or t
tgaatgtntctcctgagacaagcatcgtgatagagttcacagtcttaaaagtntgcattttcaggtggggcaaggtggctcatgcctttaatcccagcattttgggaggctaaggcagggagatggcttgagaccaggagttcaagaccagcctgggcaacatagtgagacgcccc

SEQ ID NO: 600608 - DNA, 189 bp, Homo sapiens
atcagccagacgggcattcttggtaccactgcaccaccatgcccatggcaaaaatggcgttataggaaacttctggatcagcatcactgagagaatttgcttagggtatccaggctgttgagtcgtggatttgaaacagagatgagggccagtgatacaaggtacagccctccggagtgtaggctcccc

SEQ ID NO: 600609 - DNA, 380 bp, Homo sapiens
gggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaggtgcggagagacacgccctggtggcggctctcaaggctaagcgttgtactcagccccgcgtggaactcgtgtctggcacagccatgactgtggcctaacctgacgagagtacatcagcctgcatcctacccactgtgccttgtcacgccagacttgccacggttgctagagagcccaacactgtcagcatttgccttgcttcctctactgtatacctgcta

SEQ ID NO: 600610 - DNA, 212 bp, Homo sapiens
tcatgagcacggccgcgatgagtcccccagacgaggagcaaaccgtcctacatccgccggtgcagttgcggatcagcgggatgacctgcgctgcgtgcgccacaacgatcgagaaaaggctgtcccgcattgacggggtgcacgcgagtgtcaatttcgcctctgagcgggcgacggtaactggcatgggcgtcaaggatgcgatagccgct

SEQ ID NO: 600611 - DNA, 178 bp, Homo sapiens
agagcgaaactcagtctcaaaaaaaaaaaaaaaaaaaaaaaaaattttaagtttcccaattggaagtttttgtgccttgggatttttaattgggtttccgggccaataatttttcaaggttcaaaaggggaatatattgttgtccagtgtcctgattgtgtccccctccaaattccat

SEQ ID NO: 600612 - DNA, 1609 bp, Homo sapiens
  misc_feature (644)..(644): n is a, c, g, or t
tcctcctttaaacttttttaagtggggcctcaaaatctctggtgacaaatttggggccaagtggttccctataaaaaagttccgtgattttaaaaacctaattaactttaaaacgtgccacacgcaaaaaaaaaaaaccaaggtgggctccacaaaaacattctcctcctttctcctctcgtgaggggtttacgagtgcatgtgtgttatctcatttacccagtctcttttatacttcacttaacactttagagagtggcccattgtgtgcacacacaacacgagtttctctgtggagacaccgtgtctcctctcccaccacactgtgagatttagagagagtgtgggggtgtggacacgagacacagcggtgttttacacagaagtcgcgtgtgtggttcactctatttcaccccgagtctctcgtgcgcgtctccccaggctgtgtctctcgcgagacacgcgagagcctctcgggggtgtgtgatatgtgggggaccgggagagagacacacgccggtctctcgcgggagtgcccccgcgaaatcagagcgggggccgcgccccccaaacgagaacacccccgcggggtcgtgtggcagtggtagaggggctctcctccctgtgtgatctctgtagagaangtgtgggctataccctctctctcagatatttgtgacgcccagtgtgtgcgctgttgaaatttggcgcgtgctcgggtgtcgcctatgtgtgggagacccacggtgtttccaaggggcgccccgtgtgatctccccccaacgatgtgggggcccccctgtgtgtgtggtgggccccctctcgagagaagtgtggttgcagaagtctcctccatttgtggtgagcggagcgtgctgtgtgtgcgcagggagggcctttctcacacatttcgagccaccagtttctcgcgaggagggggtgggctaaacccggtggagcgcgacacgtggaaagcggcctattggagaggctttccccaatgtgttttgttcccggcgactagaaagagacactgtttttgttcgcccacatcttccccgacaatttagccccggcggaagacacactccaggggtgtaccccccgtgtggtgtgttttgactcctttgttcgtgacccagggaccccttaggggccctttcttgggggacaggggcaaccccccccaccagggccttgccccagcccgaaaaacgcgaccaaggagggatctatggagtccccccagattacataaaagggccataaaaatacccttactagcacaagttggctagcgtcacccgaaaatttagtaccccaagaaacacttctggggcgacacagtgggttgaatgacgaaccacacaagggagacaaataagatcgagcaaaaaaatatggccacaaatgggcacacgccgggtggtgtacaactggcaccgaccaccaagactatgtgtgagccacaaatcacactgtgagtaggcaatgcgtcattagtagcgaaaaagtgaagcaccccctggaacaatagcacacgaagatcatagtgtcgtaacacaaacataatagtagtgacacaccacgcagcgaagtaataacagat

SEQ ID NO: 600613 - DNA, 540 bp, Homo sapiens
acatctcaaaaacaaaatgaaacacaaagtttctcttattctggtgattttctttcattacttgtcttgcttcccttttccatatttgtattttccagatgtggggttattaccttagcagcgttttatataatttaaacttactggattcaacattataaagtgtgaagatggctaagtcatgatggccatattttgtacaaaatgctatttatatgtgaaaatgttggttttacttgacgcttattattgggtattataatttttatgtcaaagttcaggtaataaattgtgtcttactttgatttgcatttttaaattaatgagattgacatatttggatgtcgtatgttaatttgtttcctaccttttaataatttatccattttgattatttgtatgaatttcttgggtaataatgtatcttttccatatttatcgcatgtatttttttcccattctttgctgttgtttctgttttttggagcaagggacatcgatatttcttaacttttaagtggtgggaacatcaaagaaagg

SEQ ID NO: 600614 - DNA, 554 bp, Homo sapiens
gatgacatgatagatcgagctcggtaccgaattccgcggaaaagatctgggtgctgttcatggaactgatctggtgtacagctgggtgggagatcctggaaccggctctcgagtcacaggagtgctccagctgtgcgccatccctggttctggggaaggtgaggctcagctcacggagcagagctccctgcctcccggagctcctgttcccatcccgctagcaaatgcttcttggcatttctctccctttgtttttttttggtagaccaaagtgaaggagttgggaatggaccctcaaaacatgtgcgagttcggggatgtaagtacaagcacttctgcacggggtgaataaagtgtccttggccaagacatggttgttgagaggcccatgaggtcaggtcagtgtttatggagtaccttgtggaatacctagctgggggaacggtagagaggccctcagagaggcttggagggcaagagcaacccaggcaggatgagggctccatttccacctgagggcgggctgagctttgcagggccacatgacactcccc

SEQ ID NO: 600615 - DNA, 404 bp, Homo sapiens
  misc_feature (388)..(388): n is a, c, g, or t
gcaaaaaatgtgtccttgaatcgagcgagggtcaccttatgtccaccaaggatgctcgagaaggtccccaagcagcaaacttcagtcccactatttcaaactatttattctccagacggagctggttcatcatgttctcagctctcctggctgccgtgtacgtgtgcagtcactccaagtaacgtacccttttatttgaatgtatttttaaagcagtaggtaggacggcaaaggagggtgaccaccttggcgtggatggaccgtgtcacatgttcagaggggcctcctgtccgcactggaaacaccagtgtgagaaccggcacttcagaggtcgtgatagtgtagttagcaaaccggtggtcaacattgagccacacttcctaaaagnctgttgtaatgcatca

SEQ ID NO: 600616 - DNA, 385 bp, Homo sapiens
  misc_feature (12)..(12): n is a, c, g, or t
aagatcccccgnattctcaacgggtgctatatcacggcaaggtgaaattggctttccgaaagcggcgatagttatgaaggcgagttttcctatggcaggaaacacggtggcgggcacattcgtttacaaggaacccattgatggtgtcagtaaaattacggggcgttgggaatatgatcgcctcgtggatagcggtagcgacgtaaaaatctattcacccgaagaggtcgccgaatatgccctctacaaagaatccgatgagctaacacgcgcattggatgtggtacaacagtcagatgcaaagcagatcgaactatacagcctggttgttgcaggttacggcactgaagaagtattccgccgggaaagcaaattcatcgaaaac

SEQ ID NO: 600617 - DNA, 378 bp, Homo sapiens
cgggtggtgggggctccccgcccccccacccccccccccccccgtattagggcccccggggttttttgcccggggggggtttcccctggggggaccccggttaaaaaaaacccccccccgggttttgggcccccccctggggggccccccccaggggggcaaaggccccccccctttggggcccgtttggatttagttaatttgggggaaggggggccccctttttgggggcccccccccgggggttttttcggggccctttttcccccccccggggggggcccatttttttttttttttttttggccctttttttttttttgggcctgttttgggtttttttttaaaaaaaaaaaattccctttttccccccgggga

SEQ ID NO: 600618 - DNA, 424 bp, Homo sapiens
  misc_feature (424)..(424): n is a, c, g, or t
aaatggaatcttctctgtcatataacatgctttgttcatatttagttgtttaaatattatctctgctacccttctgttactaaaactcttcaacatcttaggtttttgttttgttttgagacaggctctcgctttgtcacccagcctgctgtgcagtggcgtgatctcagctcactgcattttcctcccctaccaggctcaggtgatccttccacctcagcctcccaagtagctggaactagggtgcacaccaccatgcccagctaatttttgtgtagtagagatgggctttctctgtgttgcccaagctggtcttaaatgcctggcctcaagcagtcctcctgccttggcctcccaaagtgccgggattacaagcatgagccattgtgtctggcccatctttgttcttcattgtattctttan

SEQ ID NO: 600619 - DNA, 167 bp, Homo sapiens
cactaagccgagacaaagcttaagtgactattcctctatattcctctcacatgtaaattgtgtattcagtgaaaggctaatcagagactctaaacagaatgcaacccttttgtgctcttatatatcctattaccatggtaagccgcccgtccccgtgggctgttgct

SEQ ID NO: 600620 - DNA, 541 bp, Homo sapiens
ccgtcctgaactcagtgactctttgcacatggactgttatatattcttaataatcctgtttccacttctccattctctagtggacgtagcagttttgtcgatatagttccatgtatccccatgttgtgcacattcaggatgcgacacgtctctgcccccattcccttgagatggggctgtatttagtactcacctttggcctggatctagattagagctcataccattttacattctctgtttgaatttttccaaagcagaactcactttgacccctattaagaggcaagcgctggcacatctattccctgggcctttagaaagccatgttgcctcaaatggctatagggcttgtggggtggagggaggaagggctcgtggaggcagcggggaggaattgctagctgtagtgtgacacattgtagtgtttgccaggaaaggagccagtcatgccggaaacactgacttctgggaagccacccaggtctcattcctcctgctgttggaggcaacatctataatctcgtaggagaggtacatt

SEQ ID NO: 600621 - DNA, 202 bp, Homo sapiens
ctatagcatggatgctatcaaggactgtggcccgttcagatgacgactacccctccagctcgttctcccaacttgccatcatatgaattatatgccaggtgagatattagaaaggcaggttgttggatgtgagtgctagaccttagagaaacctcttggaagacgttcttctcgaatggactatatcacctgaagtagagtg

SEQ ID NO: 600622 - DNA, 412 bp, Homo sapiens
ctattttagtctcaaaggaaaccatgtaaattcatcaagagaggtgaagattggatttgtctaaatggaggcactactaaaagtaacagctctgttaggggagtgctgacggaatctcacggggttttcccagaatgggatggagttgaagagagaagaggcaatgaaagaatagaaacaagactagagaccaacaatttccagacattttgctctaaatagggcactagagaagtggggtggtatatggggttaagagaggattctgtgatagatgatgataaagttctttgtgattattattcatgttggaatgatcttgtatttaacagggaaatgttgccgaagaaagaacagattaaccacagcaaacccttggaccagaagtagactccacagatcacccttcgtg

SEQ ID NO: 600623 - DNA, 735 bp, Homo sapiens
agcgggatgggggagttcctccttgctctcgcccctactctttctggtgttagatcgagcaaccctctaaaagcagtttagagtggtaaaaaaaaaaaaaaacacaccaaacgctcgcagccacaaaagggatgaaatttcttctggacattcctcctgcttctcccgtttactgatcgtctgctccctagagtccttcgtgaagctttttattcctaagaggagaaaatcagtcaccggcgaaatcgtgctgattaccggagcctgggcattggcacacttgggcagactgacctgcctatgaattggctaaaccttaaaagcaagcctggtcctctgggatactacaatacagcattggcactggcaggacaacagcctgccaaaatgcaagggactgggtgccaaggttcataccttgcgtggtacgactgcagcaaccgagacagatttttcacagctctgccaagaaggtgacggccagaaattgggaccatgtcagctatttaagtacaatacatgcgtggatgtcgtctactaccttcagcatcgcgctctcgctaccacaagaatcctcaagcattcgaaaagacttttcgacgttacatgtacttgcaccatttctggactaccaaaggcatttcttctcctgcacatgaccgaacgaataacccatggccataatggtacacctgtgcgtctcacggacagctggacactgtctcgggacccctc

SEQ ID NO: 600624 - DNA, 715 bp, Homo sapiens
cagtagcgaattacaccaaaatgatttactttgagattcgaataattcgcatagcagtaaaatgtgttttgtgtaacatacgacatagaaaaatgacccacgtagtcttaacttagatacttatctggcagagtatcagacattacccagcaggctcttacagaatgccataaattctttagagactaaatgattcgaagatcagattcattatgagccgtactgtttgctagatttacttgttaaaaagcttgctgaggctcagtttttaggagatatcatttatgcctgcctgttcccttatgacagtgaggccttctttgtggctccacctagtatgataactcatgggattcgtgtttacggttagatgagaagtggctcctatgaatgcctctgctcaattcttttatttactttatttatcgaaggggtctcgccaactcctgggctcgagtgatttctcctgcttccacctgccccacagtgctggggattacaggcattgagccaacacgcctggtcgtctctgttctttgcagtgtctccgtgccatcagtcagcagtgcttacattgtttagcatattgtcatgcagtttctcttctgtgcccacgagatatttttggaccataaattgacaaaagtacatgtgtttgtcccaacctatccttagaaaacctaatgtgtactggtatttttaaacaccaaaaaga

SEQ ID NO: 600625 - DNA, 373 bp, Homo sapiens
tggggcccccagtgtgaccggcaaaattggccctgacatccaggacaacaaatgcagttggttggtggttcagtgtttgcaacgggccactccagaccagtcccagatcctgaaggaaaattacgggcagaaggaggtttaaaaagtggcccgggtgaaggcgctatataaggagttggatctgccaccagtgttttttcaatatgaggaagccagttccagccccatttttgttttcattgaacagtacgcagcccccctgcccccacccgtttttttggggcttgggggcaaattttccaagcggagaaagtgccctaaagattgcaaggggggggagagggggttttcaataaataatcgtgtaccctta

SEQ ID NO: 600626 - DNA, 672 bp, Homo sapiens
  misc_feature (344)..(344): n is a, c, g, or t
tgctgtaacagtgtttattgatgatgagtccaggctcctgctgaacccctgtgtggggaggggcacaaagcgaaatggggcgtaatggaatgcttgaagtgctgctctccgtgatgtcggctcggagctttccaaactaggcaatgggcagggtagaggccctcgtggcacaacacgccggccgcccagtcacccggcccaaattgagagggcggcctggagccctgcacaggcacttgccaaaggtgtgggctctccacaaactctccacgcccacaacctcgttaacgtgaagacactctcaaagggccgattcttccaaaaaaacctccaaaccgaggtgncaaaattgcactttagagtgaccaaatttaaaaaatatcagaaaagggaacggagggaaaacacaaagaaactcgtgaggaaagagcttttgtgaaaactctctctctcgagaaaaaacagagggacacagacacagagaggaacagagactctcccagacaaaccaccaaaaaagaaagacacctagacagagagattattgaaaacaacaaagacacaaaaaagacagagagacagagtgtgagtgtgggagagacaccgaggagttacaaatcccccgatgttgaggaagagaaaacctcaaaacctctgtggagaaataaatgg

SEQ ID NO: 600627 - DNA, 283 bp, Homo sapiens
tgggtttaaaaccagtcgagttaggattagcattttcagaacagccctgaatcccagcttagaaactggaatttacaaataaatagaaaattaaatcagttttttaaaccgggatttttgaaaatcccaaaccaggttaccaaatttaaggtttatacaaaaccagagaaaatttttgacttaattttaattaaacttcatgaaggattcgattgataaatgggaaggggacaaagccttttttcagccttcccaaaagccctgaaaaatgttgagggcttta

SEQ ID NO: 600628 - DNA, 426 bp, Homo sapiens
ccccccgaccccgcgcccccaccccgcccttcgactcccaagggcctgagagacactgaaacaaaatgtccatcaaccctttcactccactttctgaacttcggtgtctacacaagtccttccaccggccaaaaccaagagcaacggctccccactcccaccccaggcccctggaatgagtaagcggactctggacaggcgctataggggtagctacagggacaggcagagatgcgcaaggaccacgctgtcgggtgaaaatgcctgtccttattgctcttccaaaggaaaaaagttttgtttttttttaaatcactatagccagaataactgctgcgggcaaagcggcgacgctttagctgctataccgcttctccggtttccagcaagctaaacacagaagcggatgggaggggaaggcggccg

SEQ ID NO: 600629 - DNA, 966 bp, Homo sapiens
  misc_feature (891)..(891): n is a, c, g, or t
tgggggggggcagggtaaaggaaggagggaggcctgccgctctctctttttgcttttgggggcgaatagggggatattttaacccgggctccttgcctgttttcacagactcggagtcgggaactctgttacaaaggaaatgattgagaaaatgaattcgagtctttgaaatacaaccttacacaaaaatcactgtcttaaagcttcaagggcaggtggaaatataactatccccagttcttcttgttcaagggaattccccctcctttattgggcatcccccaacttggagaacagggtgacacctgagctcactcgggcttagggagtctaaggggggaccacaatcatcttaagcagcccttttcctaagccttgggttcaggacagttgaggagaggcccaaagattctaacttccagtttaggtggcggggagatgtttttaaaaaggcggggttcttaagcttggcgcctggaggccaaaaatcttgttagaaaacgggtttggccttttttcttgggcgagccggcccccaaaaggagagggggggatagttttctttaattttcctggaaaaaaccaagaaaggcattgccctgggaaaaaactccttttacgcagttttgttttaaagaaagggtttcaccacactgtttgtttgcgtgttaatatcccatggttgggggtagaaagaggttggtttttgtactgtgctggaaagagatacttgggggccctcgccacattgtctctgcgaatggatgcggcagagcaattgcatgtctgttacggtggggaactccgaggggtcacctagcatcgaagggcgtgtgggtgcgggttgtggtctgttggacgagggtgagaggaatagagggacgtgctccntctgatcgcacgagggtgtgtggtcgacagtatgttgagcggttgtttgtgtcgttgttggttcggatcgcgcgg

SEQ ID NO: 600630 - DNA, 918 bp, Homo sapiens
  misc_feature (111)..(111): n is a, c, g, or t
  misc_feature (165)..(165): n is a, c, g, or t
  misc_feature (176)..(176): n is a, c, g, or t
gcttcgtgacagagtaatagccatcataatcggaggcttgggaacctgtctaggtaaggaccagatctacaacgttatcgtcacagcccatgctttggtaataatcttctncatagtagatacccatcataatcggaggcttaggcaacatgactagattccccntaataatcggngcccgcgatatggcgtcgccccgagataaacgaacgtaagcttgtgactcttacctcccttctctccgtagctcctgctgcgcgatctgcttatagtggtaggtccggagcaggacacaggttggaacagctctgaccctcccttagcaggggaactgacagagatagagaaacacaaacaaaaagtaaaaagagaatataaaaaggaataaatacagaaaaaaataaaaagaagagatggtgtgcgtggtttgggtagggggataggagcatgccgacattaactgtggctactccatgcagggtattctgcaagtatggtttttatgaagtctttaaagtctggtatacgcaatatagtgggagaggagaatacttatctctgggcacatcagtatatttggttgactcttgcagttggtgaattctttgctgacattggcctggtcctatggaaagctgcctaaaggttcgaattcaaaccagacaggttatggccaacacttggagggatgcagtcccacaaggtataaggagaaggctaaaagcatactcaaaagaggtagccctctccggagaacaggtaacctacccaagaagaagatgcctggttggacgacgggaagcgggcagtggggccaaaccccgcaggaagcaaagccagcaacgtgcactgggccggcacacgggtggcgcaggcccacgcaacgggaacggcaacaaacgtggccccgccagaaaa

SEQ ID NO: 600631 - DNA, 508 bp, Homo sapiens
taagcagtgatgtccaagctgatgctcgaatattcaacattacgccccgcgcctggatattatggaaatttggagacaaccaaaaatagcagatgatgtagctacatagcctaaacattccaacacaaacaacctactttaagtagaactacttttagcccaaactccaaaagcccacaacagctcagtcttcaccacttgacttatagctctacaatgctgacagggctcacgcaagtaacagccttcatagcagggaacaaccatcgcgagaaccactcatattgtgcaccttttgataagctagcgtcccaaatactttcaagtttcccagtcttcccattcctccaccccataacgcacactacacgcgtcccacccgacatacgaacagccggcacacccacaccagatcgttcacgaccgaacaaaagacacggaccagaaacgatgcgcagacgaaaccaaggccactacacggacatgcgcaggaccagcaccaacacca

SEQ ID NO: 600632 - DNA, 1008 bp, Homo sapiens
  misc_feature (18)..(19): n is a, c, g, or t
  misc_feature (25)..(25): n is a, c, g, or t
  misc_feature (62)..(62): n is a, c, g, or t
  misc_feature (238)..(238): n is a, c, g, or t
  misc_feature (242)..(242): n is a, c, g, or t
  misc_feature (260)..(260): n is a, c, g, or t
  misc_feature (405)..(405): n is a, c, g, or t
  misc_feature (445)..(445): n is a, c, g, or t
  misc_feature (461)..(461): n is a, c, g, or t
  misc_feature (466)..(466): n is a, c, g, or t
  misc_feature (505)..(505): n is a, c, g, or t
  misc_feature (507)..(507): n is a, c, g, or t
  misc_feature (544)..(544): n is a, c, g, or t
  misc_feature (553)..(553): n is a, c, g, or t
  misc_feature (555)..(555): n is a, c, g, or t
  misc_feature (567)..(567): n is a, c, g, or t
  misc_feature (586)..(586): n is a, c, g, or t
  misc_feature (592)..(592): n is a, c, g, or t
  misc_feature (594)..(594): n is a, c, g, or t
  misc_feature (597)..(597): n is a, c, g, or t
  misc_feature (604)..(604): n is a, c, g, or t
  misc_feature (615)..(615): n is a, c, g, or t
  misc_feature (624)..(624): n is a, c, g, or t
  misc_feature (627)..(627): n is a, c, g, or t
  misc_feature (629)..(630): n is a, c, g, or t
  misc_feature (648)..(648): n is a, c, g, or t
  misc_feature (654)..(654): n is a, c, g, or t
  misc_feature (669)..(669): n is a, c, g, or t
  misc_feature (671)..(671): n is a, c, g, or t
  misc_feature (702)..(702): n is a, c, g, or t
  misc_feature (720)..(720): n is a, c, g, or t
  misc_feature (725)..(725): n is a, c, g, or t
  misc_feature (735)..(735): n is a, c, g, or t
  misc_feature (801)..(801): n is a, c, g, or t
  misc_feature (805)..(805): n is a, c, g, or t
  misc_feature (821)..(821): n is a, c, g, or t
  misc_feature (872)..(872): n is a, c, g, or t
  misc_feature (885)..(885): n is a, c, g, or t
  misc_feature (977)..(977): n is a, c, g, or t
aattgttcaaatttttanntttaantgcacagtatgagaaatgaacttttttaaatcaactnatttgtatggaaaatgacacggcaaataaattagacctatgttaaagcgaaggtcagctaaatatccaaacttaaggatataatgggcaccgataaacagattccacagtcttctttaatagagtatctttcaaacacaactttgctagaaactggtccaaagatcgacagcacgngggnatgcttaacagggggggngatcagggacacgtttcctgggggccgctttgatgatgttgtccacacgcagaatcacctctgctgcttcagctgcactcagaagaacctgtcgcttcacttgaaaactttctgttatacccaggatagccatatctccaatggngccttccctcatatccaatccagcagtggtattgccttcnctgggggcagccctgngctgngccaccaggtctgcactgtcatagcctgcattgtcagcnanggtggttggcaacattctcagtgctttagcataagantccattgcnanagcttctttgcntggtgttctattggcaagntgtgtnanagnatgagcnatcaacatctnagaaaagcntcntnnataaaatgttctagagtnctttanagtttgcgcaagaananaaagagcatcatgcaatgatctttctgcttnatctaaaatttgttgagnggcancacgcaaaanaatggtacaagcctcaccaagggcaaccccagaaaagtgaatgagtttgtcttctccaatcatganttcntcgataagtttgcaanttccaagcttcaccagttctgggtgatcaaaggtagaggcaatttcaccanctgtgaaaagagntaggcgttccacacctgcaaaatctgcatgctcaatagccatgacaacagcagcaccaaagagctgttcaggataattataaattaattgcntgtaaataaagcaatttattccatgctttag

SEQ ID NO: 600633 - DNA, 842 bp, Homo sapiens
tggaaacagagtcttactctgtacacccaggcgggagtgcaagggcgtgatctcagctcactgcaacaccgcctcccgggttcaagcgatttttcctgcctcagcctcctgagtagctgggattacagacgcagccaccatgcccggttaattttggtatttttagtagagacaaggtttccccatatgggccaggctggtcttgaactcctgaccttgtgatccgcccgccttgacctcccaaagtgctgggatgacaggcgtgatccaccgtgcccagccgggaaaatccattttttgaaaataaatcaattatgtcttgaatgtactcagaaaacgagctgtttaaaatgtcccatggtgactgtatatgtgaacaaggacctctaatctggtatttaattgggcaaggatgggggatgtgcatcaaatcttcacctcggggattcctgaggctgggtctactgggtcaccctcaacaccgaatacccaccccactcctagattattaactacaaatttagccttgacaccgcctactgctccaccaccgcatacgtgttagggcactacagaaacctgggagtaacaacacgcgaaggcaatgacatgggcgaggctggttaaaaaatcactgatcaaaaccccccagttaagtagccatgtggccgcaacagacggaggccccatgaaccacagggtgtggcgcatgaagccgaaaaaaggctgaccacggcggagactgccggctccaccgtcgagtccggcggagcagaccaccagcggcacggcacgaggtgaggccccgccacaatagcggtgcccggactccacacgacgac

SEQ ID NO: 600634 - DNA, 264 bp, Homo sapiens
tgacaccgcacgctacgtctgtagctaacctagcccaaactcataaccttgagtacactcatgagaacaatgccagacaaatacccaatatgagaaacatcctggcaaatttctgattagtacttcttaaaaactaaaacatcatcaaaaacaagacaactcttgagaaactgtaacaggcaaagaggaacctacagccacaaggccactcaacatgtaatgtgggtatctgcgatggagattcctggaaccagacaaaagggg

SEQ ID NO: 600635 - DNA, 174 bp, Homo sapiens
acacttcggagctgagggagtgatcgctgaggtaggagttgagatcagctggacatgtgaaatctcgctctactaaaaacacgaaagtagctggtgtgtggtgggtgctatagtctcagctactcaggagtctgaggcaggagaatcgcttgaacccaggaggtggaagtttca

SEQ ID NO: 600636 - DNA, 111 bp, Homo sapiens
cgactctagcaggatccccccagttcctgcttcttgaaaatgtccgtgtctaagtggctatcctagagcgtgcggtaccactgtcccaactactcctcatcactcctagtt

SEQ ID NO: 600637 - DNA, 281 bp, Homo sapiens
tgttaccaatctgcctatccaagttcaggatcacaggtggctgcagcgtattgcagcagttcagggtacaaggcaggaaccaaccatggacaggatgccattccatcataggctttgctcatacacacacacactcactcagattgggacaatttagacacatcaattaacctaacgcacacatctttgggatgttggaggaaattggagtacatggagaaaacccatgcagacacggggaaaactaacaaactccatatagagtggccttcggtgggaat

SEQ ID NO: 600638 - DNA, 208 bp, Homo sapiens
ggttctctaaaaccagcatcgagatgtagtttcctgagcatgagggctccagcagtgagccttcacttaacttaagggaccttggattatctgactaaaattggacgattgatcagctggtagacaatctacttcctggattttgtaagggcaaaacattctcccattggcatacatccatgtctctgcacatccttctttgaaaata

SEQ ID NO: 600639 - DNA, 1276 bp, Homo sapiens
gcttcgctgggtagtattgggacccgtcgggtccggggctctccggagcgggcctagacttggaggaaagactggcgagtgtctccggcgcagtggagcaggcatcacggccgggagccatgagttaccagtcagagggtctagttcgatcgtggagcccggctagccggcgccatgtttgcccataatacggatgtaaaagtgtcctgtcggcgcgttctcctgggtagtatctaccgatttgtgatcccgctttctgctatgatcgtgacagcgtcagtatagcaagaactttgactagctcttacttgagagaacatgacgatgggttcgtaccagtaggatgatgattgattgatgacgaaaacacggaattgacctgaaatggacgacctgcacgtaactggaagaagatcggtggatggctcgacaagtttgctgctgcgcttccgctatacagccagaacatggctcaggaggaacggcccctcagggctccacagatctcgtgtggaagtcttacctagtatgggtccgatgaccgatattgccactcccagggctcctgggagtgctcccctgatgagtgtgctcgtaccagctaagcacatgcacatgacacaagcaagtcgagcatttacctggaattaacagtaagtgaagtattcaagagagaagaagtgtcataccatcttctgaggtaatagattgccgcggggtgggggcccacacaggtgggaaagaccacacaagagccataatgggggcaacgatcggacccgggcaaccagaggaacgccaagtggcccggttgggggacagacgcggggaaagcatctcggcgccggggggccgccgaacaaacggagaggcgcgaattcaacttccacgaggagccggagttgacccgggctgagagcaatcagagcagcgagaacaaaacacagggggagtgagaaggatatcgattacccacgacgtctccccgggccccggtggtcacaaactaacacgaggacgagacacagacatcaacgaaagagacagatgcgcaggggaggaagagaaaacagagggggaactagcgagcccccaccgggaggaggaaaacgacgcccaccggagacatctgggcaccaccgcagacccaccaacgaggaccaacggtaagaggtagaaagtgaggaccaacgcgacagcaaggacacagaagcccaccacgacgaaccaaggcgcacgggggagaacgacccgctcgacacaaacacaacaaggc

SEQ ID NO: 600640 - DNA, 423 bp, Homo sapiens
tggctcatgcctgtaatcccagcactttgggaggcccaggcaggcggatcatgaggtcaggagttcaagaccagcctggccaatatggtgaaaccccgtctctaccaaaaatataaaaattagccgggtgtggtggtgggtgcctgtagtcccagctactcaggaggctgaggcagaagaattgcttgaacccaggaggcagaggttgcagtgagccaagatcgtgccactcgccactgctctccagcttgggcgacagagcaagactccgtctcatgaagttcatcttattaatttttttttgtcatttaggcttttgctattctgtttaagaaatcttggagccgggtgctgtggctcacacctgtaatcccagcactttgggaggctgaggtgggcggatcacgaggtcaggagttcgag

SEQ ID NO: 600641 - DNA, 398 bp, Homo sapiens
  misc_feature (28)..(28): n is a, c, g, or t
  misc_feature (31)..(31): n is a, c, g, or t
  misc_feature (34)..(35): n is a, c, g, or t
  misc_feature (37)..(37): n is a, c, g, or t
  misc_feature (40)..(40): n is a, c, g, or t
  misc_feature (43)..(43): n is a, c, g, or t
  misc_feature (74)..(74): n is a, c, g, or t
  misc_feature (79)..(79): n is a, c, g, or t
  misc_feature (85)..(85): n is a, c, g, or t
  misc_feature (88)..(88): n is a, c, g, or t
  misc_feature (94)..(95): n is a, c, g, or t
  misc_feature (100)..(101): n is a, c, g, or t
  misc_feature (268)..(268): n is a, c, g, or t
  misc_feature (272)..(273): n is a, c, g, or t
  misc_feature (277)..(277): n is a, c, g, or t
  misc_feature (293)..(293): n is a, c, g, or t
  misc_feature (298)..(299): n is a, c, g, or t
  misc_feature (333)..(333): n is a, c, g, or t
  misc_feature (336)..(336): n is a, c, g, or t
ttgtatggtctgacgtgtactcatgatnggngcnnanagnagnttacggcaacttgaattgacgggtcgcttgnattgncgggtncgnatcggnncaccnnctgtgaaaccacaggcaacgcccagccctggctatgaactcctacaaatgggaccattctcgagcgcgtgacgggggcacgctcgtttgccgtcgaggcgcttagttggagttggccggtgcgcacgcaggccgcggagggtacccgtggtcacacctgaccgccgngggnnctcntccggacccgtcaatncaagnngccgttaacagctgtatacctactctcaggcggncgnacgtgctagctacatgtgggccctttaacgcccatatgagtgacgatattcttaactcaggt

SEQ ID NO: 600642 - DNA, 215 bp, Homo sapiens
acggacgcatcatttgttatgtatcagtagtcatcaggagcaggtgtgaaatttctcccattctttatttgctgttcactctgatggtagtttcttttgctgctgagaacgtcttgagtttaattagattccatttgtcaattttggcttttgttgccattgcttttggtgtattggacataaagtccttgtccatgcctatgtcctgaatgcgt

SEQ ID NO: 600643 - DNA, 247 bp, Homo sapiens
ttcccccttttttttccccataaaaaacccgggggcggtccaccccccgggttttttgcttgggccgcggggggggttacttttttcccccgggaaccgttttgccccttgggccttttttggggccccttttgacccggtttgtcccaaaaagccggttgggcccggtccggttttcccggggtttttttgccccccgggtccccccccgggtccccgggcgggtgggtttaattttggattccca

SEQ ID NO: 600644 - DNA, 334 bp, Homo sapiens
gtcgacctgggatctgatgagttggaaggaagacagttatggtggtgaataaagatacacagccaagtgcagtggctcattcctgtaatcccagaacttttgaggccaaggctggaggactgcttgaggcaaagacttccagaccagcctgggaaacatagggaaactccacctctataaaaaataaaaaatctagcctggtgtggtggtgcatgcctgtagtcccagctacttgggaggctgaggtgagaggattgcttgggcctgggaggtcaatgaacagtgagccgtgatcatactactgcacttcagcttgggtgacagagcgtcgacg

SEQ ID NO: 600645 - DNA, 530 bp, Homo sapiens
ggtaaactaatcattttattatatataaaaatataaatgtctttattaatattttattatatctaaaacactgtccatgcatttattaatcttttaaattaatgtaagagataggaagaggccaggtgtagtggctcatgcctgtaatcctagcactttgagagaccgagataggcggattgcttgagcccaggagtttgagggcagcctgggaaacatggctaaatccgtgttcaaaaaatacaaaaattagctaggcatggtggcgtgcacctatagtcccagctattcaggaggctgaggtgggaggattgcttgagcccagcaggttgaggctgtggtgatttgtgattgcgccaccactgcactccagcctgggcaacagagtgagaccctgtctcaaaaaaaaaaaaaaaaaaaaaaggagagaagaaaataaagaaggctaatatataatttttcttaatagctgagttgtgattcattttaccattatattcagaattgaccttaatttgttttccagaatc

SEQ ID NO: 600646 - DNA, 109 bp, Homo sapiens
cccaggaacgctcagcctgaccttgccaggtgacaataatgcctccagcaagggctacggcggcgccgatgcgttgcttccagataagacggttggtgagggcagggcg

SEQ ID NO: 600647 - DNA, 139 bp, Homo sapiens
cttcacaacgctatacttcctcaacgctttatactccctctacgcttatacttcctacaaaaacatacaagcaggaaagcgtggagaagtataaagcgtggagaagtataaagcgtggaggaagtataaaggcgtggag

SEQ ID NO: 600648 - DNA, 147 bp, Homo sapiens
gctacgagggagacataacggaatgctccaaatgggtggcgtaggaactgatggtcccatcctcatatctcttgactaacaccaagtccacaaaatctcgtggagagtaaatgagtcttcatggcatgcggagaggagatggaggat

SEQ ID NO: 600649 - DNA, 310 bp, Homo sapiens
gatactaactagtatggataacggggtgtaggtgtgcttgtggtatgaagtgggctagggcattttaatcttagagcgaaagcttatatcactgcgcccgtcataaggggatggccatggttaggtttatagatagttgggtggttggtgtaaatgagtgaggcaggagtccgaggaggtaagttgtggcaataaaaatgattaaggatactaagtataagagatcaggttcgtcctttagtgttgtgtatggttatcattagtatagaggtaagtaagattagtaaatcgtgagtacgtaatgtgagaa

SEQ ID NO: 600650 - DNA, 292 bp, Homo sapiens
tgatgaggatctgacagtccggggatgcgtcttccaggcctccccatcagcgtagggatgccttcctctaggtcctttaggaggtgatagtcatcgcgtgtccgaggtgtcatacacacaggtagttggcgaacatactcctgaggaccccgcacggtgctccagaccacgactcgatgacggcgcacgggacgactgcggagcacgcctctagactgggactttcctgtctgcgtctttcatccatgattggacgggatgtcggaactagacgtctgacgaacgcacgaca

SEQ ID NO: 600651 - DNA, 384 bp, Homo sapiens
  misc_feature (3)..(4): n is a, c, g, or t
  misc_feature (6)..(6): n is a, c, g, or t
  misc_feature (149)..(149): n is a, c, g, or t
  misc_feature (195)..(195): n is a, c, g, or t
  misc_feature (279)..(279): n is a, c, g, or t
cannantcgggccactgcactccagccatgggcaacagagcgagactccgtctcagacaaaaaccaaaaaaccataaaacaccgtggggcgcccaggctccaccatggcgtctctgcagccacctgggccatgggtggcacaggccagntgttcccgtctgcgctcagaaccgtcccaccatcgtgcacagtgtntgcatacagaggctgagaatactcaaatgtccactgtaggaggacggagcaagtgcatcagccccgggacgatgcccaggtggngaggacgtaccccaccacgtggccatggcaaggcagtgtgactgggccccgcgttctgggtgctgcatgctgggcatggctggcgatggggccagggttgggctt

SEQ ID NO: 600652 - DNA, 1045 bp, Homo sapiens
  misc_feature (704)..(704): n is a, c, g, or t
atttaccatctcacttctagagaactactagtatatcgctcactagcctcatatcctgccctactatgcctcagaaggaatggttactattcgctgttcgttatagctactctcatagccctcaaccacccacgtcccttctgttagccaatgagttgtgcctatgtgccagtactagtctttgccgccctgcggaagcagcgggtgggcctagcgccatacgtgagtcgtcagatctccagagcacgatatggccctagacgtacgtagcaatggaccctagacctagcatccagatgctaaaaactaaatcagtccacacacaaagttagtatttacatactccaccttgacgattcgactcttcgcgaaaacacaacgagcaagtagattttgacatccaagcaactagacgcaccctcgacgaggccttgacatgccatctaagcggatcaatccccttgctacttaattttttttaacccaacaatcgaaacaatccaaaccctatttaggcctggtgtcccccccaaaggccgttttctctctgccggacacccccgcttaaaggaaacccctcccgttccggtgagagttacgttaagacgtcacccgtgggaggttgctataaccccaatccaacgaagttgcgatgaggcgaaggccaaaacggcgccagcgttgtattgccggggtgaaaggcnactttaatctccgttcatgagaaaatagcttcttaagcaatcttcgtagttaacttaaattcggtcgcccttggactaagattccgtccttgtcatagtttatttgaaacctagtttcaagcaagccccagcggagaaacctaatggtccactagtatgtgtgcatgattcttatacataacgggagagtggcatacaacgttttattccccgcgaccgtttggggcgtaattcaattccagccccgaatggaaggcgcaaaaatcaaggtccgaagacacccgaccgtggaaaacgccgaggggcgcctattccttgtcccataatttccttagaaaacg

SEQ ID NO: 600653 - DNA, 219 bp, Homo sapiens
gataaatcccaaattagtttgggtagcaggatcttctgtattggtatgaactggagcctgctggtgtaaatattttctcgacccggggctgctcgggcccctgcacagcacaggctgcggctgcagctgctgggcggcgccggcggttctttgttccggtggctaaggtcttcatctgggccggccggacagcagccggggcccacagcagcggaacca

SEQ ID NO: 600654 - DNA, 880 bp, Homo sapiens
  misc_feature (377)..(377): n is a, c, g, or t
gtgcgaacaccaatcggacgtggagtggtgaccggtacctcgattgtcagtgtgcgatccttctgggtagatcagtgacttcgactgtgagttactaatagaaggagtgactacacagtaccatagcgtcgtcaaagcgatttctattgtccatggtcgtcgaacttattgacccgggatctcatagagcgtgtggtacctagggcgagttgcagcgtgtttccagggaaatggcacggacgattgcctgtgggagtacgtgtagcatccacgtgtctatgtgtattgccctgccagaggattcgggtgtgcgctcattgtgggtgctatctcttgcacatgtctcctctctagtcacaaaacgctcttaacattantcccctgagttgaaggttcagagagggggagactacagtactcctctgagtgagaaccttgaacatacctatgtattgtacatgtgctgtgaatacgtactatgttgcgtatctttgcacgttatatgtatgtcgatgccatgtaattctgttcttcaactaacctacgttggagcagcttacatggggcgttacacaaagagggttaaccctccatgtaccgaacgagcaaattatccgtgcaaaaagcttggctcgccgaagggttccccacggtgcttaactcatgcttaggggcatcatggtctcaaaaaatattgtgcctaattttttgcgaccttttgctggtcctgttaaatcttggagtgggtctcttggaaagtttggtggccgcggttggagggcacctcaatccctttaaccaagtttcgacggaaagaattcccctccgggtggggtctgcgactgtgcgtcggtagcaaccccgtatgtggcggaagaac

SEQ ID NO: 600655 - DNA, 272 bp, Homo sapiens
  misc_feature (68)..(68): n is a, c, g, or t
  misc_feature (205)..(205): n is a, c, g, or t
gatctcacgatatgtacaatctatctgataactaactgtgctgagaatagtaggctcacagtactgtnagagaggaataaatactgagcaaggctgcaggaagatgtgtgcttttgtgagcagcgtaacacgggagcctgcctggcagcagggtttttcaaagacaaaccttgggaggaagagaaagaagtggagaagagcaganccccttttccctgcaggtatcccctggagctccagaggacagagggcagctgcgggcttaagtgata

SEQ ID NO: 600656 - DNA, 119 bp, Homo sapiens
taccctcacaagacctgacctctccttcataaattatacttcctacactattaaagtttaccacaaccaccaccccatcatactctttcacccaccacagctatcgctggcccccaacg

SEQ ID NO: 600657 - DNA, 442 bp, Homo sapiens
tcatagtgtccaaagagcggtccctctctagactatcagctagatcctcaagcagatgcagagggatctgctgggcaattcaaagttgagctaacattctatgctgggcaaggagatatcagcagactcggtagatttgtcgcctgtcaccataaatgctcccagtattatgctacatagacgagtgaggtctttaaatgctctgaagtagctagtcatgaccacaggagtattagcttgcactgtccttacaaagttatctctaggaatctcaccatacagcaggtatatgggttagtccaggttataaacgtcgtgataatggcatctcatcgatcccagttggtaatatctatatcgcgacaggtttcgacatcaattgcgtatactgcagttacagaaacgggccgggtatggtcgtcaggtagtaagttggagagag

SEQ ID NO: 600658 - DNA, 354 bp, Homo sapiens
cgcggagcacctgtgatctatacacaatggaatcgacttaatgtgagataacttcaaacaaagaaatgggccatggagggtagagacccttgagacttgaaaaaaggtggacccaaaaaaggcccacaatgagctggatttaaggtgaaattaaaggaaaaagaagggcccttgaaaccaaaagaagaaccaggtccgcccccaaaaccaaaacctgggtgcccaccaaggttttgcttgcacattaatgggaaatacacttgttttaacttggccagttgtttttcccattccaacttttattgggaaaggaaggggggttccagggccaaaacagaaaacaagggggtttgc

SEQ ID NO: 600659 - DNA, 588 bp, Homo sapiens
cgtgacaggttgctcattgtgtgatccaggctgaagtgcagagtgataatcatgtttgactacagccttgaactcctgggttcaagcgatcttcccacctcacagcctcccaagcagctaggagtacaggtgcacaccaccatgtccggctaatttttaaattttttgtagagacagggttgcactttgttgcccaagctggtctcgaactcctgacatcaggtgatccacctgcctcggcctccgaaggtgctgggattacaggcgtgagccaccatgcctggctggttttgaagaagcaagccacatgagttccacagtttgcatggaaataaattctgccaacaaacatgtgaggttgggagaagaccccaagcctcatatgagacactaattccagccaacaccttgatcacaaccttgtaagtacctaagcagagggccagctaaactgcaccccagacccctgaccacaggacaggagattaatagatggatgattaagctgctaaattgtgttgattcgtatgcagcttagaaatgaatacatcatccattttacaaatctaagctatcacaccatcgatt

SEQ ID NO: 600660 - DNA, 125 bp, Homo sapiens
tacgggtgaggtacagtctacgtggtgagtgtacagctacgggatgaggtacagctgccttgatgtgtgactgaccaggcaacgatttgttcctggcccttcctctttgtagacttgtaagaacc

SEQ ID NO: 600661 - DNA, 803 bp, Homo sapiens
atggcgccttcctctgtccttcctgctctttcttctctgcccagtgcctgctgcagctgcacatgcctctgctacacctgggctgcctgggagtgcttcctgtgtgtggtgtctggaccccacgtgccttgtgtgtcatcactgtgtgcattggtcttggggtgtggggtgtcttgtttgttgtgtctcttccagctggttgtcatgttgtgccttgaatgtccctctgctattttgtgtgtggtgtgtgtgtgtctcttcaacccccatgtgccacattatgtggccaggtggtagagggttcccatctattgtctgtggcaggtgctgatgtggctggggattgctctgtagaccccatgcttggagcccacacctaagagggcttggcaatccagcatcaatttcaccctgcagttgaaggtgaaagatgtgccaccaagtgttggcatgcaacatgccacagcccgtatccccagctgtcaagagacgtgatgtggcacaggctggggtagctcaggcaggccagtctcttgagcctggtggctcctatccagtgagcttgagaatccaagcctgttctccagtcttcctttgccttgcctggggtagctcagttgccccaatgcagaggcaccggtggatcaggggggtccacttgtggctcttggccctacacttaagggaaagcatttcttccccagtgtctctttgtaggtgggtccccagagttggcgacccttgccgtttgccagcgggttctgctgccggagtggtccttctgctgaccccttggtgctgtg

SEQ ID NO: 600662 - DNA, 143 bp, Homo sapiens
tagtacatctgcaatggattgtgtgaggaactgctccagtttcctgatcaatagtaataagccgacctatagctctgagcccaataagttgaaggcgccgcacttccttccggtacaacggactgatacaccgcaagactgtg

SEQ ID NO: 600663 - DNA, 1168 bp, Homo sapiens
  misc_feature (351)..(351): n is a, c, g, or t
actcctagccttactaccagcacaaccgttagtccaacaccatttacccgaaattaaagtataggcgactagaacattgaacacctggccgcagtagtatataagtaccgacacagggaacagatgaacaaattatgaaccaagcataacatagccaaggtactaacccctataccttctgcataatgtaattaatctagaaataactttgcaaggaagagccaaagctaagacccccgaaaccatgacgagctatcctaagaacagctaatcagagcacacccgtctattgtagcaaaatagtgggagagattgtatacggtagacggcgacaaacctactcgagcctgngtgatcagcgtgtgttgtccaacgatcaagtacactctttagttcacaccttgtagcattctgcccacgaggaaccctctaaatccccttgtagaatttaactgttagtccaaagcaggagacagcctctttggacactaggcaaagagaactcttgtagagagaggtatcaagaatttaactacccatagtaggcctagaagcaggcaccagattacgaaccgcgttcgaaggctcaagcaacgcactagcgctaagaagaatccgcaaacgttataactgaactcctcacagccaatgggatgcaatctatcaccctatagcaagtaactgaatgttagtataagtaacatgaaagacttcgtcctccgcagtaagcctggcgtcagatttaaagacactggaactgacagattaagccagccccagtatcttacaatccaaccacaagtcattatttaccctccacgtgtcaaacccagcacaaggcatgcccataagggaaaggttcaaaaacggtaaacaggaatccggaaaatttttccccggacgtgtttaccgaaaaaattaccctttgacatcaccaggaatagagggacacgcgtgccaagtagacgttttaacggccccagaatccctaacggccaaagggggacaatacaaggcccaaaagggcacgaaaaaagaccccaggagcgagcccattattaacggaaagacgcccccaagggagaacaaaaaaagacaggcaatttatagagcaacacacaccaaaacaacacagggggggagaaacaacactacatacaacgacaga

SEQ ID NO: 600664 - DNA, 407 bp, Homo sapiens
ctacccttccggtcttccagggtttgtactacagagcagaattggctacggccgctccgatgtgataggtgaatctctggaccggatccagaagtcttggaactcatcctgaccctgctacctgcaaatccacgccagttacctcatccatatacaaaagaagacatggtttcgtcctcctgaatgaggtcagagggctataggaatgacagacggccatgtatggacatgctctctaaagtagacagtgagctggacgggtggaatggcccccgcccatgtctttgacggacaagccagtgcagtgacaaacagggcgtgtgtgcactgtctgtgtgacatatgtggcacgtgttgcattggacagagacggtctatgaccctcatgaccgtgtgtacctgaatgt

SEQ ID NO: 600665 - DNA, 198 bp, Homo sapiens
agaggcctgccaccacacccgactaattttcgtatttttagtagagacggggtttctccatgttggccaggctgttcttgaactcctgacctcaagtgctcacctgcgttggcttccaaagtgctgggatacaggagtgagcactgcgcttgctgatccagcacttttaaaatgatgcgctaaaggcgtacttggctt

SEQ ID NO: 600666 - DNA, 110 bp, Homo sapiens
cccactgttacagccttgaggtaaatataactttttcccagaaaagcttcctagcaccccagaggcagctacaatagctgcatctgagcgcataggcttagtactctgta

SEQ ID NO: 600667 - DNA, 116 bp, Homo sapiens
  misc_feature (88)..(88): n is a, c, g, or t
acttgcttcagcctcccaaagttctgggattaacaggtgcgagccactgcagccagcctatatttaactatatgttttttttcttttnggctaaaatttttcagattagtttacaa

SEQ ID NO: 600668 - DNA, 1462 bp, Homo sapiens
tcaagaatttggtttaatttaattatgggctagaaagacagggtgttatagccaaaatcgggcaatggacactaagaagaaatcctacggggtcttgttcaatatggcagaattattatttgcttcccaaggatgttggccctgggtggtggatcttccaagatgttcatggtgtaacttcctttacggtggagaacttctcctgtttctcttatagtgtgggtggatattctcgtgtgagaagacgccggtggcgccatgtgaacagagctgtgtgcctataaggtttgtggcgcgcagggtgacactctccttgtgaaagtgttctctgtggcaagatagagcgtagtgttacactctgtgtggcgcgtggccaaagtggagcccaggcgagagatccccattcgcgtggagcgaggggcggagcgtgagtggagtgaggtatgagaaaagacagtatgtgtggacacgaaggctccccacacccctcgagggggaacagcgccggggaggacgtctctctccctctgcggagcctcggtgggagcaggacgatgcgcatattattctctctcgcgtgagcgtgggcgagacagacgcctgctggctgctgagaaataccgtggaagatgtgtattcgcgtggcgtgagcgtgaagagagagattacaacatagagattatatctccgctacaagggtgatatagtgggatgagtagaggagtaaatatataagacgccgatcaatatcacttgcggtgggaggagcattaccactactatcgtacaatagttcgccgaacctctccggtgggctcccccaaacttcacaggggcaaaactcagtggtggtaagaaatatattctttatacccccaccacaaaatggggaacatgtgggcagttggcttggggggccaaaggagggtgtgctggagacgacaacaatatctacgacggggtgtattaacatctaccgggggggcaaaacacaacgggtgttggaaacgaattcaccattatattctacaacaaagatgttacgcccccacacaattataaggggaacaatctttggacatcccacgcaagtggtgttggaaaattttaattaaactgttaccaaaagatgggggacacgcattttcttttcaagacacctgtggctaacgctcccaacacggcgggtggaacaacatctcgaggcacatagatacagccaacaggggggcctaccaagggggcgaaaaacgaccaactcccatcttatgtacctatatgacaaaaagagttccccccaagacacggctaacagaacgagaccacggtcctagcggaaaggcccttataagatggagaaaagaagaaaatcctgatgggcgcagaagtgatagagggggagcacaacaaccagcgtcgacaccggaagagacgatcactcaaacggagactacacaggaga

SEQ ID NO: 600669 - DNA, 148 bp, Homo sapiens
  misc_feature (54)..(54): n is a, c, g, or t
tttttctgcctttagggtagtacagctggcatttgttttatagactcttgtctntggaattaggggtatggtttttttttttcaatctgttatatgttctgtgtttaatgaagaaaacctatttattaatgaaaaatataatacatat

SEQ ID NO: 600670 - DNA, 85 bp, Homo sapiens
cctagcctacatggctccctgtttgttgttaaaaacttttgttttttggggttttttttttctgaattacaacaatgattctact

SEQ ID NO: 600671 - DNA, 358 bp, Homo sapiens
tttttgagacaaggtacttgctccgtcacccaggctggaatacagtggcacaataacagctcactgtagtgacctccagactcaactgatctttccacctcagcctcccaagtagctagggccatagctgtgcgcatgccaccatgcctggctaattttttattttttatagagacagggtctccttatgttagccaggttggtctcaaacacctgggttcaaatgattctcctgcctcagcctcctgaaatgctaggactacaagcatgagccaccacacccagccaacagagtcttttgggtatccattaggattcttatattatctagctcctatttacatttgctatgtcgacg

SEQ ID NO: 600672 - DNA, 458 bp, Homo sapiens
atcgagggtctgtcctgttcgggcttctgctcgtcctggcgtgtcttctgccattcaggtcattgcttgcaatgctctgactgtcctaccccggttgctgattgtcctactgccgtcaattgttcatcttattttgatgcgtgtctcattaccataagctgggttacatagctgtatgacaagtgttggacacttcgagcattgcaatttcaacgacgtcacaatccgcttgaggtcaaatgagctatcgtactactgctgcaagaaggacctgtgttactttaacgaccagtcttgaagctggtgggacatccttatcagagaagacagttcttctggtggtgactccttttctggcagcagcctggagccttcatccctgtgtcgacaccaggagagcttctcccagactccccgttcctgcgtattccgctttctcttgctgccacattctatag

SEQ ID NO: 600673 - DNA, 96 bp, Homo sapiens
taagagtgacaaaaagtttattctgtgcttctcgcagcataaggcaggggataaaactggagagagggccgggtgtggaggtggagtggaggacgg

SEQ ID NO: 600674 - DNA, 678 bp, Homo sapiens
gacatactccatagatattaatggctatattctgtgtatcctgttacatcaatcaaaagtttggaagtgattaaagttatccatggcaaatagtaggatatggtggggacaagtgacaaatacctattatgttggtctgggaataagaaagaccgtgcagtatggaacagggtgatcagttatgacatgaacgggaatagtcgttggacagagatcttggagatgcagcgttttgtggaatctgtctgtcgtaagagaagatatcagatctgcatgtggatgttgtgtcgaaggattaatttcggaggttagaataataggattggacgggggcagcgtgtcacaagggaagctcttcaggcgtcggggatgatgatttctgcatgcaaagcgtgaggacactgggaatatattctacctgaaagaagctaactgcccgtctctcgcttgaagactgaactagtgcttctttttatgcttcctgttaaccatgaatggatatcatttgggtcagagctgcccgtcacctgtcagattatgtaagtctgagtcgtgtgcaaagtgatgttcagttccattttcaacatgtttaagcaatcatattttcaatttatatatggtattcttaatattatgaccaagaatttatcgggattaatttttcagggtaaggtagtg

SEQ ID NO: 600675 - DNA, 1359 bp, Homo sapiens
cgcatcttcagttgtgtatatgtgctacgcgcttgttgccctccaccttcgtgtgctcccttattggggtgtgtgctacacacggtgtagtcgttcttgctatataatagcgaccaattttttttgtctgccccccccgcgcgtcttttcgtgtgctaggattgtcgctcgttggttgtcacccattgtgcgcgcacgatgcccaatgtggttccacggtaaccaccaattttttggtgtgaagcgcccccgttagcttctcattacggggggcccccccacccctttagatgtgttttcgtgaacccacagaacgggggtgatatacccgcccctccttttggcgtgggcaatacccaatggggaggttcaatttttgcatgttttgtcccacgttgcgttgagtgtgccaaagccgcaggtgtccgtgaaatctgtgtggatttgccgagctcagtattttcgccgggctaagtgcagcacaccccttttttttatgggttcaacggcccattgttgcgtcccaaaggtggttgctactgttataacagtttggtgtccaacagattttgtggttatacaggaatgttgtaactcccggtgtcccctttcttggaatatctatgaaatcgccactgaggataatcatcttgcccaccccagttgtacccggaatataggggatagctcgtttgaataaaatatggtgcacctgcaatagttggttctgagagaacccactttgtgtaagagcctctaaaggaccccacgctccatgtctcgcctcgatagccccactataaagtataattggcgacgtattttctctttcaaagggagactctctgatttctcggaataatgtccacaggagatatgtagtagccacgtttaagccacaggcttcttttcctgcttataataggagataaaatagaaaaaagaaaatagagagacaataatagataataacaggagggcacacagatataaggtatacaccaggatagaaagatatgtaagaaatacaccaacaccttgatagggagatattcgggaactacccacggaggatgtaagaatgtaagaaggagaaatgtatgaagaatttggggcccagaagttccccattagacacctccttagtgccaacccacccacccacttacgtattggtaatctctgcaacatctgcaacagttcacacaatgtgtttgggaaaaaaagggcccaatgtggtgacaactcccagcccccatcgggaaaataagaagaaccaaaccaaagagaacccctcctacagcacactttaattttaccaggaccaacatatgtctttagccccaccaaaggcagata

SEQ ID NO: 600676 - DNA, 496 bp, Homo sapiens
caagcagttaatatagactcacggtgaaggctatgttaacgcccaatgacgggtgctatcgtaggaggttgcactggaaggttactacaaggacaagctctttgaccagcggatagctccgtttggagaattggcgaggggaagaacctggatctgcctaatggtcgggagagggccatccagcgctatggagaagggagacctattccatggggtacctcagagcccgagctaatgctaaggggaccgtgtaggaaaggcaaatgttccaatatcccacccaaatgctgacgggacaatatgaattaccactctcaagagtttggaaaaggcccaaggactctggggcacatgaattcgagacagcagcaagctggacaagaagcaccatagtgacaccacgggccacctgtgtacttcagggcaagtgtaaatacaagcaagcttaactacagtataagaggatcgtgtctgggctggcatatgagtctgtata

SEQ ID NO: 600677 - DNA, 855 bp, Homo sapiens
  misc_feature (78)..(78): n is a, c, g, or t
  misc_feature (322)..(322): n is a, c, g, or t
cacgacgcgtgctgcgcgcacaagattacgtggtcccccgagaccgcaatagggtcgccgcgttggggcccacgccancgtgacctggttgcccgccctgttacttgggacccttggagtcccccgtgtgccgtccgccggtttaatcccgcgccagggtcatatacgggtttatttactggacagcgtctcacccggggtgaccaagcaccgtgaccagacgtgtgagggccagaaaaaaggtggttccaaacccttattaaaatagcccacctggggggctctttacctcgtgcagcacccttaatcctgttgcccgtgngaattatgtttttccccccacggaaaaaatgcctctcgagtttcttcaccctctcgaagccagagtccagggcgtcaccccgagctcattggtactcccccccaccccagatttttctcggagaccattagcccccgccgtcaatggcaccctggcacgattcccgtcgaacagtaatatgtgagaaaccccttcaggtgcacatctctgggccccgctcaagggcatgttcagaattttttgtataaagggttaccccactaaaaggtctttacagcgagtttcctactcaacccccccaaagagtgtccccacttactctgtgcaacccctgtggggttaacagcgggtacccctgcgtgggaagaggccccacaggctacaatcagatttgccccatgtggcgcttaaggcagttgctgcgagatgcagtgtcgcttcatcatcatcacacatgactcagcggggcagcgatgtaataataagggacacacccccgcacataaaaaatttaccttcgatttcaccccaca

SEQ ID NO: 600678 - DNA, 458 bp, Homo sapiens
  misc_feature (191)..(191): n is a, c, g, or t
  misc_feature (261)..(261): n is a, c, g, or t
  misc_feature (298)..(298): n is a, c, g, or t
  misc_feature (348)..(348): n is a, c, g, or t
  misc_feature (362)..(362): n is a, c, g, or t
  misc_feature (376)..(377): n is a, c, g, or t
  misc_feature (423)..(423): n is a, c, g, or t
  misc_feature (444)..(444): n is a, c, g, or t
ttcctacaactggatggtagaaggacatttgcggtagcggttagacctcctcttattgaagagggcgagggataagaggtggtccccaaggggccagaaattcccaagttgttcacaggcggcttaagagtgagtgtcatggttatacggatttcgtttcagcctgcctcagtgtgggcgttcaaagaccngataatctcagtctccccaacccacccccaaggagctgtgggaggctttgtgttatctgtgaaactccanaacaggggtgttgcggagaagggagagttcaaggcanacgcaaggactggacttagctccctaggtgccacagtcagatgccggacncggatttatatatnaatatatatatatnnatatattatactcactcatcacggccatctttgttgtaaccatttntgtgtttataaatgcattatntctgagaattttca

SEQ ID NO: 600679 - DNA, 438 bp, Homo sapiens
  misc_feature (4)..(4): n is a, c, g, or t
  misc_feature (14)..(14): n is a, c, g, or t
  misc_feature (36)..(36): n is a, c, g, or t
  misc_feature (48)..(48): n is a, c, g, or t
  misc_feature (166)..(166): n is a, c, g, or t
  misc_feature (182)..(182): n is a, c, g, or t
  misc_feature (185)..(186): n is a, c, g, or t
  misc_feature (241)..(241): n is a, c, g, or t
  misc_feature (278)..(278): n is a, c, g, or t
  misc_feature (328)..(328): n is a, c, g, or t
  misc_feature (342)..(342): n is a, c, g, or t
  misc_feature (356)..(357): n is a, c, g, or t
  misc_feature (403)..(403): n is a, c, g, or t
  misc_feature (424)..(424): n is a, c, g, or t
ttgnaaggggggcnaagggcctgaaaatggtggggncccccaaggggncccagaaaaatcccccaagtgggtccaacaggtggccttaagaaagtgtgtgttaatggttttaacggatttcccttgaaagccctcctcctcccttcctcctgccctacaaagagcncctatactcctcagancanncccaacccacccccaaggagctgtgggaggctttgtgttatctgtgaaactccanaacaggggtgttgcggagaagggagagttcaaggcanacgcaaggactggacttagctccctaggtgccacagtcagatgccggacncggatttatatatnaatatatatatatnnatatattatactcactcatcacggccatctttgttgtaaccatttntgtgtttataaatgcattatntctgagaattttca

SEQ ID NO: 600680 - DNA, 321 bp, Homo sapiens
gatgcatttgcgattttgtcgttagatggactttgagccacaaaaaaaatacgcaggctttcctatttctccaactgattgtactatatgcattttgtaccagtggaccttattatactggagattaaacaacaaatggaaatttttgtggcttgctctggtgggccccttcccactgactgatttcacagtttgcatttcgggttgcttgcattgcattgcattgctcagcaaagcacagtagcttttcttttgcagcaattaaaacctttggcttgatttctttatatcccttggcttatatccagcattagcaatttt

SEQ ID NO: 600681 - DNA, 740 bp, Homo sapiens
gaggcaataattaatagcctaccaaccaaaaaagtccatggaccagatgaattaacagccgaattctaccgagagtgtacacaacgacggcagctggtaccattccttcaaagaactacctcgcgaagactaataggataagcgagggaatcctccctaactcatttgatgagaccagcatcatcggctgataccaataatctgtgctagagacagaacaacaacagagaagaatttcaggccaatatcactgatgaacatctatgtgaaaatcgctcagataaacgtactggcaaaccaaagtccagcagcacatcaaaaagcttatccaccacggatcaagtcaggcttcatccctgggatgcaaggctggttcaacatacacaaatcatgtaaacgataagtccatcactataaacatgaacgcgaatgacaaaagaccaccgtgattatctcaataaatgcagaaaaggccttcgacaaaattcaacaccccttcatgctaaaactctcaataaacttggtatcgatggaacgtgtctcaaaataataagagctacttatgaaataggcaatttcaaatttcaaaatgttctgaaaaactggacaatcatctggatttcaggtattattctatcaaacacgaaaaaatatacagtgccttctcctcttactgtgaaatttgcgttctagagtcatgtgtactagtatctagtctctctgtcaatcttctaggagga

SEQ ID NO: 600682 - DNA, 168 bp, Homo sapiens
ccgcggtctgtcttacgttatgaaatacttatggcagcttctgtggaacgagggttatttttttggttaagaactaggaattcaagctggcattctttatttctaggcctactcaggtcaaaaatcagtgcgggcttcgcgctgtgcgttagacattaccgcgggggc

SEQ ID NO: 600683 - DNA, 286 bp, Homo sapiens
  misc_feature (18)..(18): n is a, c, g, or t
ggggcggtatctctcacncagtctggagtgcaacagcgtggtctccgctcactgcaacctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 600684 - DNA, 460 bp, Homo sapiens
  misc_feature (136)..(136): n is a, c, g, or t
  misc_feature (163)..(163): n is a, c, g, or t
  misc_feature (184)..(184): n is a, c, g, or t
  misc_feature (253)..(253): n is a, c, g, or t
  misc_feature (263)..(263): n is a, c, g, or t
gtctgttcttgaagtgctaataatcccaagtaagtttctggtggtcactaaatcatattgaaacacacacacacacacacacacacacacacacgatctgtcgccttgtcaatcccaatataaaggcaataatttnttacctcattaatggatctgtcctttntcttttcaaactcttccttangttagccatgaaatctagctggggctgtgtggtttctgattccccctggcttattctttactttttccnacttttccangctcagcagggagctgctggatgagaaagggcctgaagtcttggaggactcagaggatagatgttattcaactccttcaggtggtcttgaactgagtgactcatgccagccctagagaagtgccttttatatattggagcaagagcgtgttggcttggctattgacatggatggtgagtacctatctatgagggtga

SEQ ID NO: 600685 - DNA, 360 bp, Homo sapiens
cactgagcctggcctggcgcgggcctggatgggctgctgtctccgggggtgcccctcaagacactcaccttctgaaggtggacagcaaccttggtgacccggggatgagcttgcacaggggctgccaggcccaggacccactttcccccccagtgccccactagcctggagtcagtccctcccacacctttggccttgggcagtggggatgctgccacttcccggcctggctcttgcatgggcctgggcagcacatgcagcctgaggttcccacagagtgcagaggccttggggtaggccccagatggccattcctcagccctgcttcaggagctgatatggtgaagggaaaggtccctg

SEQ ID NO: 600686 - DNA, 181 bp, Homo sapiens
  misc_feature (168)..(168): n is a, c, g, or t
ggtctccccatgccggctgcgcttctcttctcccgtgcgatggccatcagtatgacggctgctgctttcgtatcatccatggcgaccaccatctccgtgacgtggactatcgctatgccgattgccagtctctccgtgactgtgacggctgctgccccgtgttctcangtatatttctctc

SEQ ID NO: 600687 - DNA, 908 bp, Homo sapiens
gactctgtaggcgcgcagggccggatgatgctgtagacccggaccggagcagtcggaggcggtgaataatagctcttcaagtctgcaaatagaaaatggctccaacaaaaggtacattgcaaaagaatgggagaaaaacagaatgggcacgagtaaaaacagtgtaaggaggcagagccttgaaggaaatgtgtcgtgggaagccaagtgcctatgatcgacggtgttagttgaatggcgcacagtggatatatattcctgaaggtgcaagggggattacggatgctgtacaaatattgggggaaaccttgaaggaacaaattgagatgtgtccaagcaatagattgaaggcgttggctttaatgtctcagaaagcggggcaatgaaaaaagatgtttacaaaaaagaaaatctcttaatcttgagcagtgaatcgtgaggtgacggcattttcaagagatggaacaacagagatgttgtgaaatggcaaagaggattttgccagaggtctagaatctgtgaagaaaatacttggtggcaaaagtacagctagtggaagaagttgttgtgttctcattgaagtgtgacacggattccagattgaagtcatgagtgtgggtctggggatcatgcgggcaaatatgaacttgtcctccaagttggtcattgttgctattgagagaggactacttgcgattcttgtacaggaggattaatgttgactaatggtacattggtcttatatataatgattatttttttaaaagtggtctaataagataataggggcacataatctctcattgaacatttgatggggtgacaaggtggaaagtgtagggttctgtccaacgggtttggacaaacaagagtgtgatagaaatgacggaatgaaaaatatggaggca

SEQ ID NO: 600688 - DNA, 414 bp, Homo sapiens
acctgggtactggtcgtatggcctctctcctttgagacctcacacttactcaagacagccatagagaaatcggcctatcacaagtcagacagaaacgggaaactgccacttatgaggcagaatccacgtcctgtttacttccaccaagcagcagtggtagcaaagaagaaagtccaagaatcctaatagcctgtcctcttggaaagccaagactcatcccaaaggcacttgcagaagaaccactcccgaatactaactgaactcttacatccacaaagagttggggggaacaaattttacaactgagaggaacaaattaagaagattgggggaaccaatgactcaggacagcatgtgggactaatgtaccaccccatagaccaactttagctcccgggatacactaccgactgc

SEQ ID NO: 600689 - DNA, 324 bp, Homo sapiens
gaagcggcaggaggcaggaccactcgggtcttgtgctggcacagcatggcgggcgcgttggtgcggaagcggcggacatttgtcaagcaaggatttcgggacatcctatgagatcgacttcttgggccagatgcaacttgggtcttccattgcagcatcaatgatttaaaagtcttccagagattctcagtggcggatgacatttgccctctgttgctattcctttagacatcatgagtttgccacaaggacagcctcggaactgcttgttgcagtccacgcacaattgagtgccagctcatccaggaggcggcttatcaacac

SEQ ID NO: 600690 - DNA, 1286 bp, Homo sapiens
  misc_feature (16)..(16): n is a, c, g, or t
  misc_feature (25)..(25): n is a, c, g, or t
  misc_feature (87)..(87): n is a, c, g, or t
  misc_feature (238)..(238): n is a, c, g, or t
  misc_feature (251)..(251): n is a, c, g, or t
  misc_feature (304)..(304): n is a, c, g, or t
  misc_feature (321)..(321): n is a, c, g, or t
  misc_feature (324)..(324): n is a, c, g, or t
  misc_feature (446)..(446): n is a, c, g, or t
  misc_feature (521)..(521): n is a, c, g, or t
  misc_feature (557)..(557): n is a, c, g, or t
  misc_feature (580)..(580): n is a, c, g, or t
  misc_feature (644)..(644): n is a, c, g, or t
  misc_feature (699)..(699): n is a, c, g, or t
  misc_feature (720)..(720): n is a, c, g, or t
  misc_feature (866)..(866): n is a, c, g, or t
tatttttctctttttntatttcccntattttttttattttatatttatttttttaaactttataatttatacagtccccttccctanttatgggtatgaaaaaacttagaggcctaagcggccgaacacacagctacgcgaacacacgcgtagacaacgacgacggctctcaaacggtgcgtttgccgtctacgtcgtacttattactctcgcccctggtggctcgttgcgcgtcaanctcacacccagtngacaaagccacgccgggccgcgccgcgccgcgccgcgcccccacacccaacanaggaggagcgggaggangcncagaggagagaaactaagaaagacgaacgcaaaaaaacaaaacgccggacccgcggcatacgaccaccccgcgcacgcgcgagggcggcggcgagagaaggaagggctatgcaagttaattngtgtgtatgcgcgttgttcacctcacatcagctctcgccgaccactagtcagagagacgaaacacggcggagagnatagagaagaagagtatacatactatcattataacncatcactcaactaacgcagtaangcacaccactagcgagcacatatacatcttgatgattcttctcgcacacggcttgctaaatgcnggctatgcgatgtccggtgtgtgggtgagaagacggtctgtatcaacacagaggncatacacacaagatgagagangtgagagacgcgcgacgcgcgagaggagagatgcgagcgagtgcgcgtcgagctcgagtactcgcatgatcagctcagcgacggacacatggtatttgtactaattctatacgtacgagcacgacgaacaagcgtggccgtggtancggtgcggccgccgacgctgtatacgcgtcagtgagaacggaggcgttgcacacggcagagcatagcacgaagcgaagtgggacggtgcgagaaagagaggagcggcaggcgtgatgcgagacaccagagtatcctgcaacaatatagcaacccgtggtagtgtgatgtcggatgcagtaactgccctgaatccggtacgtcatatacactagatctagtcgacacgcgccaacacgtcaagagagtcgttcggtctgaaagcgacggcggctgtgcaccgtctccgcattcagcgcggccatgccacacggcggccgcagcgacccgtctcagatcgacggtcggcacgacatatgagctgtacgatagcgtacgcggggtgatgtcactagcataatgcagcaaggtgagtcgcgcgt

SEQ ID NO: 600691 - DNA, 105 bp, Homo sapiens
gtcaagatctctgctgctcctcttcagctccccgagtgctggaactacgggcatgccactacacccggctaacttttgtattttttgtagagacgggtctcgccg

SEQ ID NO: 600692 - DNA, 646 bp, Homo sapiens
tagtgtaacagtatatggatattagcatagacacatgattgtatattgtgctctggtaaaataggtatatatgcagagtgattaatatggtgagaaaaagtgatgggaaagcaatgtgaggtagtaactagtaatatagggtagctggtgaggtgataagatttgtgagtttcataatgacttgtattaatccgtgtcaaagaaaaaattagacctcttggtttctccagggcatagaaatttcagtttcaacccaggattaacgaactttataacagtgtagtccagtggtgaaacagaatccttggtaatttagaaatatttccttcttaagacctttagaattttaatctgatagttctgcttattatattttttatttcccaaagtgaacggttcaaagaataccattaacggtcatttggtattacaatccttccattagtcaaaattaaagattggaaaataatttgatagtccatttggtatactaaggttggattcttaaagaatctgaagcaaattatgtcttttctattaacatttcctaaatcaactcacatgaaaattaatagattatcatcatacatgacgatcggttttctctcactgcgcataggaatatgttccctttactacttatcgg

SEQ ID NO: 600693 - DNA, 900 bp, Homo sapiens
gaagagatgattctgctagtggatggttaaaagttgttagacgggtctcaatgaatatttcagctatactgtaaccctaagatgatgtcttgggggttatgaagtcagtaagtgcggatatattccccagttctttcaaatggggtcatgtaatggagcatgtctagtttagggtggtatgatggattccagaccatatatggctgctaagggaaatggtctaccttttctctcctgcacctggttccatttatgtaacagttgagatgtagagggaagtcattttctatcatcaatcgtgtgtaaatccctcttcaagaagggtattcagcgagcttaaagttagatgctaaattgtttttaatattaagggaaggtgtaatgcggttgtgagattctgaaattaatgagaatactgatttcagaaatgtcatttgaatgcgtttttcttcttgtgacgagtgacgcaagatcagcttgaattccgatatgtccctgagttatttgtgatcatgaagccacaaatgtgttataagcaaggcaagttgtaatatatataatcctgaactcatgaccagtgtctcagggtataaatgtcgccttgggatggaacacgtacgtgacattcagggtgtcgtgacacgcaactgtcctatttatgtgttcgaattcacttaacggtggagctttttatgtaaaagacgtctgggattgggatgcttaccggtggcaattgccaaggcggtatccattggggtgggcacggcacagatataaccgcccattggccaaacacgtgggggaatttccaccaaggtctcgggtcgcggaaacagcgtggaggagaaacaccagagggaagcagcgaggccaacaaaatggataagagggacccagaaa

SEQ ID NO: 600694 - DNA, 715 bp, Homo sapiens
atcaagcataatggagttggaccactctgtaattgacccaggatgagacggagtgtacttctggatggtgacgtgagaatgtgagcctcagaatgaaatgtaagaacagcaggctccatgaggactggctgcagccacaaactgcaggtcactgtatcacaggtgctcaggtaggaagagagagaggctctgtgagcttttgtgtatttcacccagatggaaactatgcattcataaaatgatttgagactgggtgatggataggcaggcgtccgtaactcccagactactcgggactgcggaacgccggagcaaacgtcctcacaaccttgggacgcctgacctgaggctttccaacctctaggaaagccccggaagaaattctgctgccatgtcaaacgccagcctatggggaccacagaaccaagacttggctctccaacagaaaagatagtatatagtaggactaggactagtaccacgtacccacaggcggcaccaaccgtcccccctacgtagctagtacactctccccaggtacagcaacatcagcaatacggcaaaagaccgagccccgcggcgcacggagcgcaagccacgcaggcgctggccgtgacgagagcatgagcacacgccacgccgggcgagccaagcgcgactatgcggaccgcgcaagcgcaacaaagaacacaaagacaggggccccaccggccgc

SEQ ID NO: 600695 - DNA, 689 bp, Homo sapiens
  misc_feature (24)..(24): n is a, c, g, or t
  misc_feature (29)..(29): n is a, c, g, or t
  misc_feature (276)..(276): n is a, c, g, or t
  misc_feature (341)..(341): n is a, c, g, or t
  misc_feature (384)..(384): n is a, c, g, or t
  misc_feature (389)..(389): n is a, c, g, or t
  misc_feature (412)..(412): n is a, c, g, or t
  misc_feature (436)..(436): n is a, c, g, or t
  misc_feature (492)..(492): n is a, c, g, or t
  misc_feature (539)..(539): n is a, c, g, or t
taatagaggcatgggtctcacggntgttngcccaggcgggtctgaaactttggggctcaagcgatcctcccaaaacgcggggattacagtcatgagccaccggtgcccagcctaattcctggacttctctatacagagtcttcactggataggcactcgtctggtagtaactcagttggaatatctttagaaaatggtttagaatttatttggtaacaagatgggtaaggaataagattatcccatatgcatttctggtagagcagaattgggatnagcttagtggtctcaatctttttggaaaataaatggtttacctggtcatcagatttaattaaaanttatacttagtaattggcactattacttagttaatttttggtntggtntgggaaatatgggtagtactacnttggggaacctggttacggacaantggatgtcattaacaaaaggcctagtgggattagatgtttccatttctctaatttntggctggtttaaaagtgcaccttactggttctggagataccgggcanaagtctttacaaatggtttggtactagacccagggttgtacatataccataggctgggggtgagagaccctggaactgtgtaatacccttaatgttccccatttttctagtgtatcctgggtctttaaagcaactggtcattgttgtctg
